United States Patent 7,745,391 (HUMAN THROMBOSPONDIN POLYPEPTIDE) - sequence listing, part 235

SEQ ID NO: 634335 - DNA, 885 bp, Homo sapiens
  misc_feature (1)..(1): n is a, c, g, or t
ntcgttctgctcgccttgtagtgtttggccctgccgcgaagacgagcgatggcggggggtcgtatcccgatgttgatcgtgttcgcccacaatgagtgagtcggttgttgtggcatgatgataggcgatgaacagacgcttttgtggtggggttggattgttctcgtgtccccccgagtgattttttgttggtgcccctgtgctattctggtctctctcgccgaacaggattcgtgtttggtgtgtttgcttcggattccgaccccccccccgcccccgctctgtgtttgttttgtgtcggctccgccccgcgtggatggtgtgtgttagcgtgccgagttccaagggctcccgcctgctttttggttgtcgttctgcccaccgtgtttttgctggtgggcccccctcagatgagcgacgcccctcctccatgttgttggtgaaccgtcgtggggttgaacgcccctcccacacttattgtgtgcggcggcgacccgcccctcgcttgttccgtcgctcgagtccgccctcttcctgtcgcgtgagatgctcctgtcctctctccttttgatatatggtccgcctctcccagttctttctgtttgatagtttggttgtgctcccgcgccgcgttgtgtctcttagtttggtattttctttgtttgcgaccaccactcttgttgtccgcccctcgtggtgggtcatccctcactggtggggggcttcccaccgctcgttcgtctcgcgcaggacggatgacttattttttcttttttttcaccgacctccgtggggggtcgtctccctcctctttccctttttcccccccccccccgccgctcccttttttttttctttttctccctccccaattttccccccaca

SEQ ID NO: 634336 - DNA, 885 bp, Homo sapiens
gggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcgtagctcactgcagccttgaattcctaggctccagtgatcctctcacctcagcttccctaatagctaggattacaggtgtgtttgggcctcccacccaccccaccttcacacctggctgatttttcaaaaagtttttttgtagaaacagggtctcaccatgttgtccagcctggtctcaaactcctgtcctcaagtgatcctcccacctcagctttcaaagtgctggaattacaggtgtgagccactctgctggctaccactaacttgaatacattcagaatcactcctctccccataatgtagaaatagttttgaggaagcaaagcaaagcagaactttaaagtatgttcttgtcttgttactgtgtattaagcaaatatagaggtgctaaatgttcatgtaccttctcggccatcaagatgggtttcaagtgcatttgtctgacattcttgcagttacaaagggcgacacctgaagggttgggacaaagatatttgtcacaggcgcatgtgtaaacgcccacgttggtgttatggaagaacattttgggggcgcgccacagaatgtgaaaggttgtgattgtaaataagagagaagtgttac

SEQ ID NO: 634337 - DNA, 81 bp, Homo sapiens
gctgaggacactgccgtctattactgtgcgaggtccctcccgggctattactactatggtatggacgtctggggccaaggg

SEQ ID NO: 634338 - DNA, 117 bp, Homo sapiens
ggctgaattgttaagtcatttgctccagggtcagggcccttgttcaaggtcacagagcaggtcagcctctgaaggaacattactgccccacgaaccagccacgcaccaaacgcttct

SEQ ID NO: 634339 - DNA, 846 bp, Homo sapiens
ggccaaggtgggaggattacttgaggccagcagtttgagaccagcctgggcaacaaagtgagaccctgtctctacaaaaaattaaaaaattagctgtgtttggtggtgtgcacctgtagtcctaactacttgggaagccgatatgggaggattgcttgagcccaggaagtcgaggctccaatgaagccatgattgtgccactgtaccctggcctggggacggagtgagatcctgtctccaaaaaaagaaaagatgtcaatattaactccataaaaagcaaaatgtaattaaaaatatgtagtaagaatacagcaaatggttcagctgtgaataatatttacatattcataccagtgcaaatgttgaatactgatttttaaataaatgattatatagtgatagcagggggatgggaaagagagagagaaagaagactattcttgttttcattagtgtggagctcatagaaattatctaaaactgaaaaaaatcaaggaattatagtataaacttttgatagaaatagaaacatggaactcaatagaaaagaagcatctaaacggttgaatacgattgccacttaggtgtgggaatcagaagtgggcaggaaacagctatttttaattacaatcctctagaagaatttgtttttttaaacaatgtgcatatatgtacatagtgtgcaaatctattaatgtaattaatcttatcaacattttacaagagctgctaaaagcatcatctagtaaaatcaattaaaccacttagtgttaaaacatttaacaaagacgaaatgacacggaatttctgcaggatgtctaacccaaaacctgttgcactattaga

SEQ ID NO: 634340 - DNA, 125 bp, Homo sapiens
  misc_feature (100)..(100): n is a, c, g, or t
  misc_feature (117)..(117): n is a, c, g, or t
gagcggtctaacaaaacactcatcattccacaaactcttattacttcaaaaaagtgtgtttaggcagatcctatcaggatgcaccatagagaacactctngagaaaggggctcactnctaacatg

SEQ ID NO: 634341 - DNA, 461 bp, Homo sapiens
gcctcctgcggaattggacactcggctctcacaggcctcaagcaccaccccaacacatctgtaccatgtgcctctcccaagcaatgcgctcaccccgggtggtgctctgcatagcacatcgccgacagatccccagccttccagcctggcctggacaccctggagtctgcctgcctcttctctcgatcacaccacacactcaaccccctcactactgcacagccatctctactctctaccctagtctccttttccagctccgagcccagcagccagagtgatcgtctcacagccccggcacaagcatctcccttcagcacctttcagaagccctcatctcacttccaaccatagattcagcttccaagggcccctcccacctctaccccagcaggccaccctgcttatcactctctgtgtggggaacaggctgctgcctctgtctgaacaatctcctccag

SEQ ID NO: 634342 - DNA, 931 bp, Homo sapiens
gctcacgcctgtaatcccagcctcccgagtagctgggatagcaggcgccgacacacgcccggctaatttttttttttcttttagttttgtttgagactcagtctcgctctgttgcccaggctgaagtgcagtggggcgctctcggctcactgcaacctctgcctcccaggttcaagcgattttcctgcctcagcctcccgagtagctgggattacaggagcgtgccaccactccgggctacacttttggtgtttcaagtagagatggggtctcaccatgtggcttcaggcagatttcgaatcccttgacctcaagtgatccacccgcctcgcgccttcatttacttatttccttcaatacacacggggtcatgttgccagccaatgttgcccaggctggtcgtgaactcctgggctcaaggtgatcctcccgccttgccctgtggccttccaagtgctaggattacaggcgtgagccaccaaccagccctgccctgaggcaccccttcccaacactccggatgtccctgacaacacttcatcacaccgccctcagcagtgtcctgcccatcctcacatcataggatctccgtgccttcggccacgagctcctgaggcttcaacagccccctgggccacgagtaacactccaaggagccctgtacaccaacgaaatcggccggccgcagccctaatgcaccactcgggacagcgactaccctgcccacaacaaccaccagcccccactgccctcacgacccgagcaccgactagcacgcaccggagacgcacgacacacgaaacacacgccacccccccgacacgcgtaaccccacccggacccacacccgcgccgcacgcagaaccaccacccaacactccacggacagggcacaaccagagccagccgcgccgaccacacccaacgccac

SEQ ID NO: 634343 - DNA, 137 bp, Homo sapiens
  misc_feature (6)..(6): n is a, c, g, or t
ctacangtatgcctgaaaaatataatttccccagatgcccatcagaagcggtcatcagaacggaatacagacaagagtaaaagaaatgaggtggaaagagagcatcaagagagagagccagatgagactgaagacat

SEQ ID NO: 634344 - DNA, 189 bp, Homo sapiens
atggctccttccaagcatctcatcactccttcaaactctctctccttccaacatctcattgctccctctcctcttccctctcctcctcccccctgagggaggagatgtggagcgatgagatgttggaaggagagatgagatgttgaaggagtgatgagatgtgggaaggagcaatgagatgtgggaagg

SEQ ID NO: 634345 - DNA, 222 bp, Homo sapiens
tgcagtttattgatgcagtggatctatgcaggtggtgcagtgtaatccattgaatgaagctgattacatgcagcttggtagaattgatacggattgaatgcagtggattcatgcacgtgtgattgaatgcactgcattccatgcagcattgtgtaatgcactcagagtgaatgaagtggattgactgcagcttgggccaatggatcctgattgaatgcagag

SEQ ID NO: 634346 - DNA, 150 bp, Homo sapiens
aattatctatcggttactgaggatatctgcacgttgaagcactgcaggttacaggttcaggcgggagcatctggggggggcgttggagagggcacaggcacgcatgtgcgttgtccagccgcttcccattgtgacaggtgcagacaggcc

SEQ ID NO: 634347 - DNA, 565 bp, Homo sapiens
atgtacttttcactatgcttaaaaaacactgtatttttgtgtgaccaaaatagtaaatcagtgaaagaaggttatgttctccattcttcaaaactgagaagtttattagtatttagcaaatctagactcactggttaaagtatgccttggtttaactattagtttattatatcaatactgagtttaagatcacagatttgagttgatagtgttaggtagctattacagtattaaaaagatagtgttttgcaattatgtattatctgagtgcccattttggcagtgggtttctagttgtgttttgctgagacccagggctgctgtacagattaagggtaggactaagggacatttcagcaagctgggctctaacccttttctccttctcaccctcacccaatatctgcatttatttattctgcacaggaaacctttcctctttgaaaaaaaagtttatattatatttaaaagtttggagacagttccatgcttagcagttgttctagtgaatctaaacctaaatgttgatgttcttcctttataccattgtagggatctggttaaa

SEQ ID NO: 634348 - DNA, 111 bp, Homo sapiens
tcccttgtaacgagcgcatcttagatatcaaagggggttctgttggtgattactggaatctgggtgttacggagggcgctcgttaaggaggcgctcgttacgggtgcgtgt

SEQ ID NO: 634349 - DNA, 413 bp, Homo sapiens
ccactatgtctatattggacatatccataatgactggctttgcattatacagaatgctggtcttggctctgtcgtacctcggctatctagttgtcctcactgccccctagccgaccccatcccatctgactgactaccccatcacagcagtacttttatttacgttttgctctgcctaatggttattttatactgtcacgcctgatccgtgtccaatttcagtggtctttgcagttgaaatgctcccgttcacactgtcttgtttaaaatgccattaagttcatacaaaccgctagcttgcacctcctcgtctactttcatagagcgtagggctgggatgggttgtttaccaagcttctggcactgtgtggttcgctcttcccactgggaagatctgtgtaccctgtaattcg

SEQ ID NO: 634350 - DNA, 112 bp, Homo sapiens
ttcagtctctcgaatagctgagactacaggagtacaccaccattcctggttaattttttatttttgtaaagataggggtgcgtcacattgcccaggctagtctcaaacccgc

SEQ ID NO: 634351 - DNA, 815 bp, Homo sapiens
  misc_feature (403)..(403): n is a, c, g, or t
  misc_feature (516)..(516): n is a, c, g, or t
  misc_feature (518)..(518): n is a, c, g, or t
tttttttttccttccagggccggtttaaccgggttctttttcacaaaaaaagttgggccaaatatgtattggcctctttatatggaaataactccaatattaaaaatgtttatatgccaggagaggttttcttctctcctctcgcgtggaagagaggtttctcttctctctcgggagaggtcttctctttacacgagcgggggctgggttctctgggaaaggcgtggtgtgcgctcttattattcacccacaccagagagaggtcttctcttgtgtggtcttctctataacacacacccacacagagacagagactctctctctctattctctcctttctctatacactctcacaccccagagagtgtcttctgtgtgcgctgtgagcaagacgcgggcgtgnctctctctctctccatatgtcgtgagtagtgtgcgggcgtgtgtgtgtgagtgtcgcgcgcgcgtcgtgtcgtgtgcgcgcagcgcgcgcgtcgtgcgctcctatatactacncncacccgctggagagctcgtgtgtgtgactatcctccgtcgggcgcgtcgtgtgcgcagacaccaacatagtgggtgggttctccccgccggcgccgcccgtgtgggtctctctgtgtgccactatgtagtggtgtatatcaagacgactttctccacacacagtagtggtactctctcctcagagagtatcttctccaccagaggagtggggggtcgtcctctctcctctcttgaggagaggacactctctcgtgagcagaagagtggaggaactcttatatctgtgagaggcggag

SEQ ID NO: 634352 - DNA, 360 bp, Homo sapiens
accgtgtcaagcgggctcgctggcggcgacggaccgagatcggtgcctcagctgttcgagctggacacgagagcacgtctccagactggagtgcgacgtgcccaccagctgccgacggccacgacgccaggtccggtgcacgtgacaagcaggacatgacatggtccggtgtgactgcgatggacagaggatgcgcgtccggccttcctgaacaccttaggctggtgaggctgcggcaagaagcgggtctgtctctttacttcctccacggagtcggaacactatggctgccctctgagactcccagaagccacaagatgacagaaatggtgctacccagctcaagcctgggcctttgaa

SEQ ID NO: 634353 - DNA, 210 bp, Homo sapiens
tacttagatatacgaagttaactaaatctcatatccggctggtcaatatcgtgccagccaccgcgttcacacgattaaaccaagtcaattagacgccggcgttaaagagtgttgacagatcaccccctccccaatcacagcttaaactcacctgacgttgtaaacaaactccagattgacagcaaaatagactcacgaaagtggctttaa

SEQ ID NO: 634354 - DNA, 538 bp, Homo sapiens
tagatccccccgggaaaagggccagcctgacccagtccccgggggtgaattttcccagcacattgtttaagttgattaaaaagggttttagaaagcaggggcccccttctagctgtttttttgggagggttaaaaaaaaataaaaattcataccccaagggattccccccttgggttgttggtaaggttttgccccacccgaaaggcccatttttttagtgaggggggcgttagggttttaaaaaagggaatttgggcccacctcccggttggagggggccagccccccccgcttggcggtttttaaatgcccaaaaatgccccggggtaaccacccggggctttttaggaacccgcccctggaaaaggcatgttccccaaaaggtttttgggggggcaaaccccccccgtaaaacaaaaggtttcatgaaaaaaactgtttttttttgccaagaaaagaaaattttaaggccttgttaaaattaatcaagggcccgcgggggcgggccacttaaaaaaggttgcttttcttgggcca

SEQ ID NO: 634355 - DNA, 244 bp, Homo sapiens
  misc_feature (29)..(29): n is a, c, g, or t
  misc_feature (42)..(42): n is a, c, g, or t
ggaggcgcctgcctaatacatctctcctngcatatcccatcntccattatccaacacaagcatatacgcccatagccatcatttattgactcctagccgcagacctcctcattctaactgaatcggaggacaaccagtagctacccaccatcattggacaagtagcatccgtactatacttcacaacaatcctaatcctaataccaactatctccctaattgaaaacaaatactcaatgggccc

SEQ ID NO: 634356 - DNA, 1372 bp, Homo sapiens
gctggtcctgagcttcggagacttagaaatgggtatgtgcttcagcggtgctctgacttcaggaagccagtgaagccggtgtgtgacgtcacgtgcagttagtctgtgatgctctctcccagagcccagccattcatccacatcaaataaagacaagtcctaggccccagcttggggcctgtccccggggtcacctcacagacagcatcctgggatcaggaaaatccatgatgttcaacctggtctggagaaccagactggaaacctagtggactttagttcgatgggcatgtctgctcttggagcagtgtcttgctgtgtgctacgcgtgcctatcatcttgaacgtacccggttgacaagagtcttccagccctccgaggtgtcgtttcatagtgaaaaccgtgtcatttgctgagtagctaaggagaaggccaatgattataggaaaacttgaggggcattggaaaataggttatcgacaacgttatcccatcagcatggggtcaggcaaaacatgatgtgtgccccgtggaagaactaggaattcgtcattacgccattcccaaacctggaagttccagacagtcaaccctagcggaaagcgcgctctccctgggtcgaaatacaggaagaatcgtagcaaaagtacattcagtctaccaaatacgattgccagaccatagggacagtggctaggtttccccagccgaacgtgcacactcggttgaggcgccacaattattgtttgccggcatggttcgtattcctcacgggggcgatcgtggggtttcccacggcttcatagggctcctgggtcgtcgttatggtcgcacttttgcccttgtaaggggggttgtgctctcgtatgcctttagtctcttggttagaatcacctttggcttggtccaattaggagatttaaggacccaaaagcatttgttgcgatccctgggaatttggtaccccaagtacataatctcgtacgtggctttataaacagacggtcgaggtgtaccaaacattcagctttagagcataaccgtaaacttggagagatccaaacaatcatggtttgcccgtggggcgcccttctcagggggagaaaaatgctttgaaagcccttgcagtgggttccaagggaaggcccaagggtgccctgggggcgattaggaacggttccccaccgcggaatgaacgagccaactgaccttggtgggggaccatttttgccctaggtgggcatcggcgaggaagaatatcgacctccacatggcattgaacgcctccccgggaccctcttggtacacacaccagggtgaggacccctcggggcacgtttacaacagatttaggcaactcaagatcatcgc

SEQ ID NO: 634357 - DNA, 257 bp, Homo sapiens
ttttataaccgctttagtaactgtttgaaaataaaaaggccaggcgcagtggcgtatgcctgtaatcccagctctggaaggattgcttgagcccataagttcaagaccagcctgggcaacatagtgagaccttgtttatacaaaaaaatttttaaatgaggtgggaggatcacttgggcctgtgaggtcgaggctgcaatgaagctgtaattgtaccactgcactcctgcctcagcaacaggagtgagaccctatat

SEQ ID NO: 634358 - DNA, 371 bp, Homo sapiens
cattccctttaatgtccatatttctaccagcagtctcttcaaggcagtctaggtttttcctaacatacacctcaaaattcttgcagctttggccaggcacagtgcctcacatctgtaatcctaacactttgagaggccaacatggacagattgcttgagctcaggagttcaagaccagcccgggcaacatagtgaaaccctgcctttacaaaaaatacaaaaattagcccagcatgctggcgcaggcctatagttccagctacccaggaggctgaggtgtgaggatcgcttgtgcctaggagattgaggctgcagtgagctgagattgggccactgcactccagcctgggagacagcaagaccctatctga

SEQ ID NO: 634359 - DNA, 125 bp, Homo sapiens
gaactggatgctgcaacagctgccgctctgggttgaggtgttgttccttcacgggaatccatgccgtgtatctgcggtatacaattttataggtgcctcattcgaccagttccgggtggtatttc

SEQ ID NO: 634360 - DNA, 391 bp, Homo sapiens
accaggccgaggtacgtcggggcaagccacaatcgtggtggatcactccctatgccttctcccatgaccacccgacagacgtggactacagggtcatggccaccttcaccgagttctacaccaggcttgctgggcattgtgtcacacattcgcggcctttaccacagtgtggctcaagccttcccacgtaattcgcaccccggaaaaggcctccgacgcgggtccagggcccccaagtcaggcaggcacaatggcctggtcgacgggcaccttactgctgtgtgcgcactcccgaagacgttggctactggcgaccgaaaaacccttgggggcacaaggctcacctttccaagggtgtgtgccacaagggccccttgtggtgccccccctg

SEQ ID NO: 634361 - DNA, 301 bp, Homo sapiens
acgtactatgtaccaattaaaaaaaaaaacgagtctatagggcctttcaaatgcctgaattttggacattggtacatcagctgatggattaatatttggaatggctatgtgatggctctgcatgggcatgggggccagtgcttcagtttggacagcattaccatcctgggtgatgacatggacagcaaggtttctacaatggttggaaagggtaaatatattttggattacatgctgccttttaggcatacgctcttattcattccaagtatttatcgaacctgctgttacatattacggg

SEQ ID NO: 634362 - DNA, 178 bp, Homo sapiens
tggtttccccccaggttttttttcccccccccctggggggggacaatggttttgggccccccctttcaaattttttttttttcgggggggcccccccccttggggtgggggccccaacttccaaggttttttttggcccccccaaaggggttccccttttaaccccccttttttttta

SEQ ID NO: 634363 - DNA, 524 bp, Homo sapiens
  misc_feature (355)..(355): n is a, c, g, or t
  misc_feature (520)..(520): n is a, c, g, or t
gagtggatgttcgataacaaggagttgagcacaattatatctgcatattattgcctttccctggtgtaaaattatttcccataaaatgctggcacattcaatcatatataaatcaaatattgatggacttagccctcaattttcaatatctatacagtactagaccatgcattcttacaatattagataccaggtagtatatattgtcactgtacaaaaatgactgtattctcccagcagtaggacttaaactatgtaactccaggtgtcttagctcctgtacctttgggtgatcactagcacccattattgagaaagctggtactacatggggggatagctgtggaatagatantttgctgcatgttaattctcaagaactaagcctgtcccagtgcttcccagtgcttcccagtgcttcccagtgcttcccagtgcttcccagtgcttcccagtgcttcccagtgcttcccagtgcttcccagtgcttcccagtgcttcccagtgcttcccagtgcgntcac

SEQ ID NO: 634364 - DNA, 218 bp, Homo sapiens
  misc_feature (200)..(200): n is a, c, g, or t
agaagaagaagaagaagaagaagaagaagaagaagaagaagaaaacaaaaacaatggcacaatgggagggaacactacaccttagctcaagagaattaagtttcattgttcatttctgtcatgtttttgaagcatgctctacagaggatcagtattccacaaagacaaatgagagctatcagaatgatatggcaaaggtngacgcggccgcgaattta

SEQ ID NO: 634365 - DNA, 212 bp, Homo sapiens
cgcggtgtgggtcggggtaccggcttccctctcggcgacttgtcagctcggtgagccgcgcgcgtctgagcccgtgtcctcacctgtaacgtgggcgccctgcaaaaggacctgaccttcctcgggggtggtggcgagttcaggcacggggttgctgttttcagatgcaattctcaaagcaagtcaggaagagaccgcagggtacggagctc

SEQ ID NO: 634366 - DNA, 415 bp, Homo sapiens
  misc_feature (353)..(353): n is a, c, g, or t
  misc_feature (357)..(357): n is a, c, g, or t
  misc_feature (359)..(359): n is a, c, g, or t
caggatcttatacggtctgttaccctctcgcccccttctacctgtcatccgtcaaattactagcctccatgcgcatcagtgtggataggtgcgtggcggcgattgtgataacatccggcggtttccagggctgccccgaggggttgcctattaacgtgcagatccgtgtcataactcgttgatttgtcgtaagtcgttgtcaggcaccgtgccggcagcggcgagcttcgttcgtcccgaatggatgtgacgaggtttcacccgacaaaggaatcaggcttctcatggtcgaactgtgcaaagaaatcctcccggtcaatatcggagacgagctgaaacagtcctacctcgantacncnatgagcgtaattgtcggtcgggcaactgccctgatgcgcgcgatggattgaaagcc

SEQ ID NO: 634367 - DNA, 454 bp, Homo sapiens
  misc_feature (439)..(439): n is a, c, g, or t
ggtattggcaatcactagatggtccatcctttcgtcacacttccaaattttgtctctgtaactccttccatgggtgttttgtttcctattctaagaaggggcaaagtgtccacactttggtcttcattcgcttgagtttaatgtgtttagcaaattgtatcttatatcttgggtatcctaagtatctgggctaatatccacttatcagtgagtacatattgtgagagttcctttgtgattgggttatctcactcaggatgatgccctccaggtccatccatttgcctaggaatttcataaattcattctttttaatagctgagtagtactccattgtgtaaatgtaccacattttctgtatccattcctctgttgaggggcatctgggtcctttccagattctggctattataaataaaggctgctatgaacatagtgngagtatgtgtccttc

SEQ ID NO: 634368 - DNA, 367 bp, Homo sapiens
gacatattcttttgactaattagaccacttatggctgggattacaggcatgagccaccacacccggcctttgctttggtttttaaaaaaaaagaaatgcaagggaaggaggcaggcttctgaccatctgtctccaaggctgaagtgcagtgcatggtcttaagttaatggcagcttccgtttcctgggttcaggggatggcctggctttgcccgctgagtagctaggattactggcacccgtcacagggcccagctaatttttgtatttttagtagagacagggtttgattatgttggacaggctggtctcctcctgacttcaagtgatccacccgcctcggcctccccgtgatgggactatagact

SEQ ID NO: 634369 - DNA, 175 bp, Homo sapiens
aggatggctagtgcatgtccggcgcatgggcggggatccgatagcctaaatggttatttccttggccggggccgaactagggttggatttcgattggtaatctcttgcgcccagattgggaaatgggggcagatgaggagaaaaaaggctttaattgggacgcagaaccttttgg

SEQ ID NO: 634370 - DNA, 406 bp, Homo sapiens
aatggcctccggcaaccggcgacaggtggtaagtaacagggagtctgcgagttcggcggtggtatctgtcagcacatctggggtgtagccaactcggatcccacgcttcttgatttcatccaaagccaagtggtcgatgcccacacacatggtgctgatgactttgagattggcccttgcagcatccaggatcttcttgtccacgtggtcgaagagaagccagaccagcccgtgggccaccgacacacctcgctcagagctccttggcaggaatgggctcatccgagtaccactgctccacctcacagtgtcccgtgcgggagagcgcgaccctaccctaggcgggtatcctgcgggtaacgaacgccctcatgactcgcagcggtctcatccacagtgcaggccc

SEQ ID NO: 634371 - DNA, 230 bp, Homo sapiens
gaggtgggaggcgaggcacattggcaggctggtcacggagatggaaagatgttaattccaggaacttcacaggaccgaggtcgggaagaggatgcggatagcttcttagcatcccatggcttcagaaaatgcttgtcatctagcaagttctcctcaatagcaggtactttggggtcactttcaccatccagaatacccccatgtcggctgggcacggatgctgggaggtg

SEQ ID NO: 634372 - DNA, 208 bp, Homo sapiens
atgtatgatagtccgtacaaatgaacgaatcactcaccgcataggaatgattgtttatgcgttctcaccttggaggattgtgagatcttaaaggttgggcccatgcctttagtaattttttctttttttttttttttttttttttttttttttttttttttttttttttttttttttttttttttttttttttttttttttttttttt

SEQ ID NO: 634373 - DNA, 914 bp, Homo sapiens
gttgcagtgagccgagatgcgccactgcaccccagcctgggcgacagagactcaaaaaaaaaaaaaaaaaagccgggcgcggggtttcacgccggtaatcccaacacttggggaggccaaggcggaggcagatcacgaggtcaggaaatcgagaaccatccgggctaacatggtgaaaccccgtctctactaaagaatacaaaaaattagccaaggtatagtgggcggggcacctggtagacccagctactggccgggagaatgggcggtgaacctggggaggcagagctggcagtggagctggagatcggcgccattggcactggcagcccggggcgattggagcaagactctatctcaaaaaaaaaaaaaaaaacacctttgtttgggccaacagcgccccttaaccattccaacgaagaaacccttgaagaaaacacattttccccaaaggcaaatgagaagtggcgcgctctcggggcgttcaaggagaaacgccagggagaggggtgtgtgccaggaaatgggcttatcccccagggggctagtcactgggagacggcggctttcttcaccccacgtcgttggaatgcaccattggccggaaacttgtgggcgcccacaatcttctcgtggaacaaactgtgggtctccagcacggagagctatagccgtgtgcccttcatataccccaagacccggttgcatgagtgtgttcacaaacacgtgtgccagcaaccgagtgtctccgtgaaggagaggatccctataccagtagcctcatgtaaacgtatccggcactcagagagcaagactcctaaggaacgcgtgcacaaccccctggggggttcccccagggctgtggcaaaagtgggttctttccccaagaaaaatccaggcgaaaacatcaaatt

SEQ ID NO: 634374 - DNA, 148 bp, Homo sapiens
tgtaaagttgtaaagaaggaacggagaaagtcaaaggaatcgccctagggacctggaagtgtaccgttaacgttggcgaaacaccaaacccgccgagttaatgccccgtacaggcgctaagaggcattttcgggatgtggggcctttg

SEQ ID NO: 634375 - DNA, 535 bp, Homo sapiens
tgctctcagtgaaagcagatctacctcacatctgtgctggcgaaggtttcacaacattggccttcaggaagtccggcagagggagggttttccatttttcctcgaatagatgataacggggagacggggtgggctttccattccaagggcgggcacacaatcacaggggcagggctggagttctggaaactctcacgtgggattttaatttctaaccagggctatgcatccagtctttgctagggttcacttctgggaattaacatattactttttaaatttttatttaacatttttctttcttaagcgtgtaatccataacagggtttcttctcccagttctagatcaccgggtgggccaagccatcatggatgccacaccaactctgcactggagtggacaacatcccaccggggatgggcaggggtgtgggcagcacgaagacctcacaagctggggacctgacagggccatccaccagtcggaaacactctatgggatgagaccaaggcaggactgcgacccccggtgccg

SEQ ID NO: 634376 - DNA, 758 bp, Homo sapiens
ggaggagggacccggaggggcggcgtgggtcgggagcgggcgcctgggactacttctcgtttgaaagtttttcagaggccagaagttgtgagccggggctgcggaaggatccggctctggcggttgccgcgctcggcgacaacgtggcgactgaagatttgctatagaagagagtggcccattcggtgtccacccgtcaggccacaccagcagccaggcacgctcataagcccgcgttacggatggtgcggtcgggtgcacaggcccgagggaagcagaggcctcggcctcccagctcccaacccctggaccacccacagccgggagtaccccatggacagctgtggccgaggagaagccagggatgagggggatggggctcgatcgtcctcacagcagcctgtggtaagggggtatggcccctggcaggtaggagggaagctgaggctcacgagacttcatgaggatgccagctcaaggccatccaggcttggtcctcagtgctgtcattccagtagggtaagtgggacccccaggaggtgtagggggacagtcgtccactcggccagattcacagtctgttcaccgccaaggcagcaggctggactcggtgcgggaccgatggttggcgtggcaggttggagtggccctgggactgaccagcagggggcgtgtgggctccttgagggggccgagtgggggacgtgctgtgttgggtaccctgctgggtctgtgtggggggcacacaggcagtgtgg

SEQ ID NO: 634377 - DNA, 195 bp, Homo sapiens
cctgcgtatcacaatgtcgtgcactgatcaacacccctcattccaagccattgaatctgttctgaagagagagctgatcagatccactgaaagccgtttcttgtaatcttgtggattgtcctcaaacattcggaacaaaacagcagctgcatatgtcgccacaccttcattcctagatatcccttcctctctctc

SEQ ID NO: 634378 - DNA, 246 bp, Homo sapiens
cccttaggggtagcagaagctctgggctgaccaggctgaggcccgcaggtctatgaccagggaaagcacgcaagcgcggtgaaaagcgcttccaggccaagaaaggaggagatcatcaaaacttaatccagggaggaggagaccagaaattaaaacctcccacttggtctgtacatacgggcctcgggtgataacatagatcagccataaaaataaaacaagcctaatctggcgcatacctaatct

SEQ ID NO: 634379 - DNA, 286 bp, Homo sapiens
ccgccgtccttgcggatagtgcacaccaacaccagtgagtgtccaatcatctgggacaaaagtcaaagtagatgataacgccttacaaaaagcaattgccgatgccaaagtggcaggaatgaccactacacaggataagtctgccacaaaaacagtgaatttcaatcaattccctgacacgcaaaaaactatcttggccgattatcaatcacaagctgataatattaatgcattggtccacaagcacactgatttaaataccactctgctaagtcaaaggcaacct

SEQ ID NO: 634380 - DNA, 1189 bp, Homo sapiens
tcgtgtggtcccgcgcggccacaaaaaaaaaagggggaggtgacaatactcacatagaggttgcgaccccttcgtgggagaaggagggagaaagaaaagggtcgccccacaaagaagatagataaggagagatcacatcaccaacaaggggggcgccaacaaaagaaggcgataggacaaaggaagagcgggcgcacatcgaggagaaggtttgcatcgccgacgctacacgccggctacaccgactataatgtggagaagagaagcagcatgtggggtggcgcccccccttttaagagggggaggaagaaacacccaccaagtgaccaccctagaggaggaagagagtagtctagggggggcgaaactctccacgcaaatggggcagcacctccgccctctggtttataacaagcagacagtggcgcgcccccccttgaggtagtagaagacgttttgtgagggccgtcaaccgcgcgacaagaatgttccttctcgtgtgttcctcagggagaaccccccggcgagttgtttttggaaaacctctaggaaggagatttcatagcgggggaccaacaatggtgctatcatttggacgacgggccgcgcgggttagtgggtcgccccacgcgcaaagacccttgtttgacggacacccttctccctttggccacttgggcggagggacgccatctttcttgggcacacaaaggagatatgaactccctcagcgcccccgctgagaggagatacttctaagagaagccgtctcaattgggtgtgagccccaagcagcccactgtcgctgtgttgcccatctgaccgcacacatgggtgtgtttttcttctcctgagtcacacccaggggtgtctaaggccaggcccattcttgggagttctaacggacgtgcacaagagtagagtcgccaaagtgggagatagccaggagagggggcaagcgggtctcagagacatgggcgacccaaggagcctggagagcaccctctcccggagagacaccaagaagtcgaccatctccatctaggtctcagctcccacaccaagggggctatgggatgcacgccccctgtagatcctttttggtatataccctcctgtggaaaccctgacgacactttgcctggccctttccagagggcccaagagttaaaaagtttttggtttttta

SEQ ID NO: 634381 - DNA, 184 bp, Homo sapiens
gggcccccaaaaagttttaaagggctttgtccttttgcacaaccccggggaggaagccaggaccctttttggtttagtaaaaaactgttaggggggggggcccccttttttctttttgaaaaaaaaaaagtaaaagtggggcccccggggttggggtttaaaaaaaaagggggttggcttttta

SEQ ID NO: 634382 - DNA, 184 bp, Homo sapiens
  misc_feature (5)..(5): n is a, c, g, or t
tggcngccggctgctgagatggcaaagggctccttcaagtatgccccaaattttttttgacatgcagctgatcagcagcggggggtcactattgacacctccgtgggcaaatatgagaccagcaagcactatgatactctcatagatgccccagtatacatacacgtcatcacaaactatgcca

SEQ ID NO: 634383 - DNA, 518 bp, Homo sapiens
ttgcatatggcaaggcaagtactttatggctgaacagacacgccactcacaaagaagccaccgtaattcgagtccttccagccacagcagagaagtggcatcaatgctttttaagccttactgaatggaaggctcaaattaatgaagtcatcgttcgctgacttcccccagtaagaatatatctcctatttaatttaaggccggtgaacggcacttacattttgtaaggaattcagagtaacagactaaactagccttttttttttgagagggtttcactctgtcacccaggctagaatgcagtggtgtgatcatagctcattacatcctccaactcttgggctcaagcggttctcctgcctcagcctcctgagtagctgggactacacatgagcactgccatgcctggctaatttttaaacattttcctgtcgacacagggtcttactatgttgcccaggctggcctccaactcctggcctcaagtgatcctcccaccttggccttgccatatgcaa

SEQ ID NO: 634384 - DNA, 921 bp, Homo sapiens
aggtgacaactgaaaaagcaacgaaagtgctttacatacggcgaggtttattgcgtcaataatgaccggaaacacgcgtgtgggttcacacggttttcattaagggggttcctgacagaggttcattctattggggccccagcgctcaaggtggtacagcatgacacaccacgcggtttgaaaagttgtcgctgagtgtgtgggaatgctccctgcgccgtggattgtagcgcccgtgcccgccgtgcgttggagccggcggggcagaccgtgtgctgacgaagagaatcttgtgagttcgtgtcccccggcgtacaccacgttggtgttaggacaaacgattgtacccccgttgggttttcgccaagcgaccatgaggataacccgaggtgtgctgcgagggttactgttaacctccaaaacacgctggtggagaacaacaaaaatggtctaagccacggggtctgtgacctacatcgtgcggtactcccagggatacgggcacgcgtcgccccgatttttttatgctagaggacacggttgtacataaaggctatgggggaatgcgtatagaaaagagcttcgggggaggttctctcccgcccggtgtggcgatgtccaaggacaaccctaactcgggagggggagtggcagaagaaccccgttccatataggcgccaggcgacgtaataacaagcaagaaaagggaagaaaagaagctgcgccagatcgccgaaggtctcggagaaggagggggaacgccgccccccaaagatgaaagaacgggtgatatacttaaccagtacattggggagaaggcggagcaccccaggggagagacatcaaatgggaagaaccgcggattaaatttcttcatgttcaacccagaaaaattttccaaaaatcccaaaaaacataaca

SEQ ID NO: 634385 - DNA, 973 bp, Homo sapiens
caagagtctcggttgttttttttgaaaagtggaggttgttggtgagtaatatgtcgcaagatagttggattgtaaatgtggccaatgtttgggaaggatgtctgaagcggtggtgtagcgccggaaaatgtgttctcagaggggtataagaatgttcgctcgggtgatgagacgagttgctccagggggctaatgggggagtttttgtagcgcccgcggggccccatgcataggttggtgttcccactgtgtgcccccgagtgatgagtggggcacggacctcttggggaatggtaaggagttgtcacacgtgtgggatattgtgtcccagtgtgctgtacccgcgctgggggtgtatgactcgtgggctttttcggttgtctgttgtttcttgtgtttttttgggttgtttgagactatttagaagtaacggcgcccagctcatatcatggagtatagcgggatagaaacatggtcttgatatggggctgccaggaccctcctcagaccaggggttcccctccgcatatattctgcggaaggaagagatatagggatggtggaatatttcagaggaaccccgcgagaaggtggcacaagcacaatattagactttgataataagaagttggtgccacataatatgtggatagtgccacaggacacagcctttgggagaaaagaacacttggagaataaggcttgccacactgctattgtagttcctctctgccacggaaggtgtttcgcgtagaaaagagtataatgctgtaaagaagccccagtttgtgattggggaagatcactggagctttcatggtgtaatagccgtagttttggaaaagacccctggggactagacaccggtgctaaaagtttgacgaactgatggagatggacccccccgcccagaatctgttttaaattcagacttccaatagtggccatatttatatagtgcgtaattggtgta

SEQ ID NO: 634386 - DNA, 443 bp, Homo sapiens
actccatggcactgagttgtttctgtatttagctatgtgaataatgctgctataaacatgggggtacaaaaaaaaagctggtgttggttggtgggttggttttttggtttggttttttttttggagagggattctcgcacggtcgcccaggtgggagtgcaggggcgtcatcggggctcacggtaagctccacctccggggttcaggccattctccggcctcagcctcccaagtagctgggactacgggcgcccgccaccactccgggctaattttggtattttaagtggtgatgggggttccaccgtgtgggccaggagggtctcaatctccggacctcgtgatcttctggcctcggcctcccaaagtgcggggataacgggcctgagccacggtgccaggcctttctacatcatttaagataagccagggagtaaatggca

SEQ ID NO: 634387 - DNA, 455 bp, Homo sapiens
  misc_feature (37)..(37): n is a, c, g, or t
gcggcccctactactactactaaattcgcggccgctncgacttttttttttttggaaacagagtctcgcgttgtcacccaggctggagtgcagtggcataatcttggctcactgcaacctccgcctcccaggttcaagcaattctcctgcctcagcctccagagtagctgggattacaggcacacaccaccacacctggctaatttttgtatttttagtagagacggggtttcactatgttggccaggctggtctcaaactcctgacctcaggtgatccacccgccttggcctcccaaagtgctgggattacaggtgtgagccaccgtgcccggcctgccttctttttttttttaaagagagacacattctcgctccatcatctaggctagagtacagtggcatgatcacagctcactgaagcctccaattcctgggctcaagggatcctccagc

SEQ ID NO: 634388 - DNA, 758 bp, Homo sapiens
caggaacgggctccgcggacgacgggctccaggcacgcacaggcagcgggcctcccaccgcgggtgccgggggcgggggggctgcccccatgcggggcccttcctggttgcggcctcggccgctgctgctgctgttgctgctgctgtcgccttggcctgtctgggcccatgtgtcggccacggcctcgccctcggggtccctgggcgccccggactgccccgaggtgtgcacgtgcgtgccgggaggcctggccagctgctcggcactctcgctgcccgccgtgcccccgggcctgagcctgcgcctgcgcgcgctgctgctggaccacaaccgcgtccgtgcgctgccgccaggtgccttcgcgggagcgggcgcgctacagcgcctggacctgcgcgagaacgggctgcactcggtgcatgtgcgagccttctggggcctgggcgcgctgcagctgctggacctgagcgccaaccagctggaagcactggcaccagggactttcgcgccgctgcgcgcgctgcgcaacctctcattggccggcaaccggctggcgcgccctggagcccgcggcgctaggcgcgctcccgcttgctgcgctcactcagcctgcaggacaacgagctggcggcactcgcgccggggctgctgggccgcctgcccgctctaggacgcgctgcacctgccgcggcaacccttggggctgcgggtgcgcgctgcgcccgtctgcgcctggctgcgccggcagccgctgccg

SEQ ID NO: 634389 - DNA, 227 bp, Homo sapiens
  misc_feature (15)..(15): n is a, c, g, or t
cctgatcaacatagnaaaccccgtctctaattaaaaaaaaaaaaaaaaaagtacaaaattagctggggtgtggtgggcacatgcccgaaatctacagctaactcggaaggctgaggcacgagattcacttgaactggggaggcggaggtctgcagtgggctgagattgcgccattgacccccagcctgggcaacaacgggagaaacttcattctcacaaaaaaaaaa

SEQ ID NO: 634390 - DNA, 948 bp, Homo sapiens
  misc_feature (6)..(6): n is a, c, g, or t
  misc_feature (94)..(94): n is a, c, g, or t
  misc_feature (140)..(141): n is a, c, g, or t
  misc_feature (178)..(178): n is a, c, g, or t
  misc_feature (194)..(195): n is a, c, g, or t
  misc_feature (265)..(265): n is a, c, g, or t
  misc_feature (268)..(268): n is a, c, g, or t
  misc_feature (291)..(291): n is a, c, g, or t
  misc_feature (300)..(300): n is a, c, g, or t
  misc_feature (306)..(306): n is a, c, g, or t
  misc_feature (323)..(323): n is a, c, g, or t
  misc_feature (355)..(355): n is a, c, g, or t
  misc_feature (359)..(359): n is a, c, g, or t
  misc_feature (361)..(361): n is a, c, g, or t
  misc_feature (365)..(365): n is a, c, g, or t
  misc_feature (367)..(367): n is a, c, g, or t
  misc_feature (369)..(370): n is a, c, g, or t
  misc_feature (377)..(377): n is a, c, g, or t
  misc_feature (388)..(388): n is a, c, g, or t
  misc_feature (415)..(415): n is a, c, g, or t
  misc_feature (426)..(426): n is a, c, g, or t
  misc_feature (437)..(437): n is a, c, g, or t
  misc_feature (448)..(448): n is a, c, g, or t
  misc_feature (466)..(466): n is a, c, g, or t
  misc_feature (468)..(468): n is a, c, g, or t
  misc_feature (472)..(472): n is a, c, g, or t
  misc_feature (580)..(580): n is a, c, g, or t
  misc_feature (656)..(656): n is a, c, g, or t
  misc_feature (673)..(673): n is a, c, g, or t
  misc_feature (676)..(676): n is a, c, g, or t
  misc_feature (688)..(688): n is a, c, g, or t
  misc_feature (704)..(704): n is a, c, g, or t
  misc_feature (715)..(715): n is a, c, g, or t
  misc_feature (720)..(720): n is a, c, g, or t
  misc_feature (731)..(731): n is a, c, g, or t
  misc_feature (735)..(735): n is a, c, g, or t
  misc_feature (739)..(739): n is a, c, g, or t
  misc_feature (838)..(838): n is a, c, g, or t
  misc_feature (866)..(866): n is a, c, g, or t
  misc_feature (948)..(948): n is a, c, g, or t
tacagncgccccctgcccctgctcctgcaccaaacttggttaactccctcattcccagacagagcaccccagccctgacagagaaggagggggncccaaatgggccctaaacctgccagggcaggggtcagccaggctgnncatcagcacagagcctggggcctctggcttttggtcntttgagaaatagaaanngttgtgccattcgaaacccatttctagaatggtcagtgtcctaacccttcctggtaaggcctttgtcaanagnccctgctccttgggcccctccangccatgccntaatcnctcccactctgtctcancccacctcagctccgaggcatccttccctgantgtnanaganananngacaganaaacagatagncaggcctgtagcagcagtagcacatgnactcgcccggngctccccttcngggagagactnggggggttgatacccctngnagcngccccttcccagcactcagtccatctgtgggcctcctggcctgcacagccatgtgtccacttggggagggagggtccacaggggcccatgggctatccccctgggggntgcatggggtggggaggggaggctgggacgggtccgggccggcagctgggtctgtgggcaggaggcagtgaaaaanagcgaggtccgagaggngcntgagacaggggngcggctcggagggtancggggggagcncaggnggcccctgagntcantcgnctcggacctccaagcgggcctcgcactgccgagcaccatactcattgaccgctttgcaagtgtagaaaccagcatcgccacgctctgcagccaggatcngcagccggcacagcccaccctcagcctnctccgcaaagcgccgctggtctgggcgcacgggctggcggtttttcagccaggagaccacaggcttgggctccccctgcacn

SEQ ID NO: 634391 - DNA, 397 bp, Homo sapiens
ctgcccacgaggatgaggctgtatgatgggacgctcacaaagagttacggtgcttctggaggatatatggagcgcagacggcgctgagtagactaccggcgaggcacattctcatagtgcagagtatggcacgtcattgtcacctcctgtaggggagcagatcatcacctccatgaagtgcatcatggggcaggatggcaccagcctaggtaagtctttcttttcttgaaaccattgcataagtccacctggcagccaaacgtgctgtttttcttgagcttttttcctcaaaataaatagtcaggtttactaataggccgagctggctggtgtgtggtttccatggacacttttttagtgtgtttgatacatatgccatgagaacgaccctggctca

SEQ ID NO: 634392 - DNA, 156 bp, Homo sapiens
gctatagctgtaccgctgctacgcgagcacagcaataggatcgagcacactgcgactgacacagtcacggaatgcggtatcttaacccatgagcaagtcagggatcaacccacaacctcatggttcctagttggatttgttaaccactgagccacg

SEQ ID NO: 634393 - DNA, 325 bp, Homo sapiens
tgacgacagacggacctggctgggtgtggcctcacctctcctggccccggatgacctgggcaatggtgatgcccccaatctctgagtctgctgacagcggcggagaaaggttccgtcgggctcattgagaagaaggctagtaacgtacttgtttgctgatgaagccgatgatcagcctggccgggctacacggagcggactgggtgcatgggcagtgacgtatggacggtgactggttgtactggcttgctcagacctaccccagggtggggacctccccgtgtcagaccccgtagctccggacgaccagcgtttggtgacggtc

SEQ ID NO: 634394 - DNA, 238 bp, Homo sapiens
  misc_feature (36)..(36): n is a, c, g, or t
  misc_feature (162)..(162): n is a, c, g, or t
agcatcgtatgacatctaagatatctgtgtgattanaggtcctactcgtagctcaggacctagcaggaacactactcgaagctaattcttgcagcagacgccatgacagagctgtcacgtctggacaggtgtcgcgtctcagcagggagctgagcttcaggncaggtggctccagttgtttgagggtccggatggctcaggtattgaaccggatagcttgcgtgtacgagctcgaatt

SEQ ID NO: 634395 - DNA, 667 bp, Homo sapiens
  misc_feature (126)..(126): n is a, c, g, or t
  misc_feature (133)..(133): n is a, c, g, or t
  misc_feature (150)..(150): n is a, c, g, or t
ccaaattttgccccggggggtggaggtgcccaaaaaaaaaaagaggaaagggttttttctccgtgtttttctttcctccccgggtcttaaaaaagggaaaaaaaaaaggaaaaaaagggggggggnaaattgnatggggttggggccccnaaaaagggggggaaaaagaaaaaaaaaaacccctggcccccctccccgttttgggttaaccccccccgggttttgccgcccccctttaggggcctccccccccgggggcccggggaaaacccccccttcaaccccccttttttgggggggccccccttttttagggaaccccagaaaacccttaggggggggggggacccttgggcgcccccgggccccaaaattgggggggggggccaaagccccccccccccccccccctttgggtttttttttttataggggcccgggggttcccccttccttttttaaaaaaaattttcccgggcccctttggggggggcttttggggaatttcccccccgcccccctttttcaagggggggttggtgcccctcccccccccccaaaaacccccttcccccgttttttggttgaaaaaaaaaaaataaccggtggggggggcctttcccccaacctgggttttcaaaaaaaataaaattcccccgggggccca

SEQ ID NO: 634396 - DNA, 200 bp, Homo sapiens
ctagtaggatccccttgctggtctcatatgcccagttccttcatgtctccaaagtcccgtctcaccatttacaccccaggtctcacagttctcctgggtgtgcttggcccgacagggggtacgtagacggctggtgctggccccacagtactggatcagggtacgagatatgacctctagggcctggagcaacacgggga

SEQ ID NO: 634397 - DNA, 1042 bp, Homo sapiens
tagagccattgtctgtgttggagtagtgtgattgtggcgcaactaagaagtcgtgaagtagctgggtctagaccccagtgacagtgtgggggacgcccgggtgctttctgatcaagcatagtatgtggagggtagctttaaatggggtcgtacggtaataggattgttcgcttcataatggagccctaccagtgggcggacaagcgtttggctgtggggcctgtttggctcttacactgggtgctatatgttgttgtttttggagccatttttttgctgttctgagagaagggggtccgccccttataacttgaagtgtttctttcacagtccaggagtcattgggttctcactgggaaatgtgagttgtgtgggctgattccaagatacgccagataggaggttgtcgctgacttggggtatcaaagaatgcttcacagtagtcgactgtgagtggtgcacacccaatgtcgcggccttctcccacgtgtgggtcagccagggccaacactgttgtcggtctctgaaccttgtctggggtccccgtagatagcgatgctaccgcgtgcacgtgtgtagattgtaacgggggtatttctggttgccttgcacgccaggcctaggttacagagccggacttccatgtcaggtcaagtcaagtcgatccatgcaatttcagcggtgtgtatcgtacccttggacagggtttcagctctgtatccacaccccaatgttgcatgtccaattgtgaagttccccgttttgtgggagggacctgcgtgggaggtagaattggactcatgggggccgacttcccccttgctgttctcgtgataatgaatggagcgctttgggatctggttgtttaaaagcttgcagccctcccacttcacattttttggtctttccgggtccaacatggccagacgggcctgttcccctttgccttttgccgtgattgtcagtttcctgaggcctccccagccacgcttttgtttacagcctgcagaactttgagtcaattaaacctctttttttcata

SEQ ID NO: 634398 - DNA, 244 bp, Homo sapiens
aaacgggactggagatgtctgaggtgggaggatcgttgacgccaggagttccaggctgtagcgagccatgcttatgcactgtactacagcctgggtgacagaatgagacccccatctctaaaataaaataagatggaatagagcatcatgaccaccctttgtcgagttttagttgtgctcgtggtgtccttcataaacgggagaggcctaactgcactcccttccttcctcagacatctccagt

SEQ ID NO: 634399 - DNA, 1737 bp, Homo sapiens
  misc_feature (287)..(287): n is a, c, g, or t
gcaatatctataaagtaaacaaatcctgcttgaatgtactatatactcatgagtgatgatgaaacgaatgctgtctatcacatatattgtgttttgaccaatctcaccttagagtcaatcgcagagtagacataatcccaatagattgatgacccagttgttgtgaccgactccaaggaactgacggaggcacagatgtggcacctgactgtgctgctgcacagacatctgtcagtccactcaatcctgttcctctctcgcaatcctctaacagactgatcgggatntgacggtcagtctcagcacacgaaggcacgacacagattcgcacattgcaatatccttcatcacaccaatgcacagttcgtgtcccacactatatagagatgcgatcgaatcctcttcaaggccaggtagaaagcagaccaagaccggtgtgagctgacatagaatcgatttcagccttctcaataacccatatcatctcgttcgcgactacagtgtccgtacgtgttctcgaaggcagagaccatagcgtcaacactcgtgagaggagggtacggggcaatgggcgctaagtagtgactatccgcggaaaacttagcacgctcccagcatgcacaggaacatcagggtgagatttaaccaattccgatgaaaacacctgttcttttgcccatttcccaaaacaggcctggatatgggccaataatccaagtgtcatgtcaaagccatggccaggaatagacaaagtcgacttcgtgctagggaaaataaccattggcaatcgcgcgaagtggatatccagtgacattaaacagcaacagagtctgagctccatcattcacaagttgaactttaatgcaatacaagagttccttgggggaggaagttgcctatatatgcacaccgaatggggcacttcttgcacgcgggaaagaccggctaatacatgggcaacatatgcacttcctaaaaatggactcgcataaggccaccttggggagacaccccataaatattatcccttttgaataaattcaacgtcattgcattcagattacaaccggcacgaccatattccacgttcatcaacacagagcaaggagccccaattggttgacacctacacctggtcacagatatggacagaacaaattccaggaggaaaaaggtccacaagcttgaaaactgtaggagagatggaccccctttgagaggaaacacacaacaagggcaccagaacaggaggaccactgaaattattagggacagagtagaagacgacacaacagagaaaggtagcgacatcaaacaaaactagagaagacaaccaaataagagaaatgtagagaaaatgattaacgccagagcgaacaagaaacaacacttcagaggaaaacaacaaatgataagcgaagacgcaaatatcagcaaggcaaaacgatgagcacacacacaaatagaaggcagcaagcacaacactatgcgacacaaaaaggcaaacagagacaagaacgcagagccagagatacaccaaagagagcaggaaagaagacgaaagtacgaagaacagacagagagacgaagggacagcgacacagcagaagacaacagagcaaaggaaaaccaagacactaggaaagtagaaacacgatagaaaaaacaaagagaacaaagagaacaagtcagagcacaacgaacatcaaaaagaaagaacgagaagagaagaaatag

SEQ ID NO: 634400 - DNA, 257 bp, Homo sapiens
gttatcacgcatggggagaagggcagatgtgcatttgcttatctggaaacctggaatcttggggcctgatctatgttttttcagcttttctttatattcttctctgtcctttttttcttcttccctcaactcctctccccaaagatggtacttggcaacggataatttttgcttacttagaaacttgaatatcgtggaaatctaacaaataaaaatgaccctgaaaagtctctagaatgccatgcgtggattgccag

SEQ ID NO: 634401 - DNA, 293 bp, Homo sapiens
cgaccgccctcatcatacctacctaggcatgagaatcgcttgcgcgctaggggcagaggttgcagtgagacaagatggcaccactgccactgtactcctgcctgggtgatggagtgagactattcaaaaaaaaaaaaaaaaaaaaaaaaaaaaaaaaaaaaaaaaaaaaaaaaaaaaaaaaaaaaaaaaaacaccaaaaaggaaaaaacccggcaggtttaaatatccccagaatttggggtctctttggcccctcttctaaaaattcaaaatatacttcggggggggacggc

SEQ ID NO: 634402 - DNA, 1323 bp, Homo sapiens
cacttattggacttaggacacggtacgcatgtgatatgtggaggaacatcgatggtcgaagcaccttgcagtgtccctgcttactccgaagtgcaggaccggacaaatctaaccttgatcgtggtagagcccacatacacctaggaccaagcaataactttagatacctatcggaggatggataaacaaccttcccctattcgttatcaatgtggggaacacaagtgtatgagggattacataatatttccatcatatatactactatagtaatgcaagcggagagatatcaagctagtcgtccgtttactgcagctgcacaacaggagacgttatgacaaaaccatgaagcttgctacaagttgtatatactaacgtaatacagaaattagttgcgaccagtaagtagtggatagcaggtatgcctaggtagatgtacaacatgatagaccgaataactcacggatgttcgaacagtatctatccttgaaagtctctaattattaataccgggaatacctacagtgaaatgttccaggaggaaggcacaatgggtatgccatggagtcgagtttaactagattccccaagcgagtgtcgaacacaatgtagatcatactactaagtgtacggaccaatcgtatgaatagattaaaaacttgaccataggcaataggtatcgtagcgtacattaacatacatttcgttcccgtgttcgccagcttaggtgtttgagcacatactagtgatagatctcccaagtgacgctcgcacaaaaggcgaagattccaactgcattggacggggtccaaactggatgcgaaagcatggcataggcctttaagctcaaagggtacacatagcgatgctctgaacgaaggtcaatctccggtgtgccgcctccagaatacagcgccaaattgggggccactgggttcaaagatctcttggtataccaggtctaatatattccaaaacaagcgagagtatttcccgtgaaactgggatggcacattccgaacccactcgtcaaacatagggccaggtggcttgtttctgggcactttgcaagggaaccgcgtatgaacggatcccacgctgtggttgagcacacatttaccgccacgaaggcataagccccttagaaggtaccttgattcacgccggaatagcgcgttaggcgttggtaacaaactgcgctgtggcgcttacaagctcactcgtggaggggatcggacacgttaaactcgtgggcactggaaaaggttctcaggtcgcaccagagggtggcaaccgcaccttgggagagcgaccctggaatac

SEQ ID NO: 634403 - DNA, 610 bp, Homo sapiens
  misc_feature (126)..(126): n is a, c, g, or t
  misc_feature (146)..(146): n is a, c, g, or t
  misc_feature (592)..(592): n is a, c, g, or t
gcatggtggccgcaataaatgcacagaaaagatcctaaaaaacagacttgaatcttaatccaagaccaataggtgatgtccaggaagatcgtaaccccatttacccagtcaatgaggaactggggnagggacctgcgcactagggnataaattgcttgttgaaatctgctgggggtggctgcatgccagccagacacccagtcttgcaagactgtcattgaaaatctccgttttgctgttctccgggtctctgcgtccagtctttgtgtttggacggacctgccgggccatctttctgcaagaagataaaggaagaccaggagtgcctgccgaactcctatggaggaagtctaggagaggaaggggacagggaggaagatggtgtctgcaaaccaggaagcagccttgccagacacaggattggccacaaccttgaccccagacttccagcctccagaactgtgagaaataaatgtccatattgactaggggcacagggcatgggggaactggttccagacctgcctcctgggaagttgggagggggcatttcaacctgttaatttctcaaattatgtagtcattcaaaaanaaatagaaacacttcatt

SEQ ID NO: 634404 - DNA, 112 bp, Homo sapiens
ccgggttgtattcttccggtgtgcatcttccgggttgtgcatcttccgggttgtgcatccttccgggttgtgcatccttccgggtttgggcatccttccgggttgtgcatct

SEQ ID NO: 634405 - DNA, 428 bp, Homo sapiens
  misc_feature (51)..(51): n is a, c, g, or t
  misc_feature (410)..(410): n is a, c, g, or t
acgggtgagttgatctcacaggtacgactctgtctctatttgcatcaggtncagtttcttcctggttgaccttgtgggtgtgaatgttgtcacagacctgccgggccatctttctgcaagaagataaaggaagaccaggagtgcctgccgaactcctatggaggaagtctaggagaggaaggggacagggaggaagatggtgtctgcaaaccaggaagcagccttgccagacacaggattggccacaaccttgaccccagacttccagcctccagaactgtgagaaataaatgtccatattgactaggggcacagggcatgggggaactggttccagacctgcctcctgggaagttgggagggggcatttcaacctgttaatttctcaaattatgtagtcattcaaaaanaaatagaaacacttcatt

SEQ ID NO: 634406 - DNA, 150 bp, Homo sapiens
  misc_feature (95)..(95): n is a, c, g, or t
gggttgacaatggtggggtacgaaggactggctaccgttcggactgtttgtagtcatgtacgacatgatcagggtgtacactgggctagcgtacngtgaggactgtgttgctcacttccctcacgtgtatccggagattggtcactgttg

SEQ ID NO: 634407 - DNA, 234 bp, Homo sapiens
gacacatagttaaaccctatctcaaaatgaataaacaaaagacacttaaaatatctgaggaaaacaaaaaacttaaaacagtatgttcagctaggcatgatggcacataccattaaacccagcaatcaggaagcagaggcaggtcttcctgtatgtatgccaccctgactcctgcccatgtcccccggcctcagaggaatctgtggtctggtctagaatggctcaggtcgacgc

SEQ ID NO: 634408 - DNA, 466 bp, Homo sapiens
  misc_feature (14)..(14): n is a, c, g, or t
  misc_feature (58)..(58): n is a, c, g, or t
  misc_feature (106)..(106): n is a, c, g, or t
  misc_feature (149)..(149): n is a, c, g, or t
  misc_feature (160)..(160): n is a, c, g, or t
  misc_feature (207)..(207): n is a, c, g, or t
  misc_feature (212)..(212): n is a, c, g, or t
  misc_feature (270)..(270): n is a, c, g, or t
  misc_feature (284)..(284): n is a, c, g, or t
  misc_feature (360)..(360): n is a, c, g, or t
  misc_feature (429)..(429): n is a, c, g, or t
  misc_feature (433)..(433): n is a, c, g, or t
  misc_feature (464)..(464): n is a, c, g, or t
attgtgtggtccangtttatagcaccatttggagtttgattgctgttagttgggtgancctctcctcttgaggtcccaagataaactcagagcttccagacagatnatttccaaattctagaggaaccaggcagagaaataaacatgcntcaaattttgntcataggagtacaccttactcaattattaaaggccataaatagtttnaaatnagtttccttgactcagtctgatgaatgaatttcctttctcggccaacgcaccaaaatnatgtggctccgatnagtggtggagcaccagggtttttggtcctcatgccagcttagatacaaggacacggacacacgtggagtggttttnaggagcagagagttcaataagcaagaaggaaaagagaaggaagaagctaccctgtacatgacggacggnggcnccaaatcatgctcgtgcccaattccctgcancc

SEQ ID NO: 634409 - DNA, 282 bp, Homo sapiens
cggccagtgagcaccttcccttttgcgatctggtaatctccaattgagtgtaatgtcctcaagcattcatccacgctgcgcgtgtctgactttccttcgcttctatagtctgacttattttccagttgtgtatgtgcccattttgctcacccttcatctgttgatggagattgggttgtttccaccttgtacctatttgactattaatcttacccaataccccttggaagcaggtagagtcagatatactatgatgtcctaatctcctccattactagcttg

SEQ ID NO: 634410 - DNA, 268 bp, Homo sapiens
gactctaaggatccttattgaccttctgctctccaaccaagtgtggtgggtgcgggtgagccaatggataagggtgagctggagggaatgaccccagagattattcagaagcttcaagacaaagccactgtgctaaccacggagcgcaagacgagagggaagactgtgcctgaggacgctggtgaagccagaagagctcagcaaaataccggcaggtggcatcccactgtggggttgcacacgtgccatgcacttccatgggactcct

SEQ ID NO: 634411 - DNA, 549 bp, Homo sapiens
  misc_feature (38)..(38): n is a, c, g, or t
  misc_feature (416)..(416): n is a, c, g, or t
  misc_feature (472)..(472): n is a, c, g, or t
  misc_feature (498)..(498): n is a, c, g, or t
  misc_feature (531)..(531): n is a, c, g, or t
  misc_feature (542)..(542): n is a, c, g, or t
ggtaacctgcaaaccatgtacttttgtaaatgaatggnccttcttttgcctaccctcccatgtcctgtcagaggtacagagccttttccaagactgctgatatggtttgaatattttgttgcctccagattttacattgaaatgtgatcccccataggagaggtgggacctggtggaaggtgtttgggtcacaggaccagagccctcatgaatggcttggctcctccccattgtaatgagttacgctgagaactgtttgtttaaagagcctggcacctccccaccccactttctctcaccatgtgacatgtctggtcccacttcactttccaccatggactgggaaacttcctgaggtcctcacaaggaaacagatgttgggcaccatgcatcttgtatagtcttgcaggaacccntgaaaccaggaggaaaccccattttctttattaaaattaacccaggccttgggggnatttccttttaacaggcaatggggtnaaaccaaacttaacacaattaaccgtggccttnttggggggttnatattct

SEQ ID NO: 634412 - DNA, 277 bp, Homo sapiens
tgtattttcagggcatcctgttcatcacggcagatccttcacaagggaacgattttcatgtacccccgacagttgcaggtgcagaggcaagctactgtgtacagctgacaatgccacatttctgtggtgtttatggcatgttccagcacatcacacataaggtatcatgtgacgagctgaatgtgattttaagagagtgatctccaaacttttcatttgccttaaggatgacgcctctgtggaaaacactttaacctctcttttagagttcctcaaa

SEQ ID NO: 634413 - DNA, 467 bp, Homo sapiens
  misc_feature (31)..(31): n is a, c, g, or t
caactcatgcctagacctgctgattacgttnccactatttgctaggccccaactgaagcctagacaatgctgatggtgttgccactatttgctaggccccaactcaagcctagacaatgctgatggtgttgccactatttgctaggccccaactcaagcctagacaatgctgatggtgttgccactatttgctaggccccaactcaagcctagacaatgctgatggtgttgccactatttgctaggccccaactcaagcctagacgatgctgatggtgttgccactatttgctaggccccaactcaagcctagacgactgctgatggtgttgccactatttggctaggccccatctcaagccacggtgtcgatattcagatgaatcttcgactggtgcactgatgtattggtatataaccattatttaaccaggcacgtcagctaagacaaatgcttatatacaatg

SEQ ID NO: 634414 - DNA, 301 bp, Homo sapiens
gtacagtagggccctgctagtgagagtgagtagaggctgatggtgtgacaggtaggtacagcaggggtccagacagcgggtagagccttgactgaaggtcatggacatcatccacgtaggtctacgagcagaggagaacaaggcagctccccctactcctgcacaggatcctggactgagtgagggaacagctgtcctcagacacaggagtccaggccccatccagactcctctgctccttgaacttgccctcaaacgcacggctcaaatctcatccaggtagaaggcgcagaaggcagac

SEQ ID NO: 634415 - DNA, 206 bp, Homo sapiens
tccaaagaattcggcacgaggaaacatcagggagataaattcaacccagtagtaagtaacttcaatttctattggtagaaagttttcagcagccagttgcagtggcacatgcctctaatcccagcactttgggaggtcagtgcaggtgtttggccctgcctgggtaacatggcgagactccctctctgtagaagtttccaagttag

SEQ ID NO: 634416 - DNA, 328 bp, Homo sapiens
  misc_feature (15)..(15): n is a, c, g, or t
ccccgcaggcaaganaagccccggggcccctaccccctagccccctggtagttaaaagatcctaccccctgcccctaatcggttatgttatcctgtagatttacagacattgaagagaaaagcacttgtgaaaatccctgtcctgttctgttctgttctaattgccagtgcatgcagcacctagtcacgtactccctgtttgctcaatcaatcacgaccctctcatgcggacccccttagagttgtgagccctttaagagggacaggaattgcttcactcggggagttcggtttttaagatgtgagtcgttgccgatgccccgtggct

SEQ ID NO: 634417 - DNA, 192 bp, Homo sapiens
ccctctattgattcattcagcttgttacgtcacagattgacgcacagcgacggcctgacacagagcgtaaacagaggtggcaatgactagaaacccgtggcgcctggaggtttttggttggtggttggaggcaccccggagaaggcaccccgcggagggcccccagttggaaagaaggcaagatggtccccg

SEQ ID NO: 634418 - DNA, 216 bp, Homo sapiens
gttctgacgtgcggacgtgctagcagatgtcatcaccacccgtgtgatgaagagtggcttccgctgtgggcggcatggcatgaagggtctggtgcctgtggggtatacctcccttgctccttgtcgccctggtgacccgtttccttgcgctatgttgtctacctctccttgtccacctggtgaactggacatgtgccagctgacacaccactccca

SEQ ID NO: 634419 - DNA, 117 bp, Homo sapiens
ttcgcgccttctcgctgccctccccccttgctgcgtggctctctgcctcttgtcttccgccgcgcgggcccccgccctccctttgggggttccgacgtctcgacacttcgtacctcc

SEQ ID NO: 634420 - DNA, 222 bp, Homo sapiens
acacaaacaaaacaaaacaaaacaaagcaaacaaaaaaaacaaaaaacgactccacccctgcctgttgccctcttcccagaatatatgggacttcacaccacacacacacacacacacacacacacaccagtgtggacactcatcaaggaatacatcaaacaaacacttatacagctgattgctatacaggatcataatttaaatttctcagagatctcatt

SEQ ID NO: 634421 - DNA, 140 bp, Homo sapiens
tacatactattgcgtctgagagaatggctgataagtgcctgtgttcttttatgccgtctctgtatctatatgttatataatcagttgcaatgctggttatatgcgcgcaatttctatatcaagatgggttggctagattc

SEQ ID NO: 634422 - DNA, 138 bp, Homo sapiens
tcggtccaattgactttgggggtcgcaggccttgccctggatcgaggcgcacgaccgatagttcggtggcaagcttgagaaatggagactctcgtgggcatcggctaagggggcccggggccttcccaggcctgctgg

SEQ ID NO: 634423 - DNA, 195 bp, Homo sapiens
tggtatgattctaattacagtcagcgtggtgtcagttctgcgcattctgaaaatccataatttggggccggaacatgaaccattactgaaatgaatcggggagctattctttttaaaatgggcagtaacctctcacacttctgtgcctgatctctgtacaatgggcagaaaagacgagtaacattctcatgatca

SEQ ID NO: 634424 - DNA, 258 bp, Homo sapiens
gaggcttccacgtacgtcgcgctccacggtcaccacgacgcgttcgagcgatcccaatcgcgatcgatgccgggtatcgtgaccagaagcgccggtcctcggtggcgattacggccattgcgaaatatcgctggaatttcgtcgtagctcagtgcatgctcgtgcttctcgcgcatgcgcagggccgtcgcctgtctcacgcgcgcggagacgggattcaacgtgtggaagtacacgtcctgccacatccacaaggtc

SEQ ID NO: 634425 - DNA, 1012 bp, Homo sapiens
gtcacaagtgcaatatggatagaatatgaatcccatacattcatccctataactgcattttaaaatatagtctaaatatcatgggaggaggttaaaacctgagaacatggtacaatacgcacaggaataatttttcatctatatataatttcaggagaagggattaaaactaccaaaggtcattgtgccactccactgcaaacatgtggcctgcatatcctgagctcatgatttagtgtgtggtcaagcgtaatttggtggcctcaagtaaataccatttaaggctacacatttttaaacctttaaaagctacagacacaagtaatgacacttatgagtcacttaaggggggaggtaatatgcttgtatgtcacatggacattggctctgaattgtctctactggggaaatattgggatttcaatgataagctgtgactggttggaccattggcatcaaaatacaggccccatggtactccttcgctagtcgtacacagttcaagaacgctctggcatctgatgtggactacactatagatgatataactatctgctattctgccttggtcctgaaacaattggcttggtcagctaatttcattcaatattggtacctagaaggatctctagtaagttattacattaacttggaagcaaagtggctccattaaaggtacttaatccctttgtaccacctaattctagttaactattatgtaggcattgacaataggttaaggggttccttggactgattggtaacgcaggtgtgactatagaaggccccgaggatggggcccggaaaaggagagggggctccctacaaaacaacgttcccacatctgggaaaaccccgtgggttagtcacgggagcctccaacagcgcacattgtccacagcactagcgcaggaaacgcgcgttgaacaccgcgcgagaaaacgaccacactgggcggaccaaacacgcgacacaaaaacggggcgaagtacattgcgacagcgaaccctag

SEQ ID NO: 634426 - DNA, 1142 bp, Homo sapiens
taaaaacccccatcaataaaggggaacttccaaaaattgtcaacccctcttttaaaaaaggccagtattacgggggggggtttcaaacccaaagaggtggatgtgtggggttgctaaggctgaacatataaggtgggggggattaacaccaaatggtggaggaaaagttgcacccaaataagtgcacgtggaaacccggggaaacccgtggtggccacaaaaatgtgttgcacccgaaaatcgccgtcggaaatgtggttgagaggggaccacctcgaaagaatcactcccgggagggcttgcgagggagggcatacaacaatagaacacacccgagtataacaaagttgctacaaacaacgcgaggcgcgtagaaaatacaatgggggctacaccgaggtgtgtcacccaattaaaacacaacagtggggtgcacgcccgagggtggagcggaacaacacccgtgagagtggcgacagttaacaaagcgcgtgagagtgtatgtctacacgagagacaagtgtgggggacaaacttcaccaagagagggggaccatcataacagcgcgcggggagtgaaagacacccgtgagttgaggaggagagccccacaagtggagcacaccccatccaacaaaaccatgggggggcgaggaaacaagacggcacaccaccagcagcacgcaggagagtgtcggctaaccacaggaggggcttccacaaaaaaacaaaaactcctagctgggcgaacgagaacaacaaacaacaccactctctcccgctcgaggaggggatccaaaaaaccagcgagggagaaaatataacagccccgcagtatatactacaagcaaaggcggcccccatactatatatagggcgcaaaacacgggtgtcgaagcgatgaccagagtggcagcgaggagaccccacagatgagcgaaatgatgcagtgcacatctacccacgcaggagagtaacaaacaaccataccgacggaggccccacaacccaagtagggggacaaaaatatagagggaggaaaccaggcagagcgtaatagaagaaaaaaacaacaacgagccaccaacaaactaatacgacacagaacacgagcgcaacatgagcggaaggatgaacaaaat

SEQ ID NO: 634427 - DNA, 495 bp, Homo sapiens
  misc_feature (49)..(49): n is a, c, g, or t
catggcgaaatttcccatctgaggggatggcttttaatttcactcaccncattaacccagctctttccactgagaagttgccctgaccgatgaagtaagccacaagcttctccatgaaaagcggcttttttaacctctgggaaccttgcttcaagccgatgaataactttggtccaaccgccaaccagggcaaccagggtgccttaattggaacttccttgaatcattcttcccctttctcaagctttctcattcaaaattccttttgtaagttcaagattcttccgaagcaattcattattcaaattttcaagttttttccattgcggtttccgcccaagaaaaacccattccagcaattgccccggaaagcatttccgcaagcattgccgggtaccaacttgccagtggggaaagtaggcgaagaagtaggggctgtgccagtgcgtcaccccaggcatgattatcttctcaacgtcgttgatgatgtcctca

SEQ ID NO: 634428 - DNA, 270 bp, Homo sapiens
ccccccccccctgggggggggccccgggccccccttgggatttttaggggaaaaatccaaaataagggggggccccccccttttcaccaagggttgtttttttttgggacacagggggaagggggggccccccttttttttcccaccccccaaaaagggccccctttccctttggtccgggggttgggggggggggtttaagtttccccctttagggtttcaacaaattttttggccctttcctttcaaaaaggggggggctttccccca

SEQ ID NO: 634429 - DNA, 416 bp, Homo sapiens
cagtgctctcgggattcattggtcgtcccggttctcctgtgtcaaacggcttcctgattgatggctacccgcgggatgtgcagtatggagagtattttgagcgacgggccctgagaccatgacccagcggctcttgaaacgtggagagaccagcgggcgtttggacaacaatgaggagaccatcaaaaagcggttgaagacctattacaatggtccacagaacccgtcatcgccttctatgagaaaggtggcattgtgcgcaaggtcaccgctgagggctccgtgaacagtgtcttctcccaggtctgcacccagctggaggccctaaagtagcaacgctggagccgtttcccgacctcagagcccggacccacccggtcctgatttccaaccttgccagggtcccgagctcgaat

SEQ ID NO: 634430 - DNA, 1021 bp, Homo sapiens
  misc_feature (306)..(306): n is a, c, g, or t
gaagaggccatccgagcgcagatcactgtccttctgccatgggcctgtggatgcgcctcctgacgcctgctggctgctgctgtgcgcctctggggagcctgatcgccagctcgcagtctttgtgcacaccacccgaccctgctgtccggctcacaccctggctggacacggctctcctaccgtagcgtgtgcgggcgcaacgcacgcctctcgttctacacacccgagagactccgcccgggagcgccatgagtgacctgcatgggtggcggcatggctggcagctggtgcggaggagcccatggnttgcacgtgcaagccatgcagccctttgtgcaccatggacggaggaccctgcaagaaagctggtggcagattgtcggaacaacatcgctagctaccaggcactctcgctcccctcataccacgccttggaggacactaactagccagacttagaaactgctagatccagtgagtgcgaagaccccgctcatccaccggcacagcccctccatgtcgacccagagggaggagcaatgggaaattaatatgccccatttgaaacctcgaggcaaaagacacagaaccatatattcacaaaatgaacaaatacaaatagacgattcccaagcaggcaataacactatagatgagaaaactccaagcagcccggacggccataaaccatatacatgacctttcccaggaagtgggcgcagaacataacttcccatgggcgcaaccaatccaagagaaccgtgtccacacggaaaaccggggatccccaccaaaaataagacatggctaccctggcagctgtataaaacattctaggaaagcggcacaaaggctggttaccaccatcagatacaaacaggtgactgaaagagacaggccaacacacagaccaaacacaccctatatcctgccacatctcctaagcaaccaacgggaccccacaacacacacactcaaagtgcacaggtgaaaacaacacattgacacagtcaacgaggaa

SEQ ID NO: 634431 - DNA, 479 bp, Homo sapiens
gctctttagtttaataaagtctcagttgtccatttttggttttgctgcaattgcttttgaattctttgtcataaaatcttaagcgaggccaatgtacagaatagtgttttctgggttttcttctagagtttttatagttttaagttttacatttatgtctttaatccaccttgagttgaattttatatgtgttgaaagaaaatgatccatcctgaatcttttgcatatgcctagttacctatcttaccataatttgttaaatagggggtcctttacctattgcttattttgtcaattttgttgaagattaagtggttgtaggtgtacagctttatttctgggttctctaaccagtttgattggtcttttttattttatttttgctttgtatcaataccattctatttggaactggaatcttgaattttagttttatgtcagacagtgtgatgcttcactttgtctttcctagaaataca

SEQ ID NO: 634432 - DNA, 213 bp, Homo sapiens
  misc_feature (10)..(10): n is a, c, g, or t
  misc_feature (18)..(18): n is a, c, g, or t
  misc_feature (72)..(72): n is a, c, g, or t
  misc_feature (118)..(118): n is a, c, g, or t
  misc_feature (171)..(171): n is a, c, g, or t
  misc_feature (212)..(212): n is a, c, g, or t
ctcgtgcgcntgcgtgcngctggtgtagtcttcactgctctgtgtcttctgctcctagaggcccagcttctntggcctcgttacctgcaggtattgggagatccacagctaagacgcnaggacccactggaagcctagaaatggtgagagtgccgggtccgacatcccganagagggggcggggctggttggaactggtgggaagtaagctnt

SEQ ID NO: 634433 - DNA, 388 bp, Homo sapiens
cccctcccatcgctccaaccgactgctgtcaccttcaccgttccagtttttatatcctgagtcaagccaaaaaaaaaaaaacccggggcaaataaaaaaccccaattaaggccttcccattctaattttgttttttgcccaggttagtttttgtaaaaaaggggggtaccccacctaagtattagcccgcttaaaaccttttgcgggggccaatggggggcccgacctcgaaatactccggttgggggaccaaaatttgttgaaggggggccagcgggcccagattggacccccctttccacacggggtatttgccctaaggaggggcaatatttttgattttttttgagcgaccagagaaggggccccgggctcaaattcgaaataa

SEQ ID NO: 634434 - DNA, 113 bp, Homo sapiens
agataaagtgtttaggtgtgttccccccaccccccccggaatgctctataaattaaaaaaaaatatattcaaccactttgaggaacattaggcccagagggtaatgagttggt

SEQ ID NO: 634435 - DNA, 317 bp, Homo sapiens
  misc_feature (317)..(317): n is a, c, g, or t
atactaatcaacaattccaccaacaatgtatacgttcactcatttaatatcctcattagtacttgttgcattgatgtatttatgtttattatagccattctaaatgggagtgatgcggtacctcatcgtggtttggattagcatttccttagtgattagtaatgtataacatatctctatgttccagttagccatttctgtatcactttttgacaaacatctattaacatgttttgcatttttaacttagattataagtgtattttattttgagattttaaagtttcttatttattctgaatattagccttttgtcn

SEQ ID NO: 634436 - DNA, 280 bp, Homo sapiens
acacggacttgctgggtgcacttacaaggactcttggcatctgccttaggcgaaaaatgctgttgctggattgcaaccccgagggcgatggtctgaagcatgtgctgaagacagttgcctcgttcaacgcacccccgtatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttgg

SEQ ID NO: 634437 - DNA, 320 bp, Homo sapiens
ctgtccgaaaatacatgaggcaggaagaaggcaagattatgacatccttcactactgactggcaaaaaggagtagccatccccaacgtttttggtaccaggaccaggttcgtggaaaaaaatttttccacggatggggtggggaatcagaaggtttcaggataaaactgttccacctcagatcatcatgcattagataaagcacgcaacgtacatcccttgtatgtgcagttcacaatagaatttgcactcatatgacaatctaatgctcccactgatctgacaggaggtggatggagcacaggtgataaagctagctca

SEQ ID NO: 634438 - DNA, 183 bp, Homo sapiens
ggcccggggcccgggggggggggggtttttttgggggggggggggggcccccccccccccccccgggtttttgggggttgcccccccgggccccgcctttttttgcttcgccaatttgtttttttgggggggggttttccttttttttttagaaaaaaaggggaaatgccttgggggggccca

SEQ ID NO: 634439 - DNA, 369 bp, Homo sapiens
  misc_feature (37)..(37): n is a, c, g, or t
  misc_feature (54)..(54): n is a, c, g, or t
  misc_feature (294)..(294): n is a, c, g, or t
gaggccataaccctttgatttaaaaaaattttttcantgttttttgtttttganacaagggtcttgctctgtcaccccaggctgaaatgcagtggcacgactgcagctcattgcagccttgacctcactggagtgtagtggcatgactgcagctcactgcagtcccaagtagctggcacttacaggcaggtgccaccatgcctggctaatttttaaattttttgtagaaacagggtcttgctggctgggcacggtggctcacacctgtaatcccagcactttgggaggccaaancgggcggatcacgaggtcaggagtttgagaccagcctggccaacatggtgaaatcctgtttccactaaaaatacc

SEQ ID NO: 634440 - DNA, 1644 bp, Homo sapiens
ggtcaccgagttgatactgttgtctcttgtacgcaaacacgcaactctcaacttctagacgaggctgcttcgccgtcacattcgaaaagtacacaacgaacaaagatggaagaactagacaacagtacacttgacacacacgcaacagcaactccaacacccaagtccctcctaacacgggacgcacgctaagcaactgctctcctagcttcccagtctaacgctacgcgacgcttgctcccacgctactgctctgctaaactcaactgttgcctaccacaatacgccgacactgctccaggacgcgcactctcttagactgaaacgcttcactacgcacgcgcacctacacgcgcacgcgcgcaccttccacaaatctaacttctcatgcactactacgacacaactagacacggcccctggagccacaacccctactcgctctcccctgcgcaactcttcttactttgttcgtccccttacacaccacacacttcctcttatttcaacgcaacctccgaaaacaaacccacataacacagttcctctccatctccacacacgcggcttgcacactcaccacactttatacaccctgacacctgccaaaaacttgcctcttcccctttctgccacacgccacgccgcacacacctaactagacgctctccaacacaaacttaaacgtagcctttacacacaacgaatccactaactggcccacaacttcggcttcgcaccacaaaggaactaacaccttccttctcttcctgggagcaaaaccaaaaccttcctaaaccacacgcactgcacacacaccatgcgccccccttaaattacacttagcttggtcccaaacccaagctttccacgcaaagagcttaacacacggtttacacacacgctctcggaaaaccccaagccacggaattgcctacgcttaacgaaaattcctttctaacccccccccgttgtcccacttcaacccgcaattgttcttcccaaccaacgcgacgttgcgaccttcacacaccggggggacacccacagactcccacttaactctcccagaccctacagcgagaacgtcgcacacccactatcataccaacacaatctttctctctcgcgcgcccctgcttccatcagcaccacctatcagacagaacagtctcctctctcgcaaacacccaccacacgccggctcgcgaccagcccgcgcgcgccccacttacgagcagtcaaccacacacgtagtcgccacaacacgcgcagtcgcccaccacgcacaacaccccgcgcgccgacccgacccaagaggcgcggcgacactacccaccccgcaacaacaaacaccccgccgcagagaccacgcccaccgccctctctagaacacacacccacaacgggcgcgccagcggacacaccaccaccggagctcactaacacaggacagccccggagcgcctgttagcaacaccaacagcacacagacagcagagccgacacacgcacgcggacgcagacaagcctagacaaccacgcagcgccacaccggcgccgaccgacactcgtcagcacacgagcagcaccgccacacgacgactacaccccgaaccagcacacaatcaacgctaaccacgc

SEQ ID NO: 634441 - DNA, 277 bp, Homo sapiens
  misc_feature (23)..(23): n is a, c, g, or t
  misc_feature (47)..(47): n is a, c, g, or t
  misc_feature (58)..(58): n is a, c, g, or t
  misc_feature (96)..(96): n is a, c, g, or t
  misc_feature (103)..(103): n is a, c, g, or t
  misc_feature (115)..(115): n is a, c, g, or t
ttcatcacattttcaaaaattcngggtcaaactcccaaacccagggntgcatatttcngacttgtgtgctatgttgagtgaacttccttgcctaanctaaacnccagtgcatgtncaaggatctatatgttaaacatggtatatttttgaacaggaataaattaaagctttatcacacatatagaagacagcttcatttctttttagattctatggtggtggttactgttgtataaatcttaaatcacgaattttgatggtaataaatattaaaatt

SEQ ID NO: 634442 - DNA, 671 bp, Homo sapiens
  misc_feature (352)..(352): n is a, c, g, or t
caaggcgcaagcgcatattttgggcggatgtgtcagatgacccaaggggccttcgaggtgccttaagccgatcgcattgcatgtatacatattgacgccatgggtagttagtctcaggggattcagcagctgatgcaggccgagacgcgctcagaacgtgaaggagatcgaggcccgcaaaagaaagaaccggaggctgaagcaggccaaagaagaagctcaggctgaaattgaacagtaccgcctgcagagggagaaagaattcaaggccaatgaagctgcggcattgggatcccgtggcagttgcagcactgaagtggagaaggagacccaggagaagatgaccatcctncagacatacttgcggcagaacagggatgaagtccttggacaacgctttgttttttgactgtgacattcgggcagaaaatcatgaaaactaccgcataaatggatagaagagagacgcacctgccctggggagtcgcattttagatgcccttacgaatattgaagctatcacagctgtaagtacaatcttatgggacggcactaaattattttcataaattatataaaaagtcccttcactttttggagaggaagcaaaacaagcttttttggacagacttaaaaatatctaaagaattcatcttttttaccacattgct

SEQ ID NO: 634443 - DNA, 767 bp, Homo sapiens
agcggattggctggggctgtgtgtgtgcgtgtgcgtgtgtgtgtgtgtgtgtgtgtgtgtgtgtgtgagagagagagagagagagatgctcccctgcagtctggactataatgtctggcccatcaggtttcagttgaaaacagatcctgcaaaagttccgggtgcccacactggaaacgttggagtatcctgcttcacagaacacagtctgtggggaacgttggggtggagcacgagaagtttctgtatatcagctgcccaggcagaaggcgaagtggggtctccacagatctgaacgaagtgaagacacgacagaataagagactctatgtcatagatgacggacgtggagcgagaagaaacgaggcccctgggccccgggaaagaacgtgacgatcgacggggccagggactcccctggaggtggtcagcacgtacagcagagatggcaacagcatgagaacgtccagagcagacgagaacaaagagcggccgcgaagtaagaaggaacgcctcacaccaacaaaggtcaacaagcaggggtccagcgtgtagacggacgatctcagagagagagagtgaggagaccagtgcaaccaaaagagaccaaaagtgaggaactctctcggacagagtctccctccagatctaggataagcttggacgggcggagccttaatgatgatggcaggagagaccactagggatatcgcccagagacaaccgaaggcacgtcccccagtatatacagccctgaaagtgtagaa

SEQ ID NO: 634444 - DNA, 286 bp, Homo sapiens
catttctacacgatggaagcagattcagttttaggtctgtctgactgaaggtcatgctcttcatcacactgcctgcatcaggtgtgaatgtgtgtgtgggaaggtcttggagaggctggggtggagagttaagaaatatctaatactgtgaagttaaatttaatcagtacagcataatactttgcttttctcttcactttctctgtattacacagagtttgaaattaattgactcaaagcaactttcagaaattataatttttagagttgaaaccaatggtgcagt

SEQ ID NO: 634445 - DNA, 316 bp, Homo sapiens
taaaaaaaaccttttttttggaaaaaaaacttttgttagggcccctttttggggccattttgggccgggggcctttttgaaattaaaaaaccccccctttttctccccacttttttggcctttacccggtttctccaacttttttccctttttttcctaatttttttttaaaaaaaaaaaaaaaaaaaaaaaaaaaaaaaaaaaaatcttgggggggggggccgggcccccattcccccttttggggggggttttaaaattggggggggggttttttaaaagggggggggggggaaaacccggggggtccccaatt

SEQ ID NO: 634446 - DNA, 277 bp, Homo sapiens
ttctctttatcacaccctctgcagaggtaggaaggtatgaatatcttttttatgtcaagatgcaaaaacaaatcatgatgctttagtatgggagaatttttgtattcagtatttagtatgtacctttttttttttcaattggacagcccaattcggtataacatttagcttggcattgaatttttgtgtcagatgacgcttaccttgtcacagatcccctgacctgaagcagagtccttcaccatcactgaccagtgttgggggttgagagcccccc

SEQ ID NO: 634447 - DNA, 677 bp, Homo sapiens
taaaggttggaccagcgccggtcaagcgggggtctggcagctactgtccagctcgggactcaggagcccgagtgatagctgcttggtgctctaccgggagctactgaatcctaatggtcacccacttcttaaccaaggaggagctgctgcagaggtgtgctcagaagtcccccaggtagcccctgggagtgctcgacccggccagcctccgctccctccttcacaggaacctggtcctcagggacacaccagccagcaggtactcattgaccccagagtgcctggagctggcccatgaagttgtccgagtcagaaggcctgagcttgttgaatgtgggcatttgttcccaaggagccccctggggaggagacagtagtgaccaggagcaagcttcagcagagcttgccagtgaagcatttgtccatcagcagccaatgtatctgatgcctggagagtacagtgtgctgttgtgtgttgacattgtttataccttttttgctttcacaggccttagctgttccgatagctacagttggtgaatgttaccccacacggtgcgcaaactagcatgtttggagatttgtgtgtttgtccatgaaacaaatcctatagaaccagtaaaacctgggagttggtacttgtatacaacattgtggatcgcaagttaatttgatta

SEQ ID NO: 634448 - DNA, 184 bp, Homo sapiens
  misc_feature (171)..(171): n is a, c, g, or t
acactttaataagaagacagaattcacaccagaggcacactctggggaatgtaaataaccatcacaagttactctgctgggagaataaaatgaagctctctcagagcacacatacacaggagggaatgatttaaaataggctcatgacttacaatcacattatactgtatnaagcacttaaaac

SEQ ID NO: 634449 - DNA, 501 bp, Homo sapiens
cgccctgccctgcctgggccaccatgtttgtcgggttctcagagcctaaattcaatgattcagtgattgccccctataaccccctctgcggccctctatcatactcccctggatgggccactcatatttatcaggcatttactatgtgccagacacggctctaagccctttacatgcctcaacctactttatccacgcaaggtagacgttctcattattgccagttggctgacgaagagactgagacccaaaggccttagggaaattgtctaaattcacaccactgatgcgtggcagagctgcgactgagtcccgggagtctggctccagagtggtcataacttcaactaccacctacacctgctgccccacccatggcctcggcactccttgagggccaggaccaggaccacctctgtgtccctggagacagcacagagtctagcatgcagctgagcttaataactatttgcaaagtgaatacatgaaaaaagaacaaaa

SEQ ID NO: 634450 - DNA, 370 bp, Homo sapiens
cgtgggcatgcctgctccatacccctccttaccaccccaacccacagcgagacacctggagtggaggacggcagacgttctcattattgccagttggctgacgaagagactgagacccaaaggccttagggaaattgtctaaattcacaccactgatgcgtggcagagctgcgactgagtcccgggagtctggctccagagtggtcataacttcaactaccacctacacctgctgccccacccatggcctcggcactccttgagggccaggaccaggaccacctctgtgtccctggagacagcacagagtctagcatgcagctgagcttaataactatttgcaaagtgaatacatgaaaaaagaacaaaa

SEQ ID NO: 634451 - DNA, 384 bp, Homo sapiens
tctgacttggtccagtggccgcacaccagctagtgaagaaaaccacagactccaactgcactgtgtacgctctggtgtcctcatttccaaaaaaaaaaaaaaaaaatctacaagatagagtttaagaaatctcatttgagttgccctgctaatatttgcagctcgctggtgggtgccgtggaggccagtactcaccgtcaggctgtggcaggtacagtgaaaggaaaaactccatgagagaacggtggaaagttcacctgagagtgaaacgcatgccagttagagtggctgaaaaatagcatggacaacaccagctagtgaagaaaaccacagactccaactgcactgtgtacgctctggtgtcctcatttccaaaaaaaaaaa

SEQ ID NO: 634452 - DNA, 480 bp, Homo sapiens
  misc_feature (23)..(23): n is a, c, g, or t
  misc_feature (172)..(172): n is a, c, g, or t
  misc_feature (178)..(178): n is a, c, g, or t
  misc_feature (181)..(181): n is a, c, g, or t
  misc_feature (187)..(187): n is a, c, g, or t
  misc_feature (194)..(194): n is a, c, g, or t
  misc_feature (201)..(202): n is a, c, g, or t
  misc_feature (224)..(224): n is a, c, g, or t
  misc_feature (243)..(243): n is a, c, g, or t
  misc_feature (278)..(278): n is a, c, g, or t
  misc_feature (283)..(283): n is a, c, g, or t
  misc_feature (288)..(288): n is a, c, g, or t
  misc_feature (295)..(297): n is a, c, g, or t
  misc_feature (299)..(300): n is a, c, g, or t
  misc_feature (307)..(307): n is a, c, g, or t
  misc_feature (328)..(328): n is a, c, g, or t
  misc_feature (331)..(331): n is a, c, g, or t
  misc_feature (341)..(341): n is a, c, g, or t
  misc_feature (344)..(344): n is a, c, g, or t
  misc_feature (347)..(347): n is a, c, g, or t
  misc_feature (357)..(357): n is a, c, g, or t
  misc_feature (362)..(362): n is a, c, g, or t
  misc_feature (365)..(365): n is a, c, g, or t
  misc_feature (368)..(368): n is a, c, g, or t
  misc_feature (371)..(371): n is a, c, g, or t
  misc_feature (375)..(375): n is a, c, g, or t
  misc_feature (389)..(389): n is a, c, g, or t
  misc_feature (392)..(392): n is a, c, g, or t
  misc_feature (394)..(394): n is a, c, g, or t
  misc_feature (438)..(438): n is a, c, g, or t
gcagtttcgagtacagagcgccncagggcacttacaatccccacagaggccagcgacccaacatcagagtctgaccagctgggtggtcctgccctgcatccgagagggtgtcgggacactcatccagatggctctgagacagcagcggagctgacaagggggccccacaagngggagnccnttggcntcaaggncgcaagnnctgtccttgggccgccgggccngcggagccgcccaccggcnttaccctcagagattgctgcagaagcctgtgtgcnggaangggcngccacannncnngggaggnacccgggggcacatgtagccnggntattcaatgntancanagacgggaangacanccncgnggntgcngagagcctgaatgngangngcggcctgttccaggtcgggctcagccagctgcacctttgagtnggggatgaactctagtgcacaggacacagaacacaggcccag

SEQ ID NO: 634453 - DNA, 326 bp, Homo sapiens
gctcgaccattataggccccattactttatatcggttctccaaaaatcacatgaatgaagggaaagaaaggaagaaaaaaactggctacagttcagaacgtcaattatgtcctcttttaatccccttttcacgatttatttgacattttgaacagtggccaaaaaagctattataactataaaacatattcattggtataaatctcattcgttgaatgatttaattaaggtattgacatgcttaattgatatgctaagccaggaccatttttatatctcatttccatatgctttctgctttaagagaagagaggagctggatcttt

SEQ ID NO: 634454 - DNA, 133 bp, Homo sapiens
agtgatcttaatgtgtactgtctaatcgttcctgtctttcttttttgtatagacttgataatgtgtcagtgacttctgtgtatatttaccccatatcttgtaaattcctcactaaatgtccatagcagtaaaa

SEQ ID NO: 634455 - DNA, 108 bp, Homo sapiens
tctcatcttcaatcctcttgccaccttctttcaatcctgctgcggacgcgagggggtcccagggcccgtggtgcccgaggtcggtcctgttcgccctcctcctcagag

SEQ ID NO: 634456 - DNA, 429 bp, Homo sapiens
  misc_feature (1)..(1): n is a, c, g, or t
ncaggtgcccgcgcattgacctggttgaccacaatgacctccgcggtgatgccctcagacagcatgagccagaatgtcatcgacagagaagacagtgccagtgaagccaatggggaagcgtagatattggtgaggttcagctctttgaccttcttcccaatcaagttcagcgcttgtgtctacatgatgttgagagccttctatgtggcagttgtgcacgctctgggtgtaacacagggttgaaatgtagttcttggccacaaatgtttgcttcagaaaactcacatagcgcccctgcttgcacaattagccgaccgattaagtgctttggcacctcgatctcacagatgatgaggtcgaccttcatagggttggagcctgtctgcgcattgcgaaagctctcagtcttcttgagactgcaccctcgtg

SEQ ID NO: 634457 - DNA, 141 bp, Homo sapiens
cgttgtcagtgggttatgtttatattctacgtttattggtaggacaggaacagtgccaagacctccacacttccctgggaagaacagtcaggagaattagatacatctaaagtgtgggttacctgagctcgacattcgtaa

SEQ ID NO: 634458 - DNA, 202 bp, Homo sapiens
gcgagtttcaaacttacttccatatgaggctaagacacctcaaatttcaggaattggggaaaataaaattagcacttgcagaagtagcagcagatgggaaactgccttgcttgacattttctttcagcatttaaatttttggcattttacagcttcatgacaaacagttttgtgccataccttagaaatgtggtgctgagtt

SEQ ID NO: 634459 - DNA, 755 bp, Homo sapiens
tgggtaacagtggaatgtggttgatcagatttttcagttcaggtctggtagttgggttcaatggtcttgggagcttgcgcattcgtttcgcgatggctcttgcgaagactgctgacatgtgagcataaacgagtagtgcacgctcgggatcaataatgcacattggtgtaatcatcctcaggagtgtggccctgctattctgtatcctagttgttatttcccatgaactgtgagtctccctagatctcctgtccacgacttcgaccgtgccttgtgctactatggtactcacactggagccctcgtgtctctacccaaggtgccgatccctgtactgccagtcaactactcttttgtcggggcgctgtctgagcccacaacgcttattggttgctactcagtacgttgttacccagcgttcgtcaacatctcagggcccaatttgccctgcgctggagttcccccgtggctcgtaggacactcctaacatagctgctgtgccatcgggtgctccgcacattccgcagccaggccctgcagcacacccactccgtaacctctcacctgtagcctgtgccaagcctagcacttgtgatgccgtcatgccccgagggccctctcgtcagttctgggaggatgactccagtccatgacgcctggcacacccgtcacggtatgcataccaaggcggcaaagctccagaccgtgccagacccaggtgccccagttaacttgtctaggttctgcttcccatg

SEQ ID NO: 634460 - DNA, 742 bp, Homo sapiens
agcggggtgaagcaggacctcgggccatggattctactgaagaaaggtagccatggaagagaatatggaagagggacagacgacaagagaagggtgttttgaatgctgtatcacatgcctggggggcattcccttatgcctctctgattgccgacctatcctgctctatgcgggtgtagccctgtatctgtggctgcgcgtgcgatgaagcgctttctggaactgatcaacattctgttaaacgcatactttgtagatggcaagaactgctggagacactactggatgttatcaccgatgattgagatcgtttaagtatgtcgatctaaggcatcgcagctgcgtactgttgtgtatggcatgagcgtgatggtgggaaggttatcgttcagaacatggggccatcaagagatctctatggggcattgcacaaagtcgatcacattgtggacagatgtgtgagcgcatggaggcagttatgctgacatatctttgtccatgtaggcctggctgggagtcacggactttcgaccgtcacatgacagatttacaatgtacttcaattctgtggaggcatcctggacggaagcaccacgattgagtggagggagcagaatctctgacttggacctatcgacagtttaggaattagtgacaagttggagaggacacagagaaatttgtgactgtcatctcgagaatttgcttgaggatgtgtgaatctattgaggtgaaaatgacc

SEQ ID NO: 634461 - DNA, 428 bp, Homo sapiens
ggggtccatacggagttggtctgacttcccgccgtatctgatagggaatctttcacagtcgccgcagcgattgatgtcctgccaattaccgacgaagatggccttacgttccttgcagcaggatcccacttatgtcgcaccaatcttgacttccatatggaacagtccgtttatcaaacgaaacgtgatcgcatctatatcataaatttcagtacgacctgttagaagcgtctgatgtcagctagggccattgttggcatagtccctgctgatgtcagatgtacatccttcaggaatactggccacagtgctctgctgtagatcgctgctgccactgggaccactccgattggatgtcgcttgactcctggaacctttacttaccgcatacaggcaggcttgctggccacatgtctttgtcgctactg

SEQ ID NO: 634462 - DNA, 309 bp, Homo sapiens
gggtaaatgctgctggagagatggaatcagacctggggcccggaacagagaccctgagccagagactcacatcagagccctgagtcacagaggacgcaaaggcagagagagaccgagggacagcggctgaccaaaaataaggggagccaaagattagccgctagagacagagacgtagaaacggataagagataaagtcattgacgcagagtccgaggagcagtaagaggctgggagcctggagagtaacaggcccagaagcagaggaacaaaagacgatagtgagcgaaacgggcagagacaaagaaa

SEQ ID NO: 634463 - DNA, 102 bp, Homo sapiens
tatagtagtgaacggattttagtagtgatcggcatatttagtaatgagcggatctttactaatggacggatctttactaatgcgcggatctttactaatgag

SEQ ID NO: 634464 - DNA, 193 bp, Homo sapiens
  misc_feature (43)..(43): n is a, c, g, or t
  misc_feature (74)..(74): n is a, c, g, or t
  misc_feature (91)..(91): n is a, c, g, or t
  misc_feature (141)..(141): n is a, c, g, or t
  misc_feature (146)..(146): n is a, c, g, or t
ccaccatggtgctgtctcctgccgacaagaccaacgtcaaggncgcttggggtaaggtcggtgcgcacgctggngagtatggtgcggaggncctggagaggatgttcctgtccttccccaccaccaagacctacttcccgnacttngacctgagccacggctcttcccaggttaagggccacggcaagaaggt

SEQ ID NO: 634465 - DNA, 122 bp, Homo sapiens
cacgaggagtgatccccatcaaataccgtcggcatctttacatccattagtacccactatttagctcccacttgtcagttcaaacatgtagtaattggccctctgtttctgcatcaatttac

SEQ ID NO: 634466 - DNA, 271 bp, Homo sapiens
tgcggatctacaggtcaacgattctcccgtctcagcctcctgagtagctgggattacaggtggcaccaccacgcccagctaattttgtgcttttagtagagtcggagttttgccatgttggccaggctggtctcgaactcctgacctcaaatgatcctcctgcctcagcctcccaaaatgttgggattacaggtgtgagccaccactccgggtaaaaaaattcttcatgcttagcatgctgacgccctgaatgcgggatgacgctgctttg

SEQ ID NO: 634467 - DNA, 356 bp, Homo sapiens
ttggaagccccccagcaacttttgcacagcaccccagaatgcccccaccctggagctggaattggatgtaaaggggcaggcttggaaactctcaacctctgtccctggggtgagcaagtcggacttggggagtgcaaagccccctgaaattgcccgtgaagtggggggtatctgtgactgccttgaggggtgggggtgtgcccttcctcggaatctccagcacccagacccgcagctgatggagaagcatggcgcagagtcccggacgaggaacccagcacagactcccgttccttggcttgaattttgatttgtgctatttttctaggaaattgtccattacatccaaattttca

SEQ ID NO: 634468 - DNA, 851 bp, Homo sapiens
ggcagacacacccttaatctgggtgagcaccatctaatctgtgccagcgcagccgaataaaagcaggcagaaggaagtgaaaagaccaagatgtttggcctccaaactaatatttctcccctgctgatggttcgtgccctcgaacatcagacttaggttcttaagctgggggagtggaagtgcttccttttccctcagctgtgcaagatggctagggtgggacctgtgtgatcatgtgagtaatactattaagaaacccccttttatatctatcgtgtaattccgtgtccctctagagaacccgtgatgaatacaatggggtattgtgtagaaagggtacttaattaaatactaaggatcaggtttctattatagcttattttatgatttcacacttgagagtatctaaagtaaaaggaagctaatcttttatttaatcctattatctaatcaaagaatatgtgtatttaaattcaaaaaatgacttcattaaggtcacctttcttaggagtgaatgtgctaataatgaggaaatactcatgtgtcacttcatacagcaaacaaatgcctagtgggtatccagggctaaaagatttcccattctaacatcttacctcaatagatggtcttatgtgtctacaaattagtctccaaaatagaggcccattatttttttcaacaaaattttagaattcaggtcgggggggaaccatggctgtaccccccacttgtggggcagtcgggttcgaaccgctgcccatggtgacccttggttacaaaaaaaaccgggtgggcgggaacaactgaggggggagaacatacacgggggggtgttcacccggggagatacc

SEQ ID NO: 634469 - DNA, 134 bp, Homo sapiens
ggatttgctggtgcagtacaactaggcttaatagggacatgcacagacattcagacgagggaccagcgtgaaaacgtatgcactcactactgtaagtcactctggataagagcatcagctaaatgccaaaaaaa

SEQ ID NO: 634470 - DNA, 451 bp, Homo sapiens
tttaaccagaaagatttcgatcaaaggaggggctgccatgacagacagcctcccttggcttgctggctcaggccttggagttccaggagcctggcagatccctataggtaaagcctgaagaggtcagattagcaaaagaagtctatttaagcatccttttcaatgcaccttttattgctacctactttgatctgaccccaatgggcccattttctcctccccctttgaaaccccaagtgcttctccctatcaaccctgctgcaggaggctcctctaacatagccatttcctaaggagaaatctgtgaacgtccccaagcccttcctgcatgcagcccttcaacacatgcaaaagcagcttcggtaagtcagtccctgtatctttagatgtcaccggggatccgcaagggatattcaattacttatcaataatcaaccagagctttccagag

SEQ ID NO: 634471 - DNA, 285 bp, Homo sapiens
cagtgcccagactctcagattttccagccttgtggcaggttttcattctgcacttccatctgcattttggccatgtggcagcacactccgtgtcaagggcagaagttccaagccagtgtgggcagtcagcacaccacatctccattccccagcagtccagcaggcagccagcagcacatgtcaccttgcaccatcgtccgttcctctccaagctcagcccagcagggtgtggcagccgtcaaggcacagcgtggtggtcagccagcattggcagtcacattggtc

SEQ ID NO: 634472 - DNA, 302 bp, Homo sapiens
agggtttccaaagaggtacaaagatgctgcagaaagcatctggtctgtactaacagcttgctgtcttcagtacaggccttcataatagtcacgtgcacggctgtctccttgcaatagatcccattatatgcagaagagagttttcatgttgctgataggttggtgctatagatcgaatggtgatgggattcgaatccactatgcacattagaggcttcattatcattggtacaatgaattttgaacgaagttgttggcattgatatcgagaggtgcgcgcggggatcgctcataggatgtcg

SEQ ID NO: 634473 - DNA, 738 bp, Homo sapiens
gggagtacaggggtacgatcatagctcactgcagtcaacttctcagactcaagcgatcctcccacctcagcctcccgagtagctggaactacagacgctgcaccatcacacttggctaatttttaaaattttactttttaatttccgtagagacggcggggttgggggggcgggctggcgggctcttgctatgttgcccaggctggtctcgaactcctggccccaagcccaaagcgatcctcctgcctgggcctcccaaagtgctggcacattgcaggcatgagccactatacagcctaatatcagcggctacccgttaagccagggtggggctaatgaccttgctgtcgcgaaccacacactgcacccctactctcccctctactgctgacagtatacgcactttcctttcctgcactcgctggagcacgccttacgcagtgcctgaaacctgctcgaggagcgcacgtgtcaactgatagttccagatccacagcccccgctgcacgggcccaggacatggccggcatcacaaccacgccaaccctccagacgctccgcggcagtccgagcgcgaacgagggcataccccgtgcaagcgttcacggcacctcccccagcaccccggcccggcaccaagcatggcgcaacagaccccgcgcccccccacctggcaccacatatccccacacacgccccacggcaccaccctggccgcgctcacatcgccaccccagc

SEQ ID NO: 634474 - DNA, 612 bp, Homo sapiens
  misc_feature (401)..(402): n is a, c, g, or t
  misc_feature (408)..(408): n is a, c, g, or t
  misc_feature (420)..(420): n is a, c, g, or t
  misc_feature (436)..(436): n is a, c, g, or t
  misc_feature (447)..(447): n is a, c, g, or t
  misc_feature (456)..(456): n is a, c, g, or t
  misc_feature (467)..(467): n is a, c, g, or t
  misc_feature (470)..(470): n is a, c, g, or t
  misc_feature (492)..(492): n is a, c, g, or t
  misc_feature (541)..(541): n is a, c, g, or t
  misc_feature (564)..(565): n is a, c, g, or t
  misc_feature (577)..(577): n is a, c, g, or t
ggcacgaggggttttgctatattagccaggctggtcttgaactcctgacctcaagtgatcctccacctcagcctcccaaagtgttgggattacaggtgtgagccacagcccctggccttaaaaaatcctttttttagagacagagtctcactgtgttgccaaggctggtctcaaactactggcctgaagtgattctcctgtctcagcctccggagttgttgggattacagacataagccacaacacccagcctcctcttacttttaaatacattctttcccttattatcctagaagatgaacccagaatattttccatgggcttgtagatgttgttggactacttctgtagctcaatttatttgcaatttgcatttattttgagatggagtcttgctctgnnacccangctggagtgcantggcatgacctcgctnactgcaacctncacctctgngtttgcagctncanctccttggtcccgagtagctgngactacaggcatgtgccaccacagccagctaatttttgatttttagtanagatgaggtttcacatgttggcnngctggtctgctnctgacctcaggtgatccccgcctggccttcgtgtg

SEQ ID NO: 634475 - DNA, 100 bp, Homo sapiens
gatctgtgatgtatgccacatctgctatagtttgcgtgctttgtggcaccctcatgacaggctgcctctaggacgtctgtgttcactgatgatgaagaaa

SEQ ID NO: 634476 - DNA, 941 bp, Homo sapiens
  misc_feature (29)..(29): n is a, c, g, or t
  misc_feature (102)..(102): n is a, c, g, or t
  misc_feature (125)..(125): n is a, c, g, or t
  misc_feature (239)..(239): n is a, c, g, or t
  misc_feature (317)..(317): n is a, c, g, or t
  misc_feature (325)..(325): n is a, c, g, or t
  misc_feature (388)..(388): n is a, c, g, or t
  misc_feature (547)..(547): n is a, c, g, or t
  misc_feature (582)..(582): n is a, c, g, or t
  misc_feature (593)..(593): n is a, c, g, or t
  misc_feature (600)..(600): n is a, c, g, or t
  misc_feature (602)..(602): n is a, c, g, or t
  misc_feature (605)..(605): n is a, c, g, or t
  misc_feature (622)..(622): n is a, c, g, or t
  misc_feature (628)..(628): n is a, c, g, or t
  misc_feature (654)..(654): n is a, c, g, or t
  misc_feature (658)..(658): n is a, c, g, or t
  misc_feature (683)..(683): n is a, c, g, or t
  misc_feature (707)..(707): n is a, c, g, or t
  misc_feature (714)..(714): n is a, c, g, or t
  misc_feature (734)..(734): n is a, c, g, or t
  misc_feature (738)..(738): n is a, c, g, or t
  misc_feature (749)..(749): n is a, c, g, or t
  misc_feature (760)..(760): n is a, c, g, or t
  misc_feature (763)..(763): n is a, c, g, or t
  misc_feature (768)..(768): n is a, c, g, or t
  misc_feature (783)..(783): n is a, c, g, or t
  misc_feature (801)..(801): n is a, c, g, or t
  misc_feature (812)..(812): n is a, c, g, or t
  misc_feature (814)..(814): n is a, c, g, or t
  misc_feature (842)..(842): n is a, c, g, or t
  misc_feature (849)..(849): n is a, c, g, or t
  misc_feature (851)..(851): n is a, c, g, or t
  misc_feature (878)..(878): n is a, c, g, or t
  misc_feature (924)..(924): n is a, c, g, or t
atgacattcaaacaggattgagcaaaggntgcctctgcctgctcgcatctcagcagcctgggttgtacttcataaacagaaaagagaaaaatcccgggagcnggaagtgaacccttttctcaganaatgttctctaaatcccaacacgtcccatgcccccggctctcagcagggagtggggggacacttggttatagcagccgggtgccagaggcctgcctctcactgaggaatgtgtncagggaagaagtcaacactggccgggaaaaacatcaggctttcacctcactcatggcctccataaggcgagcgccgtntgtgactnccgtcgtcaggaaaatgaacctgtagcctttctctctgcccaggaaccggagggctgagatcncagagaatgtacaaccacccaagaacaccaccaagaagaggcgcagggactcactggaagccttgtcttccttagtcatatctgtgaatgccaagtcactgcagtggagcagccgtcccacctcaccaaggccctgccagcctcgccgccctagcaccngcccaatgattcggcagcccaggggcacaaaagcnccaccgaagangtaagcnangtntcggggcactttcagancaaacncgccgtccacacgtgggatcaaattnagcnttttgctgaaggcacgaaaattgcnccccttggccagagaactgaaggnatcagtnatctttcctgcagccttgtnggtnaccagcctgcncactttactcnccncggcngtgagggtgtccccnggggcctgccccgttagngcccagccctncncagaatggagaaggttagcaggtgcccngggccananccctccagaaactgtgttttcagagancggtaatccttggggatcaaaccattctcagttatggacaaaaggnacaagaggagcaggctt

SEQ ID NO: 634477 - DNA, 344 bp, Homo sapiens
  misc_feature (103)..(103): n is a, c, g, or t
tgccgagctggtcaacgccccattgggtactataaaaagccgccgtaaccgggcaaaagcacaccttattatcacggctgcgcaggaggtagccgaggacgtntcggacgaaatcgagggaagagcagatgggatagacactgccactgtcacgttggcgaaaagtgcctagtgcttagcgcctagtgcttgtgggaatatatgcggcggtatagtcgttctactaaaatagtacgggtaggctgccataatgcagtaatgaatgcccgccgctcacagaaggataatcgtggctgagaacactcccgacaacaccgcaggacgtcattatcgtaggctcttgg

SEQ ID NO: 634478 - DNA, 195 bp, Homo sapiens
gatgtgactgcgtggaaatggaactttctacacactgggatctggtggcaacacacttttcctaccataatgccccaacaattgcttgttttctactgttgcctggttgggggacgatatattctgagtgttcctccaaaccttgtagcactcaactttttctgggggagagggttgtcctaagactggtctgcc

SEQ ID NO: 634479 - DNA, 799 bp, Homo sapiens
  misc_feature (14)..(14): n is a, c, g, or t
  misc_feature (67)..(67): n is a, c, g, or t
  misc_feature (135)..(135): n is a, c, g, or t
  misc_feature (141)..(141): n is a, c, g, or t
  misc_feature (149)..(153): n is a, c, g, or t
  misc_feature (175)..(175): n is a, c, g, or t
  misc_feature (181)..(181): n is a, c, g, or t
  misc_feature (203)..(203): n is a, c, g, or t
  misc_feature (205)..(205): n is a, c, g, or t
  misc_feature (208)..(209): n is a, c, g, or t
  misc_feature (211)..(212): n is a, c, g, or t
  misc_feature (214)..(214): n is a, c, g, or t
  misc_feature (231)..(231): n is a, c, g, or t
  misc_feature (237)..(237): n is a, c, g, or t
  misc_feature (268)..(268): n is a, c, g, or t
  misc_feature (283)..(283): n is a, c, g, or t
  misc_feature (291)..(291): n is a, c, g, or t
  misc_feature (294)..(294): n is a, c, g, or t
  misc_feature (297)..(297): n is a, c, g, or t
  misc_feature (315)..(315): n is a, c, g, or t
  misc_feature (348)..(348): n is a, c, g, or t
  misc_feature (427)..(427): n is a, c, g, or t
  misc_feature (440)..(440): n is a, c, g, or t
  misc_feature (442)..(442): n is a, c, g, or t
  misc_feature (451)..(451): n is a, c, g, or t
  misc_feature (462)..(462): n is a, c, g, or t
  misc_feature (492)..(492): n is a, c, g, or t
  misc_feature (502)..(502): n is a, c, g, or t
  misc_feature (504)..(504): n is a, c, g, or t
  misc_feature (509)..(509): n is a, c, g, or t
  misc_feature (513)..(514): n is a, c, g, or t
  misc_feature (526)..(526): n is a, c, g, or t
  misc_feature (544)..(544): n is a, c, g, or t
  misc_feature (554)..(554): n is a, c, g, or t
  misc_feature (556)..(556): n is a, c, g, or t
  misc_feature (560)..(560): n is a, c, g, or t
  misc_feature (563)..(563): n is a, c, g, or t
  misc_feature (587)..(587): n is a, c, g, or t
  misc_feature (600)..(600): n is a, c, g, or t
  misc_feature (794)..(794): n is a, c, g, or t
gttttgtgtaaatnttacaaagtgtataaaaaatctgtgtttctctacattaacaaaaaccaaaggntaaaaaatcggttttatatacaaaacacggagatattgcttcactttcaaacaagttccaaaaaagangggganacaatatnnnnntttttttttttttttttttttntgtttntttttttttttttttttttttntnttnngnntnttttggggttggttttntctttntatcaatcaacaggcataggtgggattcttntttagtttctttgtncggatgancgngtnggcgctgaaagcccgggntgtccgcctgccccggcccccgctgcctggttnttcgggctttttcccagagcacggttctgggtggggacgacgggctggctgggccacccggtcacagatgtatggaggnaatcgctccctanantcggccaangaaaatggganaaggcggcgccgtccgcccgtcctcctcgnctctggtcancnccgtncatnnttccgccctccncaccccgccaatacgctntggggacccnantttnatnggtgcagcaaaccggggcttctanctttttcccgggnaggacggggtagcactggctcctgtccttcctgggccccggcccggccgtgcagagctcactgggagggctggaacgagccggccacagagggacagcagggaggggccagaggataccgtggcggggacgggcggaggacgtgcacgcacgctggggtggaggcgcaggggtcacaggttctggcagcactgnagctt

SEQ ID NO: 634480 - DNA, 760 bp, Homo sapiens
  misc_feature (42)..(42): n is a, c, g, or t
  misc_feature (95)..(95): n is a, c, g, or t
  misc_feature (97)..(98): n is a, c, g, or t
  misc_feature (104)..(105): n is a, c, g, or t
  misc_feature (124)..(125): n is a, c, g, or t
  misc_feature (167)..(167): n is a, c, g, or t
  misc_feature (170)..(170): n is a, c, g, or t
  misc_feature (173)..(173): n is a, c, g, or t
  misc_feature (188)..(189): n is a, c, g, or t
  misc_feature (201)..(201): n is a, c, g, or t
  misc_feature (215)..(220): n is a, c, g, or t
  misc_feature (224)..(224): n is a, c, g, or t
  misc_feature (231)..(231): n is a, c, g, or t
  misc_feature (235)..(235): n is a, c, g, or t
  misc_feature (241)..(241): n is a, c, g, or t
  misc_feature (248)..(248): n is a, c, g, or t
  misc_feature (273)..(273): n is a, c, g, or t
  misc_feature (281)..(282): n is a, c, g, or t
  misc_feature (368)..(368): n is a, c, g, or t
  misc_feature (371)..(371): n is a, c, g, or t
  misc_feature (375)..(375): n is a, c, g, or t
  misc_feature (378)..(378): n is a, c, g, or t
  misc_feature (412)..(412): n is a, c, g, or t
  misc_feature (420)..(420): n is a, c, g, or t
  misc_feature (484)..(484): n is a, c, g, or t
  misc_feature (514)..(514): n is a, c, g, or t
  misc_feature (518)..(518): n is a, c, g, or t
  misc_feature (522)..(522): n is a, c, g, or t
  misc_feature (557)..(557): n is a, c, g, or t
  misc_feature (561)..(562): n is a, c, g, or t
  misc_feature (567)..(568): n is a, c, g, or t
  misc_feature (572)..(572): n is a, c, g, or t
  misc_feature (578)..(578): n is a, c, g, or t
  misc_feature (617)..(617): n is a, c, g, or t
  misc_feature (629)..(629): n is a, c, g, or t
  misc_feature (634)..(636): n is a, c, g, or t
  misc_feature (646)..(646): n is a, c, g, or t
  misc_feature (648)..(649): n is a, c, g, or t
  misc_feature (654)..(654): n is a, c, g, or t
  misc_feature (658)..(658): n is a, c, g, or t
  misc_feature (662)..(662): n is a, c, g, or t
  misc_feature (664)..(664): n is a, c, g, or t
  misc_feature (668)..(668): n is a, c, g, or t
  misc_feature (738)..(738): n is a, c, g, or t
ttatcgttttttaaatgagtctctagcagttcatcatatgangactcctactttagtctgtcctctgttgatgaatttccaggttttctcttggngnngggggnnaggagagttggaataaacnngagtgaagggaacacatctgtacatacattttgtactcattnggnttnttctcatgataaatnnctataagagggntgttgaaatcagannnnnnaggngggtggntggnggatcngtttggnttgattctgtgcaatacagacgggnccccaggnncctttgctgagctgtggttgaagggcatcaaacagtctccttttctaatgacactcccttttatagattggcccggatcctcgttngcntgcnggnactcaggctgatgagctccaacataacagaagancttttttntactggtctcattggcaatgtttcgatagacagcataatcccctacatcctcaaggtggggacngcagggtataatggccagatcaccggggcnagtntatngcgcaaccacacacctgccaaggagcaacagaatncttnnagganngttnacatanaaagaaaagtagtggtattttggtatgtgcaaatatttncatatgttagcnatttnnngtctggtttntnnttatntgtnaatncnaganaatagcaattaaaagactagtaggatcctttcctgacataagaaatgttttaatgccttttgatgaagcngcagattttggaacaatctttt

SEQ ID NO: 634481 - DNA, 211 bp, Homo sapiens
agcttgatgctgcttgtctgactctagagtgatccccccttgctgtccccatgaattgacctgcacctttccctgcccacctgctgcagaacttgcctggccagcaacacctgctcgtgcagacctatgactgtcctgtgagcatgaaattctttgcctggtgttcaactgtgggtacctgatgctctgaattctgtaatcatttgtcata

SEQ ID NO: 634482 - DNA, 973 bp, Homo sapiens
  misc_feature (77)..(77): n is a, c, g, or t
  misc_feature (89)..(89): n is a, c, g, or t
  misc_feature (239)..(239): n is a, c, g, or t
  misc_feature (285)..(285): n is a, c, g, or t
  misc_feature (297)..(297): n is a, c, g, or t
  misc_feature (374)..(374): n is a, c, g, or t
  misc_feature (393)..(393): n is a, c, g, or t
  misc_feature (403)..(403): n is a, c, g, or t
  misc_feature (408)..(408): n is a, c, g, or t
  misc_feature (413)..(413): n is a, c, g, or t
  misc_feature (490)..(490): n is a, c, g, or t
  misc_feature (510)..(510): n is a, c, g, or t
  misc_feature (513)..(513): n is a, c, g, or t
  misc_feature (520)..(520): n is a, c, g, or t
  misc_feature (528)..(528): n is a, c, g, or t
  misc_feature (537)..(537): n is a, c, g, or t
  misc_feature (553)..(553): n is a, c, g, or t
  misc_feature (566)..(566): n is a, c, g, or t
  misc_feature (574)..(574): n is a, c, g, or t
  misc_feature (663)..(663): n is a, c, g, or t
  misc_feature (698)..(698): n is a, c, g, or t
agcggagcgtcagctgacctggggagtcgcgattcgtgccggccggtcctggttctccggtcccgccgctcccgcangcagccatgtcngttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcanctgattatggtaacttcctggccaaccgaggcatcacctctgacgngtgtcagtcatncgatgaccggcttcaaggagaagatggtggtggagttccgccacatgaggaaccattgcctatgatgccactcgccnagcttcctagacgttcatntacttacagnttacnatgantcgacaacgtgatcctgctcatcacaggcacgctgcagccagctgctccatcgctgagctcgtgcccaatgtgccancccactaggcagcttcgagncangatgganggccgtgnaacattgcntcagacacctgctgangctctacaaatgnccattctnggtggacacgcctcttgcggcgttttattccaggactgcatttcagagcaggaccttgacgagatgaacatcgagatcatccgcaacancctctacaaggcctacctggagtcttctacaagtnctgaccctactgggcgggactacggtgatgccatgtgccccatcctggagttttgaagcagaccgcgcgccttcatcatcaccatcaattctttcgggcacagagctgtccaaagaggaccgtgccaagctctttccacacttggggggcggtcttaccctgagggcctggggcagtgggtcgggtgaacgactttgaacgggtcaagaaagtgggcgatataaccgggggacaagtgtctccgaggtggggacaacccgggaaaagctggggcg

SEQ ID NO: 634483 - DNA, 483 bp, Homo sapiens
aaagtggtgatagatttcctgtagtgtgtgtaaccttttgcgtgtgtaggttaagcacaacccagaaatattaatgaattatctaaagataagtaggtagattgcaggagtagaaaactggtggctcggggccaaattcttccacagatgtgttcttttttgtcctgtgtggtatttaaaattgtttctgccagtacataaaaaagaaaaaagaatttccatagaaatctggacttctagtttctcttagaaacatagtaagatttgtggaatggaaatctacatttccatatgtcagtagtgtgctgcttttaggctgggcctgattctgtttttcctcagttctagccttgcttgccatacccaattacctgtgtaggatattcttcccttccatctgtgtagcataggactgcacttctttagcttctctaaattttacaatgttttctgtacagtcttatacatctttttaaaaaaaaa

SEQ ID NO: 634484 - DNA, 181 bp, Homo sapiens
  misc_feature (7)..(7): n is a, c, g, or t
ttacctnactattctaatagtctattctagtgctcgtgctgtgtgctctggtactcatctgccgtttactttggatgctgagtgcagaaaaattgcttcaacccgggaggcagaggttgcagtgagctgagatcgcgccattgcactccagcctgaggaacaagagggaatctcggttctc

SEQ ID NO: 634485 - DNA, 323 bp, Homo sapiens
ggtactccaccctaaccccagaggctgtttccatacatgaaactgacctcatctgccgcctggtcctggtggactccttggatatctgagcattgcagatttatctgcacgaggaggcgcttgaaccctgcctctaaatgctgtttcttctgaagctttagctgtacctgtgtatagtttagttacaaacacactagtccatgctccaggagaagaccgaccaccgccgtgtgttgcccgcgtctatgggctctggactcaaatagcgtgatggttttctattgtaaaagtgggagaatattaagcatttttgcctcgacacg

SEQ ID NO: 634486 - DNA, 523 bp, Homo sapiens
ctggcgtccagcgtagccgtctgtgtcgccgcggtgggggacctgcggtcggagtgggagggccagtctgcacccaagtaggtggaagacggacgtggctttaggctggaatcgccttagaggagccatttttccagcgtggggccccaggcgagaggctccgacagggagcctggccactagtcgcgcagccggggaggtggagcgcgtcccagtacctcgatgcctcccgtacctcatccaaacccagttccttctgtccttggaggccagaggggactctgagcatcggaaagcaggtagtgccttggtttgcgtttcagtgtagaaccagacagagctttacaacatcctgaatcaggccacaagaactctccagattaacagaccccaactatctctgtttattggactgtccgttccaaactgggcagtatgacgaaagccatgtgatcactgcccttcgaggtgaagaagaaaaagtagtgcacatatcttctcccggagtctgtggacctggagc

SEQ ID NO: 634487 - DNA, 479 bp, Homo sapiens
  misc_feature (234)..(234): n is a, c, g, or t
  misc_feature (272)..(272): n is a, c, g, or t
  misc_feature (334)..(334): n is a, c, g, or t
  misc_feature (343)..(343): n is a, c, g, or t
  misc_feature (412)..(412): n is a, c, g, or t
  misc_feature (441)..(441): n is a, c, g, or t
actactggcttgctgtattttctctccatcatgatttctgtttttcccctgggcatgcaactccgtccgtttcatggttgataagttgagggccttgatgtcactttaaaacgacagttccctgctggtatgccttgtcagtggacccaaacatatcacggtgttcctggacagctcctccccaccttgggacagctggtgcgggccgcgcaccctcagcttccatgcaccctnttgtactaagcagtaagtgtccctttctgtgtgtgccntggcaggaaacacgtgtcactaacacaaagagatgtgagggtgggagctccaggaaggagcngtccccagntcccagtgggtgcatttgctcacttcctgtcctgggttcccgggccgctttccaggagacaggacagtntctggagcctccatgtccaggtgaagatnagtctccagccaccctctaggagacagaaaaggacatg

SEQ ID NO: 634488 - DNA, 885 bp, Homo sapiens
  misc_feature (635)..(635): n is a, c, g, or t
  misc_feature (862)..(862): n is a, c, g, or t
gattggaaacacggcttcgggcgtgtccagcagtgagcagaagattgatggactgtcgaattccggccagcagaaaaaatcgatgctgcctgtgtcgttcaccagtgccgcgctgcgcatatcgccgatgatgccatgggcatcgatggcgctttggggttcgttcttgaaatcaaccattgccacgaaactccggataaaggctcatgccgccatcaataaacaaggtgctgcccaccacgtattcggaggcatcactggccagccagaccaccgcattggccacgtcttccacgtcgcctacgcggccgtagggaatcaacttgagcaattctttttcagccgcgccttcggtggccgcacggttgattgccgtgcgaatcgcccctggcgcgatgccattgatgcggatgcgctgttcactgacttcctgggcgagggtgcgcatcagcatctccacaccgcccttggaggctgcgtaattcacatgcccggcccacgggatgacctggtgcaccgaactcatatggatgattttgccggccgcccgccgaaacccgtcgcaaatgccttggcgattgaagatccgcacggcggcgcgggcgcacaggaaactggccggtgaagttgacccnatcacggtgttccaatcgtcgaaggtcatgtcaaccaaattggcgtcttttgcaggcccgaattggccaccaaaatgtccaggtgaccgaagggctcaagggtctgggcgaacaggcgctccacgttcggtttctttggaaacttcacgccgatggcaattgcccgcccccccctgctttaatttccccacaaaggcttcggctggcccccctgggaattttatttnaacaccccggccccaacccccct

SEQ ID NO: 634489 - DNA, 267 bp, Homo sapiens
gaactgtatggatcacacacgagctctgtgggaaaaaagaaaactgctccttcgctctgctggaagctggagggtgctaggccctgtgtagtagtgcatagaattctagcttttttcctcctttctctgtatattgggctcagagagtacactgtgtctctatgtgaatatggacagttagcatttaccaacatgtatctgtctactttctctggtttacaaaaagccaaaaaaaacttaaaaaaatggggttatagaaggtcagca

SEQ ID NO: 634490 - DNA, 235 bp, Homo sapiens
cattgactggctgtgacatgcttacgggtggtggttgctgaaggtggggtgacagtggtaattacagtgatttttgtatagttttggttatctattaagagacagggtctcattctgtcactcaggatggagtgcagtggtacgatcatagttcactgcagccttgatttcccgggctcacgcaatccttctgcctcagtcttcccagtagctcaggaatatcaagaatcggcac

SEQ ID NO: 634491 - DNA, 567 bp, Homo sapiens
gggattgcgggcatgtgccaccgcacctggctaattttttgttttgttttgtagagatgggattttgccacattgctcaggctggtctctaactcctgggctcaggtggtccatccacctcagcctccaaaagtgctgggattagaggtgtgagccactgcacctggctcataaagtaaactttaaaaaattaaattagccaggtgtggccaggtgcagtagctcacacctgtaattaatcccagcactttgagaggctgaggctggtggatcacctgaggccaggagttcgacatcagcctggccaacgtggtgaaaccccacctctacaaaaaatacaaaaaaattagctgggcgtggcgacatgtatctgcaatcccagctgctcaggaggctgaggcacgagaatcacttgaaccggaaaaggttgcagggagccgagatggtgccactgcactctagcctggtcggcagagttagactctgtctccaaaaaaattttttttctttaattataaagaatttttatttatttatttatataaataaataaagtagccaggtgtg

SEQ ID NO: 634492 - DNA, 420 bp, Homo sapiens
aggatcctctaaacgacgcgatatgcttcgggctttcaaaaaagagacttcttgatgtaatcaagattaatcaccagcgggtgagaccgtatgtgtataaggaacccaagaatttaacaactctggtttctagccttggggggaagttagctttctgccgatcaatctgtgagctctcttttccaggaggagcgctgcccagatgaagggaaggcggcttccgctacaagggggagaagccccacaatgacagcagatgccagggctccgagggggatgtgtaacgggggatacatccatcatgtggtatccagatgatccagaaacatgaagaggtgggcagagtcctccttgtggcaacagccaccgctcaggaaacggcttcaggtggctgggactcttcccatcagggcccccgga

SEQ ID NO: 634493 - DNA, 117 bp, Homo sapiens
taccaactccaggcttttgagattcttaaagatcactctgaagaaaattcatcagtttcctgcttaactctatatcttatgtgatcctgatattacaataaaattatggtaaacttt

SEQ ID NO: 634494 - DNA, 585 bp, Homo sapiens
tggcagtccctaaaacgggctttaaaaaacatcgtgttttcactgaaaagctgtgggtgtcccacccggggccgggccggggctattaaaaggagtacgggttctccagcggcgcgcgcgcggccgggcgcggccctccgggggcctccttcggcggcgggtggcggccacggcctccagaaggcgctcggcgctgtagctgcggcctccgagcgcttgagcgtggccctcgaaccggggcgcgggggggcgggccccaacgcggcagaggacaacaaggcggaaaacagaggaggccccgggggcgttcagcagggcgaggcacggcgggacagggcggccgagaaagaggctgtggacgaacgtatggtgcctcgagccgaggacaaaagtatcgcacccacgcaaggcacaggaggcacagccgagccagcagccaaagagcacggccgatgcgagcgccaagcaaatccaaaggaaggagggaacaccagagggcccgcaaacaacaaaacagagacaaaagcagtgaaaacgaacaagccaaaccccacccaacaacccaccgatgagcaaacggagaag

SEQ ID NO: 634495 - DNA, 2234 bp, Homo sapiens
  misc_feature (1617)..(1617): n is a, c, g, or t
  misc_feature (2147)..(2147): n is a, c, g, or t
ggtcaagacaatctgatcaaagccatcttgtcagtcaccaaatgagtacctgcctgaccccatgcctctggacatgcctcctgctgcccgcctgcctgcaatcattcgttgggccaactgcgacggcgcttcatctgcccaaaccaaggctcctcctgcgcggctcaccgcacacttctgaccgaccttacttgaaccagtctggcgcgctgcacgcaactgcacacttccacgccacccacagcctgtacacacgcgccactcttggacgcaaaccggcaacggttgcgcggccaggccgcacacacaacggaacggagccttggccgccccacttcgaacccgataagccccctcggcacgtgcgccctgacccccacttgcccgaagaccggagacccccctttggcacggcccaaggactcaacccggcaacggcccggtcacgccaatttctcactaacatttccctcatacgtgccttcccccattccgggccaccggatgacccctttctacccaccacgccatctggtggccccacgacgcgtgcaagcccctcgatcgtgacaacgcgccttggccgcaataccgggcaacaccaaacttaaacccaacacttccgggccataccctttaaagcccacaaacgtcgtgccaaggcgcaaggcgcccgcggattggccacggcgccttgggctcgcaagcgttaccggggccgaggcaacctttgggcactgacccacttacatcccgttgggtgcgcacacaaccaacctttcacacttgtgccatcgcagaggcctcccgaaagcgcgattccgcggaaaacgggctatttgtcccctcccccacagcccacatccggctcaaatgcccctccgacaccccacttgatgtaccaaaatgctccaaacattctcccagccaacaactctttcccccccttttcccccacaacactccaccaaagcattaaacattcacacaacccaaaaattacccccccaacaatatagtcaaagagtcgtctccccccggcacccccccttatctcccactacgcccccctcctttccacacacaactacattagggcggatctcaccccctttggaacagcgacccgcgccgcttttggttgacgccaacaaagagtccagcacaaaaacacaactggcagctgaccacccgtgaataccacagctttgggagccgctgtgacccccccacgtgaagacaggacacagctgggcacaaccaatacacccgagcattttccccacccctccacgttttagacaccaccgcaccccagatagttgtgacggcacgacccaaagagctgcctgtgttgcactactggcgcactggcctacaccacacgcccagtatgcgatcaaacacgcacccccctcaaactatattggggacgggcacgcccacatcaacccgccccatctcaccaacgacgaaacagcaccgacggtcagagcgaccccacactttgagaggcacatgagcaaaaaacgcgctttccaaacactgcgtgcgtgtccttttgtggtgtcgaccccccgcaatcgccaggcacgctttaccccgtggacgcagccnaacactgtagcggtggcaaaacaccgtcctcacaccgctcatgaggtatcagatcccccgccgcattctcacacccatgtcgatgacagaacagccacccaacaaccattgttgatgcggcaacaaaccgtgaccccacaccaacagcccacaatgacacgcctacctccaacactcaagacagtacaagcacccgtggcgtagaccgccaacaactcagacccaggcccccgccaccacacttttctgtgactgccccaaaacaccgccattaataacacactcctaattgatactaccaccattcactctacacaaaaggcgacacaaaatcgccccaccccagtgagcacactcttacttatcagccgaagtagcaccacacaaactcatttttgttggctggcatcacccctcaaacagacggctcacccccccccaccaaaacacattctcactccactcacactaaacagcattactgcaacacatcgcacgtctttcctcccccaacccatatatgtgcgagnggcacacaaaatacactgagttactacctctcactaaccccgctaaccatcaaacgactttactcatacacaacattctttcctacc

SEQ ID NO: 634496 - DNA, 252 bp, Homo sapiens
tccgacccttaataatgagaccccaggctggagtgctgcggctcaatcagaaatactcttctgacgtaacatcttcagtaaatggaatacctcgtggggttttataaaatgctgagtgggtgtctccatagccatttacaaggaattttagcataatatgatcacacttagcttctccaactaccctgtgtcagaggtactcctattattagcatttttggaatatgaagagcaaggatcagaaaggtcaag

SEQ ID NO: 634497 - DNA, 220 bp, Homo sapiens
atatctggaacaggtaataggcagatcctgtacagccagtgtaggggatatgatagagggccctgggccagaaccctaccaacgccgaggtagctcaaggtcctggggaaccccaagagtagatgaggtgaatagtgaaggtagctggacttatgagcactatatctgcccatgctagcagtcaggaggccagagaacaaggcaccaggggcaccatata

SEQ ID NO: 634498 - DNA, 84 bp, Homo sapiens
gcggccgcctactactactactactactgctcgaattcaagcttctaacgatgtacggggacatgcaataaactgaaaagagcc

SEQ ID NO: 634499 - DNA, 341 bp, Homo sapiens
  misc_feature (115)..(115): n is a, c, g, or t
cagtttacccacagtagaaatgttttatgaaattggagttaatctcaaaccctgccactgctttatcaactaagcttatgtcctattctaaatcctttgcttttattttgatatntttgatagcatcttcaccagaagtagattccatctcaaaaaggtgctttctttgcttgtccataacaagtacttcttcattattcaggatttatcatgagatttcagcaatttggttacatcttcaggctccacttctaattctgattctcttgctatttccaccacatctgcagtgacttcctccacttaagtcttaaaccccctcaaagccattcacgagggtt

SEQ ID NO: 634500 - DNA, 137 bp, Homo sapiens
ttcatttgcgtatcatattatcctactgttttttgttcttttgcatgtttctagaaaacagctgtgtacttattgagcgttattttggtgttactgtactaaacatgcataataaatattcttatttatctcatgtt

SEQ ID NO: 634501 - DNA, 268 bp, Homo sapiens
gggggaccccgttatcccgctgtcgtttaagcagagcctcatgcctccggcctctggccatgtcttttcccctgtgcccggaacccgaggtgttccctaccaggggacagcaaaactgaatggcctccgaaatgctcccccagcgggggccagctccatggcagcgtaggattgccccgcagtgcacttcttgtggcagagtgtgtgaccccctgccggggcgccgcctcggcggcccgaagcaaacggactgcagaacggggccctc

SEQ ID NO: 634502 - DNA, 123 bp, Homo sapiens
tgttgttattttggcatggcccttactatccaataacataatatataatttatttatctactgtctgctcacatatttatccacacacacaaacacacacacacacacacaactagtaatgcg

SEQ ID NO: 634503 - DNA, 216 bp, Homo sapiens
  misc_feature (35)..(35): n is a, c, g, or t
  misc_feature (57)..(57): n is a, c, g, or t
  misc_feature (60)..(60): n is a, c, g, or t
  misc_feature (64)..(64): n is a, c, g, or t
  misc_feature (96)..(96): n is a, c, g, or t
  misc_feature (118)..(118): n is a, c, g, or t
  misc_feature (194)..(195): n is a, c, g, or t
ctcaggcaaaaaggcaacagtaataatttgtaaanattatagaaacttggaggattncanaaanacatgaaaaagaggctttgcagaagctttggncacagatgttcattgagcttgntagggatgcagtcatagaaattcgcaataaaaattcctatatgaagctctgcctacagcagataacagaccaaaannaaaaatggcctttagttacag

SEQ ID NO: 634504 - DNA, 309 bp, Homo sapiens
gctgcggcactctcgacgactctcggtcttgtgctgggaagttggttactctattcgatttgaagactgcagtagtgcaaaaaccattcttaagtatatactgatgggatgttacttcgtgaagctatgaatgataccctcctggagcgatatggtgtactacttcttgacgaggctcctgacaggacactggctacccatattctaatggggtgtactgaacgacgttgtaagacagagatcagatttaccggttatagttctgagcgctactctagatgcaggaaaattccagacaagaaacacacg

SEQ ID NO: 634505 - DNA, 159 bp, Homo sapiens
tgacctattatttgtgcttgactactctgttggacaggatccttgcgctattgtttttacttgattataggcagccttgatacatctccagcagctgtggctgggagatagtctaactcccaaagagtccagaatctgagtaactggcattaaatgcag

SEQ ID NO: 634506 - DNA, 777 bp, Homo sapiens
cctctgttacctggcctcggatcaactggcgaggcctttggagatccgccgtgatatagggcacactggtttccgaaattaattgccttaagcccgatgttagagaaagacgacaaaattgggccggtgtttgaaaaaaaatagcgtctacagaattcttaggaattcttttcaccacgacggttgccgattagccttagagttaccaaagaggggtaccccgaccaaaggggggaaaataaattcgttgttagaactggaaatagttgaggacacccactcgtgtaggggaccgattgtgtgacgccaacacgggtttcctgaaaaataattaggaagtgtattcagtctgtgaaaattgggggccccggtgagttttccaaggtaggtgaaccacgtgtccagtggaaaatacccggtggaggacgtatatttgtgaaaaatggtttaaccttggattcctacgtctttatcgtgcgtaaagccggaccactcaacttccccacatgggttttttaaaaaggccctttttttacccaattgtttgaattatttacccacctttttttttttttttttttttaattgagcggagtctcacgctgtcccaagctgaagtgcagtggtgcgatcttggctcactgcaacctctgagtcccaggttcaagcgatactcatgcctcggcctcctgagtagctgggactacaggcgtgcaccaccacacctggctaattttttgtatttttagtggagacggggtttcgccatgttgccca

SEQ ID NO: 634507 - DNA, 372 bp, Homo sapiens
aggatcaataaattctaaccatccctggagtctttgtgtattaacaatgttaaaataaatgtagactcagtctataagatatcagacagttttttcagtccatgggattgtaaatataaacattaactttccctataataatatataggctttgtaatctatagcctcaaatagatatttataatggattcactggacatacagctgtatccttattgtctttattctttagtgtttctgattcgctataagtagctgttgataaagccgtccaaggaaaataattattttcagtatttgaagtcacttttgagcccccatcaagctctcattgtgatggcagggataccttttcgttgttaaaagcctatt

SEQ ID NO: 634508 - DNA, 907 bp, Homo sapiens
gactgagacccatcccagtaacccgagcgccgctggtctacgatgaacaccatgattcaatttgtacaaaccttcttctctcctgtcatcggcgggcagccctcccagctatgagatgctcatagcgtagtgagcaacgcaaggtgtggctgtgctgggtggcgcccctccacagacccccttggcttcccccgatgttccacctgtgtagtcgcacactgccgtccaggcggagagcctccggtgcccgcaccgagttgtccgtcctgtgtcccctggtggctagatcatccgcatcttctagtggacagccgcctggctgtgctggggtgtttcattagcgggtttctgcctaactcccgtgaccgtctgaagggggactggggagcagcactgggttgagcagaaccagttgactctgggggcccagggctctgattgccttgcccacccggtcgaagggtgtcctgaaacattcgtgtgggccccgtggattcctggggcagtcctcgggtgaatcccttcttgctcgactcggtcattcccccaggttgcttgcgtcttcccatggcctactggatggactcagggaggcactcgctgaacgtgcccagagatgcctccttgtccccagtgagccctggtagtcccgacgttacatccaaggctatcaacttgccctcgccctgccccccggtgccgagtccctggtattcaggcctttcatagcatcacagcgctttgcttacaacgtggggatttcactgaaaggtgcacgttgtggcctggttgctcatgacacaacagcagcgttaccaaagaacaactacgtgcaggagggcggcggacatatgctaaaactttggacacgcagacttatggaggcgaggagaaaggccatgaacaa

SEQ ID NO: 634509 - DNA, 221 bp, Homo sapiens
agctgctccatcagctctgctcccatcagcagtcttctccatcagcgcatcttgcttcccatcagactgctgttttataaccaacaagaggtcaatgtatagaaatccctgatgggacgaagatgcgtcccatcaggggatttctatatattgacctttgttggttacagagtcaacgacgttacaaaatgatgggagaaagtgctgatgggacggagatg

SEQ ID NO: 634510 - DNA, 318 bp, Homo sapiens
tgcaggagagaggtagaaacatttcaaataagaggacgttcctctcacttggggcccactcctcaacagcctgggtcagggaggagaggcaggggaggaattctgacacttctcctcttcctaacctcccttttccattccttgaagctgtagaaggtggagggcctttcctgggaaccaaaaaaaggacaggtcctggtggcaaggaagggccatggggactgaggggaaagggctgaccctgataaggggcagcggaaggtggcggcagttctggaacgcccaactcaagcagaacagcactctgttgcctgccta

SEQ ID NO: 634511 - DNA, 1092 bp, Homo sapiens
aaatactaattgggcctcatagggtggtctctggaaatggggtgattattccatctcatttatccatcccatgcagcaggcagccaacagcccacattggcaccaggcatatttgtaggccaacaggcagtgtctaggcataggtcaacccagggaggcccatgctgttcatccagacaccactgcatcagttcagacatgcagcatgataattgctgaccacacatcatgggagatcatgatcacttcttcacaccacgaaattcgatatatgagtgccacctggcaatgcatatcgagaatgacgattatcatgcaacggacgcgatgttgactacagaaccctatccgtgcaggacgcactcggtgggcaggaggaacccaacatacaagcccacagacaacagagtatccatccgggggactctggagacacacataaccggagaacaaatcaagtactcgaccgactgaacgaccctggttctatcaacctactattatgaactgacacgcttgacacactttccaacccgactaaacacgtactttgactgactacgcgacacacacccttgaacacgaacttgcttcaagaacacctcacgacccttggcctaacgtgccacaaacacgcgcatcactcacaaaggacgaactacggggggaccgccgttcgcacaccctatcattggatcttaaaccccagtaccgaaccggacataaacgggacaagaacaagacgaggacgacaggggaacacgggccatgagccggcgcagccgcaagccggcggactggggcccccagagagcgacacgcggcatggccgatcgcaagcggaaaaagccacggacacccagacgaaagccacaccccacagaggacacgggccccaggagaggagcaacgacataggggcacacgaacggcacacgaaccatacagaccgtcacggacactggcggaacaacggacgcttggaggcaatctcaaacaacccgaaccctggcgaaacgaggaccagcatcgaacaccaccacggacaggcaaagcaccgacacgacaggaaacacactctaaccatgccga

SEQ ID NO: 634512 - DNA, 136 bp, Homo sapiens
atattttagataattgaacctaaaactctaattttatttaaaaaaaaaaaactgggatacagaggggacggcagcctcactatccgggcacgcgtcacccgcatacagaacacgtccagcagaccttccggacgag

SEQ ID NO: 634513 - DNA, 118 bp, Homo sapiens
ctggtctcgatcagccgcccggaggacagcgacgccgaacaccagcgcatgacccgttgcgccgaagtggtgctggaaaagctgggcctgccgtaccgcaaggtgctgctgtgcaccg

SEQ ID NO: 634514 - DNA, 840 bp, Homo sapiens
gggccgggcgcggtggctcacgcctgtaatcccagctcgtcagggaggctaagaggcggaaggagagtttgagcccaggagtgcgatagctggccgtgggcgcagtatagcgagacccagtcttccagaaagggctcggtttgagagatggacaaacaaaaggggatagcctgcctgaaccggggagagcgtcaagataccatttgtgtgtcctggggcgaggagagtgcggcaccactatggcttacaacatcggacccatgcgcagggccagagtgcaaatgtgtgaaagatcagtgggcttcaataacttatgaagataggaggataagcaagaagctctttttccatgtgccagaagtgcaggcatgggattgagctggaggcaggagcatgaggtggcagtgctcagtgattcttaatcagcgccgggggggggtggagcgcctggtatgtttggcgagtctgtgagggccccaaggctgttgcagtcctcgacctgatcggttggtcaatcgctttgaagaatatccacttctggattgatggccagtggttcctcgcctaatggttcttccgtcagcaagggggaccagataaactcaatggggttctggtgccgacaagaaagatcccgtccaagctgggtgtcattgactaaccacatcaacaaaggcacaccattaatccactatgattcaagtggggggaaactggggcacaggttcttgaaattttccctttttatacctcccgaaatctggaatattatcctattggggcattcaccagttttacacctttctcggtgttgttcacacatcacttcttttgaaacct

SEQ ID NO: 634515 - DNA, 213 bp, Homo sapiens
agaggatccctatgtctcgacgttgttctgtgtatagttactcccacttataagtagaactgcatatgtgttctgcattaatttgctctgggtatggcatccttacagaatagtttggagttggattatgtgattcctcaggcttcttttttttttgggttaggatggtttggctattacttgactaattcttttttttttttttttttgggg

SEQ ID NO: 634516 - DNA, 100 bp, Homo sapiens
ttagagagtgatgcacctcaccattctaagaatgaaaggccagcacggccaccaccacctatcatgacagatggtgaagatacaaacaaatagaaaaaca

SEQ ID NO: 634517 - DNA, 353 bp, Homo sapiens
tagctattactctacttctgtcacttagaaaaggatcagtccttaatcatgggaggcttacagtgagtcataacacgcttcaggctggtcacttcctggattacatactttgtactgagtgttattgtacaaacaagttccttttggagttcctaggcattcataataactataaaataataggactgtagcaatcttttttcctacctcagtgacttgatgtatatactgggaacagccctcagtctgaggaagttcagctgaagtccttaatgtacaagtccaaattttaaggaaaatgagtcctgcgatgagtttcctcatgcttcagccgtgcgtggaccagtcagctt

SEQ ID NO: 634518 - DNA, 271 bp, Homo sapiens
ccgtttgtgacacaggtggatgtggctgtgcacacagtggctggatatccctgagaaatggcataatgatataaactagtggtcacccaatgaatgatgtagatgctggcctaccagtgagtgcgatgatgaacatggctgaggctcaccagtgaccgctgcagtgactcatgcacacgttcaattgcccatgccgccactgacatcacggtgcttcgggattttgtggccatgcgcagaacctggccaatcaccattatgaattacctat

SEQ ID NO: 634519 - DNA, 217 bp, Homo sapiens
gtattttaatgtaattctttaatacccaggaaccagagatccttggagaaataactgattctatgtatagaacagataataaagaaaatgagcttggactttcttttaatacccaggaaatcagaacgtgttcaaaaacaaaaggatgggatgtgttgtaaggatgcaggatccaaactaaatgagctcccggcacctaataaagctgtggttgagc

SEQ ID NO: 634520 - DNA, 203 bp, Homo sapiens
  misc_feature (5)..(5): n is a, c, g, or t
  misc_feature (14)..(14): n is a, c, g, or t
  misc_feature (29)..(29): n is a, c, g, or t
  misc_feature (95)..(95): n is a, c, g, or t
  misc_feature (123)..(124): n is a, c, g, or t
  misc_feature (148)..(148): n is a, c, g, or t
  misc_feature (165)..(165): n is a, c, g, or t
ggcanggccacaangttgccttgcatgtnacgcagatggcagaggtgggtgtgtgaggggtgaggaggcatcagcagttgagccccgaaggagantcaggcagccccacctgcaggagaacgnnaaccctccaggggaccagcccctnccagttccacccagctncaggtgccacacggcagggatggagaagggttgggagc

SEQ ID NO: 634521 - DNA, 263 bp, Homo sapiens
cgtgatatgtgattctagctacatgggaagctagaggcaggaggtcaaggctgcagtgagttatgttcacacctctgcactctagcctgggcaacagagctagactctctctctctctcctaaaaaaaaaaaaagggccttagcctgggaatgcttaagttttaatctgataatttatttttatcctttaaacattgtctataatacaccatcctgcgggtttctcattttaagatcctattccagatatgatcctttttttt

SEQ ID NO: 634522 - DNA, 194 bp, Homo sapiens
gttatccgcaagtattcccattggaaaagtgtggattattggaagatatctcatattttagacagaacaggataggaggtgctctctggggtgtcctcctaccaagacagcctgttgaaggcctcgtagtaactcagggagcacagacgcgacactcgcagatcgctaacgaccttcatacttgacggccacac

SEQ ID NO: 634523 - DNA, 105 bp, Homo sapiens
gtctatcccgctgacgccacagggctgcaccatccgcgcctgtccacgccaatgccgaggcggcgcctgtcgggctgcccccgctgtgttgtccacgccggaatt

SEQ ID NO: 634524 - DNA, 873 bp, Homo sapiens
gcgacgcgtcgggttatcatatagttaaagccagcccatgaccctaacaggcgtcctctcagccctcctagtgaactccgagactactccatagtggaatttccactgtgctcacctccagtgaatcgactcctcatacatagcgcacatactaaaccaagcacagctagatccatataccacatgcatgaggcagcgcatgtcaacaggagaaagcgacgatgacccaatggctcagccaccaatccacctacctgtccatatagaaggccttccgcatgacgggataatcacatattatatgtgaccctccagaacattttgtttgcatgtacgctagggattttgtctgagtcttttaccactccctagctcttagtccctgaccccctccaatatacggtagggccactggtcccccaaaaggcatcaacccgattaattcccctagcacatgtcccactcctaaagcatatccgctgattagctcgcatcaggcaggtatccattcatctggagctctaccgagtactgcctaaataggaaatactaaccgataacaaataattcgagtcactgtgttattacaattttactgggatctctatttcaccctcctaccgaagcctcagaatacttcgagtctcccttccagcattttccgagggcatctagcggcatcaacgagttctctgtacgccacgagggttccacaggacttcacgtaaatcattggctcaaatttcctcattatctgcttcatccgacaactaatatttcactttacatccgaacatcactttgggttcgaagccgcgctgatatggcatgcgtacaatgtggtttgactatcctgtatgtctcatctataga

SEQ ID NO: 634525 - DNA, 203 bp, Homo sapiens
tcgtcacctcggaccggacgcgttgaatggcatgggggtacacccagcacgctttgggcttggggtagaggatgccctttctggagccgaccgtttatggaatcgcagaacgggcggttagctgtctctgtcccacaccagctgggtgctctttcactgatagcccctctttgccaggagggccccctatcaccccatcttgt

SEQ ID NO: 634526 - DNA, 741 bp, Homo sapiens
  misc_feature (258)..(258): n is a, c, g, or t
actacacctttaccacccagcccccatgaatttatcataacatccgcgcaagcccaaaaccaccgcccccctctaagcggttagccataaacctataccagataaccgataaaatagtaacccacccacccccgccgccgaggcgaagcgcgagaaaggaggcacggaagaaaggggaggaggagagaggagacaaaacccccccccccaccccaaccccacgagaccaatcactagcccccgaggtagtgagaatantccccaagacaccccgatcaaagcgaggaatcaatattgtaatattgtcgttgttagtgaatgatttagttttttttattgcggttcttgtgtatcctttcgcgctggcgggggcagttcccttgcatccagttccggcggtccctctgctcatacgtcccgtggtctttcggtctagacacggggacgggacgtacccagcttccgttccccgggcgctgtgagattgtagtggttggatttgttgggcgcgtcatgtgaagcgacgagagttaagtaactaaggtaggcggccgggcacgcggtcgggagccgccgcgctaggtgatgtcatacgaactacgttctacctctcgccgcgttctttatgcgcggcggccggcgagggaccatccgcacaataccagagaagggagagacgacgaataataaatcggaattcacgcttccccccgtgctcaacaggtgaaatacctatatacg

SEQ ID NO: 634527 - DNA, 196 bp, Homo sapiens
ctttggggggggggtttgggccccccccccccccaaaagggcctttttttttttccgggggttttgggggggggggggggcccccccccccccccggggttttttggtggggggggggggtttgggggggccccccttttttttttttttcggggccccgggggggggtttgcgcccccccccccccccgggggga

SEQ ID NO: 634528 - DNA, 385 bp, Homo sapiens
gctgcgaggtgggtggtgtaggggatggtgtcttctaggaatgacctacaggagaagggggagacagggtggattggctttggagagggccacaggtgcggtggctggggagacaagaagggcagatggtgtggaaggatggtatcttccagaaacaacccacagggatacagggagacaggggtttagagagatggtatcttccaggaatgagccacatgggaagtggtagggagagacaggaaggatggacgttgtggggggtggtattcgggaatgacatagctgggaatgggggaaacaggaaacaggaatgctgtagcaagatacatcttccaggaatgagccacgagggcttgaggggagacattatgattggatagtg

SEQ ID NO: 634529 - DNA, 212 bp, Homo sapiens
actagaggatcccccggcgcacagcttctcggaataatgggggaagtttggacttgaatattattccgccgtattccagtgtactcgtaggttcagtaccattggtgtgccaatctgattgtgatggtaatgggagggatcgttgaactcgtctgtcatgtgcaggatgcgtagggattggagggtgattaggactaggatgatggcggccg

SEQ ID NO: 634530 - DNA, 174 bp, Homo sapiens
ttgtaagagaacctaatataaagtcagtcttagtcacttcgatgtatttccctaatgactagtgatgtagggcatctttatctgcttatcggctatatgtatatctttggagaaatgtctattccagtactttctccggattttaatttggctgcttagttttttggtggtgag

SEQ ID NO: 634531 - DNA, 132 bp, Homo sapiens
  misc_feature (66)..(66): n is a, c, g, or t
attattctagtcctttgaatttgtaagggaaaaaaaacaaaaccaaaaccttccgatgccctttcntccagcacatcagatttcaaattgaaaattaaagacatgctatggtaatgcacttgctagtactac

SEQ ID NO: 634532 - DNA, 857 bp, Homo sapiens
  misc_feature (857)..(857): n is a, c, g, or t
ggagccgccgcttggtcacagtgaccgccaccattgcccggggatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaaactcagacagatcgccggggaggcagcgcgggatcccagcctcaggcgtgcgcggacggtgtgcggagtctagctttgtaccaggctgcagtgcagtagtgccatctcagctcactgcaacctctgcctcccgggttcaagcgattgtcctgcctcagcctcccgagtagctgggattacagcacatgccaccacacccagctaatgtttgtatttttagtagatacggggtttcatcatgttgcccaggatggtcttaatttcctgacctcgtgatccgccatctcggctcccaaaatgctgggattacaggcatgagccacagaacggacatgctttccttaaaagctaatatttaggcttgtgtgcattaggctctgttacaactacttaattctgtttgtattctatagcacccatgggttatacttaacaatgagctgatgttgtctcagtaaattgggtcctaaccgggtcacctgaagtttagtgtgggcccgttaacgtccatgggtcccgagaaagggtctttttccggggaactccggttcgtgtctggacacacttggattaggcgaatcacaaggggggggagcggcgggaaacctcggaatgccccgcgctctgttctgggagaaaaggacgctcgtgtcacgn

SEQ ID NO: 634533 - DNA, 1240 bp, Homo sapiens
tctctctccctcccctaaacacggggggagtgagggggggggggggcgagagagagaggggggaggagagagttttctttcataaaaaaaacaccaaccacgccccggcgaggcgacgagagagagagagagaaaaaacaccggcggggcgacccgccgcgcgcgcggaggaccaccgcgagagagagaggggcggactctctcacaatatagagagagaggggaggagggagagacacggcgcgggggagcgggggcggcgcggcgcggggagagaaaacacgcaccacaaaagagagagagaggggaaaaacaaaacacagagagagagagaaggagacgggaggcggcagagccaccacccccgcgcgcgcgagcgcgaccgcacgagcgcggacgcgagaccacactcgggacgggacaagagcgagcggcgggccgagacaaaccagagaaaaagaacacacacgcacgcggcacacggagagccaccctcgccggtgcgccctctcatctcttcccgcacacccaccacagccggatatttaagcgccgcgcagcaccgatcgccgagagcgggcgccggcaacatgggtcgagaaaaaaaaaagactatgaccccacttcggagcccagcaggcgcgcggggcacccctccgcgtgccccgcgccggtatacactcgcgagcgccagagagacgagccccccccctcctacgacaggaagaggccgggccccactccggacaacacaagagagtagatcgcactcccgcgcacaggcgcgaggcggacccccacacgccacgccacccaccatcccccaccccaaactgcacaacgtctccacaacgagaaagaaacacactcagccaaacgaggaggaaaacataaagcgaaggcgacagcgcccgccgcacccgtgccgcgccgccccccccaactctcctccatctataactaatccccccaccacctccgcccccatcccacacacacatcaacaaactaatcagtcactcaacataaacagaacctcactttacaatcacacactaacctcctcttctctttcctccccctgcccccctctatctccccacaaccacttccatctatacactaaccccatacacccataacacactatccctccaccccctcacctaccgcacaacaacaccatcccctctctctactcacaatccaaaattaaatccccctctaacaacaatgcatg

SEQ ID NO: 634534 - DNA, 547 bp, Homo sapiens
agtcgatttaattaattaattcatcatttttttaaaaaaaatgtactgattacttcctgggtgcctgaacatattccaaagtaacactgctacacaagctgtgtgtgctagcaggctaaaaacagccatagctgtcttcatagggatatgtccatgaacgtatacttaggttaaacattattctggtagacagcgcaggtggttgttagcaaggaccatactgtttgattacttgttaatgttaaacaaaaatggttttgaaaactgttttctgttcaacagatcttagtcagtgcttggaagccgcaaagcactctcaaagtatttctgagggaattgatatgggtggcaaaagagaacttacagctatgcattgcttgtagcagttccctttctcagaaacattatttttgttgctctaaataaagcattgcctgtcttgtttgagattttacagccatactctgctatgtaatgttatagttccttttctatgaaatgttattttgggtgatctaaataaagctttgccagttttgtttgaaag

SEQ ID NO: 634535 - DNA, 301 bp, Homo sapiens
  misc_feature (240)..(241): n is a, c, g, or t
  misc_feature (281)..(281): n is a, c, g, or t
gcttaacctagggtcagttttgcacgtggtatgccatttaccaagatagttgtaggtaaagaagggcagatttattagagaaattgtgaaaatatgttgcagtgggcagctcagcagagaaggggctacctgcaaaggaggcaagggctggagcgaaagttttatatgggtcctgctgaagcggtgctactgtgtggaactgaggtcattgctgcccgcagggtggtattgtgattagcnntgtctctaacaagttgttcatacacataattgttcattanttgttctcagacttggggct

SEQ ID NO: 634536 - DNA, 101 bp, Homo sapiens
acgtgagtgtctcttttcccctgatgatgaaatgatcacgcgaagggagagagatccgtgcccaaaggatgtgtggacagtcctttgagacttggagccag

SEQ ID NO: 634537 - DNA, 879 bp, Homo sapiens
tagtttctctgtcattatgaaacctaaaagcattgaattagcccacagagtcttattcaggcatagacttgcgctaaagcccatattgattaacagtctacagttacagtgtaaacagtttagccctgtggatagtgagttactctaaggaggactgtgatatttgtatcgaaaagttaagagacatacaaaagactattgtgcaatatatgcccagatggttctcaacgtgactacaatctttagcacctccagtgctctcactgcatggacatttgacaatatctggagacattttaggttgttgcaactggctagcatctagtggatagaagccaggaatcttgcgtaaagtatcctacagtgataaggacagtcccccacaatagagaattatctagttcaaaaggcaataatgccaaggtttaaaaagaccctgttatatacctctgtgttgaacgatgttgtgatttggattactaaacagtacaagtaagtaatttcatatatttgctcctatgctgttcaactttgttaggtgacagtatttgattgtaagcgaaatgcagaatatgttaatgagcgttgaataagattgtttcttaaaatggagaatatttattaaaccacttaagttcagaaaggcaattaaaaaacacaaggtttaggcgaaatagaaatgagtgatatttatatctgaagctttctgtggcaaagcgaccaggcattaagctaaactggaaggatattgagaagattaatttgatatgcttgtgaaatagtttcttaactcctcttggaacagctggccccatgtaggggatatacaggtgatgatctcaggactattcctaaaagcagagagtgtacttaggtgaa

SEQ ID NO: 634538 - DNA, 106 bp, Homo sapiens
cactaagtacacccacaaaacaatatggatatggagatcttccttatacccctcaactttaatttggcccagttatacctcagtgtggtagcagtactggtgatac

SEQ ID NO: 634539 - DNA, 413 bp, Homo sapiens
tgtattgcccaggctggagtgtggtggcacaatcacagctcattgcatcctcaatcaccgaggcctaagcaatccttccaccttgtagctgggcatacagctcacagcacacctggctaaaatttttcttttgttgagacggattctctatgttgcccaggctggtcatcaggttcctgggctcagatggtcctcgtgcgttggattccaaaggcacaggccaagttgtagctttgtcccttgccatcatgcccaacaatgagattgtataccttttaatgaattgactgttcataaattggttatgttggtgggcaagttctttaagctggaaattgtaaattcctcatgaaatgttttttgatgcagttaccatgaattagtactacaataaaggatggtggtgggtgtca

SEQ ID NO: 634540 - DNA, 162 bp, Homo sapiens
  misc_feature (103)..(103): n is a, c, g, or t
  misc_feature (128)..(128): n is a, c, g, or t
  misc_feature (145)..(145): n is a, c, g, or t
tgcccccccctgctcctcggttccggcctggccccctcccctcctttggacctctggccctttttccccgggggccttccccttttggggtcctccgggctcntctttcccctcacccccctcctccnccttggctttttttttncttttgttggggggggc

SEQ ID NO: 634541 - DNA, 311 bp, Homo sapiens
  misc_feature (232)..(232): n is a, c, g, or t
  misc_feature (244)..(244): n is a, c, g, or t
  misc_feature (246)..(249): n is a, c, g, or t
  misc_feature (251)..(251): n is a, c, g, or t
ctgacacgacggaactggaacaaggtcactcacacccaaagcacccagaataagagtggctcaaaactgacctccccttacatggcctctttggggactctctcttggagattttcccagtgactctcagcgtgttttaagtaaatgtatttgacctgtggtctcagcattcagagagcagcggtgtaagaatctgctgttctccctggatcttctgacattactgctgtcngagatttgtatntnnnnanatacaagttccttgataccctaaaaccttggattaaacagaatgtgcattgtacatcttt

SEQ ID NO: 634542 - DNA, 281 bp, Homo sapiens
tcacaagtcccactgggcttcaatgccagatgctccaggtgctctttctcccagtgccaaatccccacacgtgagggttcgctgtggggctcagaactctcactcctataggtgagtctctatgaaccagttagttttcagtctgtggagcttctcacccgggagctatggggttgtttatattgtgaaatcgcccctcctacctcttgatgtggcctcctcttttccttctggagtagggtatcttttttaaggtttccagtccatttgggtggagattg

SEQ ID NO: 634543 - DNA, 874 bp, Homo sapiens
ggagagagaactagtctcgagttttatttttctttttataagaggaaaacccggtaataatgtcggggttgagggataggaggaaaatgggggataggtgtatgaacatgagggtgtttatcgtgtagaatgagggtcttatgttgtcaatgtgggtggagtgagtgagccccatctgtgtcgtggataaactatgtcgagggagatatagggctgcagactagctatgtagagtcctgataagatagcaaacgatactatggaatcagcgagaacaatgggacaacaagacaaaaaagtcaccccacaagacaagaaaaacacacaggaggaagaaaacgagcacagaaacaaagaacaataagacagcaaaacaaacacacgaaaagacagaaacaagaggcgaacacaaaaacaaaacgccaacccacaaagaagaacaacagagaacaaacaagcacagacacaaacaagcagcacagaaaacagacgacaaaagcaacaaaaacaacacaacaaaacaagaagacaagagaacagaggaacaacaaacaaaaaacaaacgaggccaaacaaaaaaaacacacaggaagcccaagaagacaacaacacaacaaaagaaaaaacagacaaacaccacagaaaacaaaaaagaagaggtgagtgagactagagaggcagagagagcgagatcgagggacaggagaagagaccagtgaacgctagagaggagagcgagaaagcatcgaggtgaggagaaatgaaaagagggcagaggagaaagaaggagagaggagaaagaggtggaagagggaaggagaagttgaaggagagaaggaaaagagacgagagagtagaagacaaaggaaggaaa

SEQ ID NO: 634544 - DNA, 1452 bp, Homo sapiens
  misc_feature (560)..(560): n is a, c, g, or t
  misc_feature (1014)..(1014): n is a, c, g, or t
gtagttgtatgttgtgtgtgcccttctgttctcccgcgctgagggcgtgtggccctcctattcgtgtgtgttcttggggtgggtcgtacctacatgttcccggtggtgggttggtgtcgctgctcatatatttgtaccgtcttctttggggctgccccactcccctgtgggtgcgcctggcgggtcgactgttttcgctcctactacaacacgtgtttctgttaacgtcatctgtgtggttgtcttgcgtgtgccctccctacctagttgctcgcactcgcgctgttcttggggggcgcccagcccaacattttcctgctagctatcatgtggtttccccatcgccctctcctgtctgtgtcgcatcgtcgggaggggttctcgcagaattgttgtgccgcccgtgaagtaacttttctgccgaaggtagtgcgtgtgtggcacgtagaaaattccctcttgtctggtggcgtgaacacaacaagtatacccccccccctttgccctttgtttctgggtgaggtgtagatcgccccccccccgtaggagatgtgtattgnttgggtcgtacaccacatagttttttcccaatagaaggagtgtcaggagttatgtctcccttcactatcaccccaggagtgtgtttcctccccgtcgtgctgtcgggtggtgctgttgtcgcacctcctttctgtcggtagtgtttccaccagtgcgtcccgtaggtggtggttgggtggcctcaccctcctatgtgtgcgctgcggacgttgtgctgttctctcccgcgctggtgctgtgtccttcacaaggctgctttgtatgcactgccgtctttttctctccatgcctcgctcccctttgtcgcgcgttggagatgtattatctcgatccacgaggtggcctccctcgtacggagtctgttataacacaagacaagcgcgtgtattttcttctttgtcactagagatccgtgagtacccagtgctgggtgaaacaacacaccaaacgcgngatctcttttctcgaccatgtcgtttgcttcccataataaccaggggttttttgtcagcgtgctagactcagcacccgtcaacggggggcatcttcgagggttctctcacaagcttgcctcccttctcgcttgtagatccctcctcggttagccgtcgccttgggcgccaagaactctggtggtctcctgagggggagtttcctgcgaggctcggcctctacattgctgcccacagaacttgtggcgttcggagccaccaggggcacttttatgggcccccatgacccctcttcggcccccttgtggtcccgtgggcgcgccccttcggcccccctccccggtttcgggcggttgtaaggttttccgcgggggtgcctgcctttctcccaaagggggttttcataggaaactggtaatcaggtgggcccctcttttta

SEQ ID NO: 634545 - DNA, 100 bp, Homo sapiens
cagcgaggcccttttctctgtgcgctcggctctggtccggctcccggttaccgggcgcgagaatgaccacattggcggccgccacccttcctggcgcgca

SEQ ID NO: 634546 - DNA, 584 bp, Homo sapiens
caaggccacccccctagcttcctagtgagacaatggtcaggtaatccgttagttcagactacccgggtcaatagccattaatgtgatttctggacattgcccatgtataatcttcactgatgatttcaagctaaagcaaaccaccttatacagagatctagaatctctttatgttctccagaggaaggtggaagcaaccatgggcaggagtaggaattgagtgatagacaattgggctaatgaagcaaacttctcctattgttcagttcatccagattataacttccatgggacactttagcccattagaccattgacactggattaaacaaattcacataatgcctaatacccaatgtatttacagcaacgtatgatttgcaaagatcccccttacaagctgctgtgtaattagagtgtcctaactccattacttatgacttagaaggttaaagcttatgatagtcctctggaattcttgacattcacgccagaaatctttctgagttcccccagaagagaatatgcatccttttttaacatttttgacccatccaacaatgctctggtgtttacatcgcaga

SEQ ID NO: 634547 - DNA, 398 bp, Homo sapiens
atgagaaccaactcatctttattaaatgcatcgtgtgtgtgtgtgtgtgtgtgtgtgtgtgtgtgtataacacatacttcaggcttgcggcaccaccccataaagctggtgaggaagtaacttctgcttctcattgcaactgtacatccatcggggaccaactaatgccagggaggggttgtccatcacggcctcctcaaagctgggatcccattcctgtgctgcgatcacaaactgaacccggtcactcatatattcctcgagctccccattgaaggctgtgacgtatcggatgactttacgccgctcggccccagggaactccccgtaaacaaataagtgcttgccctgcaagaaatctgggacctcaaggactggcagaccaggaggctcctggc

SEQ ID NO: 634548 - DNA, 656 bp, Homo sapiens
  misc_feature (97)..(97): n is a, c, g, or t
  misc_feature (148)..(148): n is a, c, g, or t
cggggaaccccatggcgcgtgcctctcttcaatgtggcgctctcctgggtacccctgcaatgtcgggaagcgccggggttggcctcatacctctttntgtaacaaccctgtgttttccctttggtccattgatttctccccaactccntggcctttaaggcacaaagttcttctaatgtggggttgttcttggtggcttgcccctggccccaaccaccaggtccctcctcctggttcctggttcacgggttcttctaaaaccgaagttccccagtttccaaccactggcttttcaagggaatctcctgctttccagttttgtatggaatttgcttagtggaattcctcaaccccctgcttcctctctcctacatagtttcctttttgctgtcactgaatttatttaaattaaaccacatattgttttcctttgtttcaaggtgatgcagttgattatcagaaacagctgaagcagatgattaaggatttagccaaagaaaaagataaacttgagaaagaattgcccaaaatgagccaggtatggcctttcttcagtgcagagaattaacttttttttttttttttgagatggagtctcgctctgtcgcccaggctggagtacagtggcgcgatctcagcccactgcaacctagtgc

SEQ ID NO: 634549 - DNA, 303 bp, Homo sapiens
gggcagtaggccctctggggctgtggtgagccagataatgacccaaagatgtccatgtcctgatcctgcaaacctgcaaatgtgttaacctacatggcaaaagggactttgcagatgtgatggagttaggaatctggagatgggaagaaattccacctacggccagcggcttcagtccctgcctgagccccagcccgcccctcccgctggcctgcctgcacctgtcagcctttcccagccagccccacaatcacatgtgccaattccttgcaatctatctgtccatctttatctctgcctcta

SEQ ID NO: 634550 - DNA, 179 bp, Homo sapiens
  misc_feature (51)..(51): n is a, c, g, or t
  misc_feature (62)..(67): n is a, c, g, or t
  misc_feature (114)..(115): n is a, c, g, or t
gttatcgccttaatgcgcctcagggattccctactgcttgcactgcccctntggttattggnnnnnntcctaatacgcccttggacgtaggctcttccgatcgcggccatccannttgccgagctcctgcttagccatcgcgcgcgccgatatgattctgcagatggagttccctccgg

SEQ ID NO: 634551 - DNA, 931 bp, Homo sapiens
ggcggcgtgacgtcaggcgcccggtgctcctcacttgctctgagacaggtgcggcaagtctactgcgggctggtccgggctcctcaggttcagacccgaccgttatccagtcggttcgtgagaggagaggtgcactttacaggtccccgatgaaccagagagaacccttccaacatatccaatgggccctgtgtccaactggccccaatacccaccttatccaccacaacaagtggtgtccagggacctatgggggggaccactacccaactcctcaatggtgtaaccccttaccaagggatacccacaagtacggctggcgcaggggttggccctcagggaagcctcctaaaaccacaagtgtatttgtggtagaagaccaaaagaaaggagatgacgctagggacccatcacacgtgcctacaaaagcctgctggaccggctctctgttgctccgtggtctcgttggggaacatgctcacctgaaccagacagccccaaggcggtccttgtcctgcaagcttctggttgccaacctctgacaggttgtgccttgcccccatctcttctgattggctgttaacaaattgacttaggcttgggaaagcacaccttctaacttctcagcaactatgggaatcctagataaatggggggtgtactgttaattcaaggtgatgtgatctttataatgtccaaaatcattcattatgatcttaaagattgtcctaaatgactttttgaccaagggctagttgtgacactctatttcaatatcattcaggttggcgcaatgacaccttatatgaggattctgtaacagcgcgttgtaataatggccagtaacaaaaaaaaaaaattggccgcgggagtaaatgggcgcagagagaaggtaaccaggggcacaaggggtacattggtagaataccgg

SEQ ID NO: 634552 - DNA, 177 bp, Homo sapiens
acatggagaagctgcaggatgtgggtggctcaggctgtcctagagagctcccatcttgtatctacagctcactgcagcagagcagttgaaataagtaacaactagagttacattggggtaatttaggagaaagggcattagccccttggaactcggcattacctcgatttctttcag

SEQ ID NO: 634553 - DNA, 114 bp, Homo sapiens
cagaggatccccactgctcatcactagcgggactttgtgcgatccatacagattcgtagttgcttagattgcttattgttttcatccaattttgtgggggtgtgcgtgtgtgtg

SEQ ID NO: 634554 - DNA, 309 bp, Homo sapiens
gctaatactagtacgtcctgggagctcgggcggcagctatgtgtaatgctgaacagtggtcactacgcctggttcccgtaggaaagtcctgagtggatgagctagtgcatgtgcgacttcttacagcgcagagtagagacacacggcgccgcgcgggcaaaagcgacggcggtgcatgagagcacatactccaggactgagatgtttctcgatgggtcactggacttcggcatctgactcacagcgaggaggttcctacaagggaggttggagtatgatatagttagctgctcctcgctggcgtgattt

SEQ ID NO: 634555 - DNA, 811 bp, Homo sapiens
ggcgtgggcagccaggcgggcggcgcggcgcgggccggcaggaagcgtattctgggcacggggcgccgggcgggccggctgcgccgagcggagtggtgggataccacccaaggcctcgcgcggtgccgccgtcgaggggcgtggcggcgggtacccacttgtggccgtcgaagagcgcaggaggccgggtgggcactgggccgggccgctgcggttgcagccatgccttgtggctttacgtgctgcgtgccagtgctgctacaatgaactcgcaccgggacagggcgctgcacttcgtacacgtttccaaaggacgctgagtgcgggcgcctctggctcaagaaccgtgtccgaagtgcggccggcgtcacgtggtggttgcttttcttcgcaccttacaaggtcccgaccacaaggtccaccgtctctgcaaggagttgcactttccagggctggcctgcaaagacctatcacggtacgcagtccccaacatcttcccgctggctgcggaggctcaatgatgcggcaaaagtagcgcgcaagacgccggtgggggtcgggagcacgagccccgtccggcagaggggcaagacagcgaggcaacagcgatgcagcaagcaggaaacgcagcagggaacgaggccgccgcagctagcaatcagggaggccgcatggagcagccagcacagagccatcaccctctggcctccagatggccacgactgcccagctgcaaggcgaacctggctcttgttcccgaggccgggctccgcaaccgcagggcactggagacaggagtagggccgggatc

SEQ ID NO: 634556 - DNA, 132 bp, Homo sapiens
cggagccatatgatattctcgtcctctcatcatcgtctatagagttgctcctccttccatcctgcactggaactcatgatctggttatcactcgtcgcgtccatactggcatcatctcttttgagaatgcag

SEQ ID NO: 634557 - DNA, 207 bp, Homo sapiens
ggtaggtgctgtactgtgaaagatcgtcggagagtgtaggatctgccatgttagcagccgattgagccttcagggtactgtacgctctgtaacggcgaataggaaaatggtctcacatacgtaagtctaccccctttcaatgtagatcaggtgttctcctattatctggggcctgtctcaaactcccgggaacatggcggaggggaa

SEQ ID NO: 634558 - DNA, 934 bp, Homo sapiens
  misc_feature (184)..(184): n is a, c, g, or t
  misc_feature (392)..(392): n is a, c, g, or t
  misc_feature (395)..(395): n is a, c, g, or t
  misc_feature (403)..(403): n is a, c, g, or t
  misc_feature (405)..(405): n is a, c, g, or t
  misc_feature (426)..(426): n is a, c, g, or t
  misc_feature (430)..(430): n is a, c, g, or t
  misc_feature (446)..(446): n is a, c, g, or t
  misc_feature (452)..(452): n is a, c, g, or t
  misc_feature (455)..(455): n is a, c, g, or t
  misc_feature (480)..(480): n is a, c, g, or t
  misc_feature (482)..(482): n is a, c, g, or t
  misc_feature (501)..(501): n is a, c, g, or t
  misc_feature (510)..(510): n is a, c, g, or t
  misc_feature (516)..(516): n is a, c, g, or t
  misc_feature (522)..(522): n is a, c, g, or t
  misc_feature (527)..(528): n is a, c, g, or t
  misc_feature (534)..(534): n is a, c, g, or t
  misc_feature (545)..(545): n is a, c, g, or t
  misc_feature (552)..(552): n is a, c, g, or t
  misc_feature (563)..(563): n is a, c, g, or t
gtgtttcaatcaaaactgaccatgagataaaggaaagagatgtggctttgtgatattctatcacaaacacttatgtatctctgtaaaatacaatgtatgtatgcatgtaagtgtttttgtcctaatgttgctactcccatggcaaagaaaaaaaaagaatgaaaaaaagaaaaaaatttggaanaaaaaatcaggctcatagcagctactgtgtagaaaattccccctacttctaatttgctgaatgaagaaaatttacaataataaaacacttaaaagcaaaaaatatttaactggtgtttgggctttaaaccactgcgtttttcatcttcgtgtattttgacagaaatttagttatttattggttgttgacataacaagctcactttaanttngaaggagntngagggaggtggagtgtatatnattnagctctgggccagtanggtatnctncaaattacttaaccacgccattatngncaggggtacaaagtagttnctaacaggntccttnctatangtcannaatatnctgtaacagcntttcgtnacacttctatntcacagtaagtctatagtgtctataaatacttgagtgtccactatttggtcaattctttttctcaatagccaacaaagcctgggtattgctgaacagtttgtttaccaaaataggggaaacaatctggtccctaaggagttatagctttgcaggagtacaattctaagtcaatctttcattttgaagctcctagtttggacccaagccttccagggacctggagggaatccatcggtgaccataactggtacgacaggatatgccgccaacctaaagcgcccgatttgggcaacacaatcctcaaaaatttttgaataaagtgcgtacgtcgtgcggtgttgtcatcttgatattatcttctcgcctccct

SEQ ID NO: 634559 - DNA, 976 bp, Homo sapiens
  misc_feature (184)..(184): n is a, c, g, or t
  misc_feature (434)..(434): n is a, c, g, or t
  misc_feature (437)..(437): n is a, c, g, or t
  misc_feature (445)..(445): n is a, c, g, or t
  misc_feature (447)..(447): n is a, c, g, or t
  misc_feature (468)..(468): n is a, c, g, or t
  misc_feature (472)..(472): n is a, c, g, or t
  misc_feature (488)..(488): n is a, c, g, or t
  misc_feature (494)..(494): n is a, c, g, or t
  misc_feature (497)..(497): n is a, c, g, or t
  misc_feature (522)..(522): n is a, c, g, or t
  misc_feature (524)..(524): n is a, c, g, or t
  misc_feature (543)..(543): n is a, c, g, or t
  misc_feature (552)..(552): n is a, c, g, or t
  misc_feature (558)..(558): n is a, c, g, or t
  misc_feature (564)..(564): n is a, c, g, or t
  misc_feature (569)..(570): n is a, c, g, or t
  misc_feature (576)..(576): n is a, c, g, or t
  misc_feature (587)..(587): n is a, c, g, or t
  misc_feature (594)..(594): n is a, c, g, or t
  misc_feature (605)..(605): n is a, c, g, or t
gtgtttcaatcaaaactgaccatgagataaaggaaagagatgtggctttgtgatattctatcacaaacacttatgtatctctgtaaaatacaatgtatgtatgcatgtaagtgtttttgtcctaatgttgctactcccatggcaaagaaaaaaaaagaatgaaaaaaagaaaaaaatttggaanaaaaaatcaggctcatagcagctactgtgtagaaaattccccctacttctaatttgctgaatgaagaaaaaaaaaaatctttaattggggatatttccaaagactttggctcaagtagggggttttaattattaaaatttaaaagaaaaattatttagggtgttggggttaaaacatggcttttcctctccggaatttggaaaaaattaagcttctcaatggtggtggaattaaccaagctcactttaanttngaaggagntngagggaggtggagtgtatatnattnagctctgggccagtanggtatnctncaaattacttaaccacgccattatngncaggggtacaaagtagttnctaacaggntccttnctatangtcannaatatnctgtaacagcntttcgtnacacttctatntcacagtaagtctatagtgtctataaatacttgagtgtccactatttggtcaattctttttctcaatagccaacaaagcctgggtattgctgaacagtttgtttaccaaaataggggaaacaatctggtccctaaggagttatagctttgcaggagtacaattctaagtcaatctttcattttgaagctcctagtttggacccaagccttccagggacctggagggaatccatcggtgaccataactggtacgacaggatatgccgccaacctaaagcgcccgatttgggcaacacaatcctcaaaaatttttgaataaagtgcgtacgtcgtgcggtgttgtcatcttgatattatcttctcgcctccct

SEQ ID NO: 634560 - DNA, 138 bp, Homo sapiens
  misc_feature (56)..(56): n is a, c, g, or t
  misc_feature (131)..(131): n is a, c, g, or t
ccaggcgtagttgtcaagaagctagactgcaagatcaaatgtatgctgtcttcaangaaacccatcccacaaatagtgacacccatagactcaaagtaaagggatgaagaaaaatctaccaagcaaactcngcctgat

SEQ ID NO: 634561 - DNA, 1148 bp, Homo sapiens
tctgctggagaggggagtggtccagcaggtgaagggccactaccgccaggccatgctgcgcaaggccatggccgcgctagagggccaggatccctcaggcctgcagctgggtctcacggaggccctgcactttgtggctgccgcctggcaggcagtggagccttcggacatagccgctgctttcgtgaggctggctttgggggtggccctaatgccaccatcaccacttccctcaagagtgagggagaggaagaggaggaggaggaggaagaagaggcaggaggacagcagggtgaagcgagaggaagagcgaggcacggcaacggggaggcaggcaggcaggcagcgaaggggggcggacaggccagagcggaattgggcggaggacagcaggcaggtggagcgaggagggtgatgttgcataagctgcatgacagcaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagacttaggggaggaccatggcttactatagccatggatcaaagaggtacctgaccatccttccccatatgatgaccgacgtgcagagcacaaatcctccacattggaacaacgatctggttcatgtgagcaaggaagaaccacgccaggcaggacgcggagtacgaggtcttggacatcaaagctgagctcactggacctaggatgtagacaccacaaactagattggcagacaaacaacacccagggcagaggactctctgggacacccgctgtgcatggagccagagtgaagagaccaagatccatttaataatgcttcacccttggtccatgaaacaagagcccgggtaaactcggccggggaccggaggcatgaggtcaagaatcactgcatgcttatagacctcttacgtagaatactattcacaaaaaaatgggcctgaggacaagagaaag

SEQ ID NO: 634562 - DNA, 535 bp, Homo sapiens
gtcagagcgggttctccattcctcccacatggaaggacggtcgcatgaacagcaatgtcataccttccctgagaatgtcggggaggtcacctagatgccctggcatcctggagcagaccctatctcgcctccctttccagctctatttccaagccctatagcagatgctctcactatacaagccgacttctaacacgaggcccagtgcggaaaataaagcccaggctcctcaatgcttctcccatgtggctcccctgccttgctgggacttccctcatcaaggtggtgtctgctctcctggagctcactctccaggcatttgtttccctctctccttccaagcaggggtggaggtgataaatgtattatcagctccatcacatggagttccctggaggccaacttggggtcataaagaccaagctggagccttttatctaaggagcctaaagtctgaagatgtcaaagttaaaaacagagtgtggggaaacttccagcaatgggaaacacaggtcacaaaggacttgacggtgct

SEQ ID NO: 634563 - DNA, 204 bp, Homo sapiens
aacttgaggacgcatcaggcagaagaaggatgaggacatagctcgcttttgcgagaaaaggagttacaggaagagaaaaagagaaagaaacactttccagagttccctgcataccgtgctttatgcagatagtttactatatatgaagactggaggaactgaagccaaagagtgatgacaagaagctgtatctactaccaatca

SEQ ID NO: 634564 - DNA, 1217 bp, Homo sapiens
agcggagggggggcagcaggcaggcggtgggcgcctcggacgagcttctccttcctcctcttgacttcctccatggctcgctgcgtcgcttcgtgctggtgtggccgggccgcgcgtggttcctgctgccagacgccgacgggcgagggcctcgacttgactgccttccatccctgctcccccgccagggtcatctcaggcagcgagcgaggccgcagtcgcggcatggaccgccgggttagtcgccggcattcggaccgcggcgtggccgtacggctggagccttcggtgcattgcgatgcacgaccaccggttcgggggcgctgctgcacgcgctatgcttctgcgatgagtgcgaccctggcaggccctccggtggcctgtcggcttgtcgagggctagtcgcgacgattgcaccgccttcgagcgtgcgcgtgtcctaccgatctgcttgtgctgcctgcgttgccatgcttggtagactctgcggggtgagacttgggcggtctgcacgagggccgttgctaggttgtcttccgctcatgacttcacccctatggattcgcctgtcatgcaaagcgtaccgcgaatctaatccgatgattcctgggcgccatagggtgggatggggggacatgaagacttggtataaaggggaggcgtgccccttccgcggaccgcatgagtcgtagaccgagtcatagttcgatagtgaaagattgtagcccgaggcttttcaaccaaaaggctgccccgatggtgccatgtacgatgcccatgacggcaagcattccggatacgctcgtctgctggggcttagcgcgtgggaggtcccagaacgtacgcggcgtagcctggcgttgactaggtcgcggtctaatgagtgggcaggattgtacccagggggctgtggctcacttcggtggattagggttggggaaccgggtgtaccctctcgcctgagccagggtggctggaggacttcatctgggtattcacctggggtttggtccctggccaggattccaggtcctgggtagatacctgggccttgggttgggggaactttcccacgaaccgcaagtgtttcctgggacccgacttgctctcccgatttcggggttcccctgggtaaacccgcttcctggacagctaggcctggcttcgggcacaaggggcggggtactgctggcttgtacccaccggaggggcccccg

SEQ ID NO: 634565 - DNA, 189 bp, Homo sapiens
atgatgaaatcccatctctactaaaaaataccaaaattagctggcctggtcggtacggacgttctaatcccagctacttggcagctaggcaaggacaatcatttcaaccctgggacacggattccataggtccgcatcacggccattcacatcacctggtacaaccaaattctgtctcaaaagcacaaa

SEQ ID NO: 634566 - DNA, 175 bp, Homo sapiens
cacacacctgagtcgttgtttggtctgttgggtatcagctctttttggtactttctagtccatggctaatgcagtaaccagagagtactctgattaatgtctctatttccattctagttttgcctatcagttgtatgtgatagtctaattattgcggtttctctgaaaagctcat

SEQ ID NO: 634567 - DNA, 158 bp, Homo sapiens
agctgatggctcagcaagccatcggtacagcgattaagaatgccaaggcaaagagtggcgagatcgtcatgatggacgtgactaatggtgaggtcctggcaatggcgtcaatgcccacttttgactcaaataagcccggaaaagccaaagagagccag

SEQ ID NO: 634568 - DNA, 277 bp, Homo sapiens
ttacaaccccacgatcacatacaccttcattctcaccgaaatgagagtgagttctggcacatcatgttccgggatcaagctcaaccacgattctcaatcgtctgttgatcatcaccgccctctgacatcccactgtgagcaatgcatgtgagttatgacgaatgaccagactcgaatgcttcccacatgccaactgtggcacgccttattgtgtacgtgactagcgcgcccgctcctttggttgtcctcggcaagatgtctgagatgtctagggata

SEQ ID NO: 634569 - DNA, 646 bp, Homo sapiens
ggtcttaggagatgcaaagaccattgtttacattcacttcttcgtttaatatcaaggttgttaacaatggtcttaggagatgcaaagaccattgtaaaacttgatataaacgaagaagtgaatgtaagaactcctttgaacatatttataaagaaatatttgtaattggagtaagtagtagtgtatgaaatcatgtgtaatgtaaatgtaaactgcaatgtctatttagtgtgtaacaatgttgccataaaatagcttgctaaatgtgaaatgactttaatccctttgtcttcaatatacttcataaaggaggaaatgatgatttacacaattgtcatgaagcttccgtgtttatgagaaattccaagaagtaagagccaagaggacagatattatcagaatatgggacataagaaatcgcatatagtgtcaagggtatctatataacaacttcaattcattccctctgcatatatagtaggggtcaacatcttcgctcaatgttaaacgcgggacataatggacatccaaaccatgcatagctctccatctcaccactgagctaaaggtgtgcgtatacacatgcacttcatcaacataacactcatctatgcatataccacccagaacaacaaaacaacaaacg

SEQ ID NO: 634570 - DNA, 425 bp, Homo sapiens
tgttggtaacggcgtgcgtatagctctcccggcagtttccgctgcgaatgcgagacgggcttactattttgatcggcatcagccaggatgttgtgttctatttcttcgacgtgcccgggtcttccccgggcgcctgtgtggccacatgtgcgagaacacgctgggctcctacctctgcagctgttccgtgtgcttccggctctctgttgatagcaggtcatgtgaagacatcaagtgagtgcagcagcagcccctgtagccaggagtgtgccaacgtctacggctcctaccagtgttactgccggcgaggctaccagctcagcgatgtggattgagtcacctgtgaagacatcgacgagtgcgccctgcccaccgggggccacatctgctcctaccgctgcatcaacatccctggaagcttccag

SEQ ID NO: 634571 - DNA, 227 bp, Homo sapiens
atactgcaccacagctgtagtcgttgtataagcgctcttcccaaactcctgttcagtggctccgcagcccggtgccataggtgccgagtgacacatctctacttctgaaactacccagtcctgctcatcggcatactggctgctgtacctaccatggtggtccctctatccccaaatcctggccctgctcagaggcatcttggctggcctaagcccccagagcatct

SEQ ID NO: 634572 - DNA, 680 bp, Homo sapiens
  misc_feature (113)..(113): n is a, c, g, or t
  misc_feature (116)..(116): n is a, c, g, or t
  misc_feature (122)..(122): n is a, c, g, or t
  misc_feature (124)..(124): n is a, c, g, or t
  misc_feature (138)..(138): n is a, c, g, or t
  misc_feature (146)..(146): n is a, c, g, or t
  misc_feature (158)..(158): n is a, c, g, or t
  misc_feature (160)..(160): n is a, c, g, or t
  misc_feature (205)..(205): n is a, c, g, or t
cctgctggttcggacagacacctgataccagcaaagagtatggtctatgatagccagcgtctactgatttttagtaggatggacctctgtcgactgctgggatgaagactgcntangatgcntnctatgcttggcccntgcctggnggtcttaccaangngttggaagcctgaatgcccgttgtggacccccaaagtggctttgnttttaccccaatttgaaaattggggggggggggaaattattttctataaaaaacttgcgtgggtatatattgggggggcccaaaaatatatgggagccttttaagaggggtttttttttttttaaaaaaaaagtgtggtccctcttagaaaaaacacttttttaaaggctgtggtgttttttttatagaagaaaaaaatttttataaacacccccctttcggggggggccccccatatttttttttttttttggggggggggtggttaaaaaaaaacctcttttttgtttaaaaaaaaaaaaaaaagggtggtttttttttgagagagggcggaaaacccgcttgggttattataaaaaaaaaaagaggggggggggggggggcttttttttttttgttttttttcccccgcccgccaccaattgggggggcggctattttttataaaaaaccacccctcccctctcccggccag

SEQ ID NO: 634573 - DNA, 1467 bp, Homo sapiens
  misc_feature (1467)..(1467): n is a, c, g, or t
aaccgtgtactattagccatggctcaaccccaccgtgttcttcgacattgccgctcgacggcgagcccttgggccgcgtctcctttgcagctgtttgcacgacaaggtcccaaagcacagcagaaacattttcgtgctctgagcactggacgagcacaaggatttggcttataagggcttcctgtctttcacagcaacttatctccacgggccttctatgctgctcagcggctgcgctgaccttcatcaccgtccactaacctggccactggctgcgccaacgctccactcctactgcggcgcacgcaacacttctgcacacgcactgcacgacaccctctccacgtcctctaacacgcccatctcacggcggtcccttggtcattctgttggatccgactggcccacaactgcctgcgctctcgcgagaccactacaaactgcgcttctcccaacgccttcgtctctccgctcctttggcacccctgtccccacccgcagccttgcacgccctgcgcctcctgccgcccctgcgcctacgcgcgccctctcgcttgcgcctcgcctctctcgcgcccccacagcgctggacccaccgcacacgggccactgcaaagttacatgtggctaggcgcaaggaggcctcgaacgtttgcgccaatagtcccagcccctactctagacgcggcttccgccaaacgggcacacgcttggcgcccacacacgaaaccccctacgcccaactgacgcaacatcgctaattccaaacgcccatcttcttggcccttcgcctgcccattggttttacggaaccccccaagtccattaccgggcaacacatttacaacggcccttctcgtcgggcaaccctgtctcggccagggcctacactgatgaacgaataccgtagtaaacaacctccaagccaccagacggagacctttcaaacgtgtttccccgctatttccgttggcataacccgacccttcaaccgccggcacaccacaccgtccaccccgcgcccccgtttctcttccatacctctccgcccacagtttcacatgggcccctatccctcgctctacgtgtcctacagctctcctccttcgtcggccgaccagcccgtcctgtttcgtccgggcaatggcgcctactgtccctattccggcgcctcactgtcggccccttagtcgtccgtactctctcgccgccgcattcctcttcgcgaccgcagcgtccttctctccccgagcactcgtgccattctctcctccactacgccgtcgtggtgcgctatcagtcgccgccccctctcccactccagcctgtcggtcccctcttagcgtccactctgcgtcgcccgctttctcggtgctcccccgctcgcccttctcgaccacgccgccgtccctgtactctcggccgtccttctccctatccggccgcacgacgtatcagctgcaccgn

SEQ ID NO: 634574 - DNA, 160 bp, Homo sapiens
ccatggcccgcgggaaacccaaggaggagggcagctggaagaaattcatctggaactccagagaagaaggagtttctgggcaggaccggtggcagttggtttaagatccttctcttctacgtaatattttatggctgcctggctggcataaaatgttcca

SEQ ID NO: 634575 - DNA, 780 bp, Homo sapiens
ggagcccccagatgaccgcgatgccgttcagcccgggccccctcgccgtccacgtgtcaagctgggagcgggtgttacggctcatggaggaggaccctgccttccgtcgtggatcgtcttctccctgtggcatcgtgcagcgagacagctacggctgtcggggatctgtcgagggtgtctgggggccgtggggcgggggtgctgtcgtcgatggtcccccagcccgtctttgtgtcgcccacttcgacgaagggccaaagcgtatcgactttgcgcacacgtgtgcacatgaggcgaaatccccacgaggcaaaacgtgggaagtactttgaggcacaagggaactaggggggacgccgagtgtggagggcttgcctagaccatctcgttgtccctaatggccccctggaatcgaatgagatccaacgccagctccaaatgggcaaaggcgcaaagaccacactagagaaccaggcacaggagggacataccccgaaacgatacacacaacgcgtaataaggaggtccacccaaggacgagaggcaccactagtccaaagggaatatcagtgcccccagtaggggaaattttgggtcgacgagagcgatctcggaaacacgcaccggaggggaagtaaacccagggacgactacggctaggtcaaccttagtagcccccgacgagaagcgcacaaccaatccttcactagtaggcacaacgccacagtccaaagataacgaagggcaatctccatcggtcgggagtaacattgggcccaa

SEQ ID NO: 634576 - DNA, 204 bp, Homo sapiens
  misc_feature (70)..(70): n is a, c, g, or t
  misc_feature (123)..(123): n is a, c, g, or t
taaaaacttctgcctgtgagctgaaatgagagcaggagagagccctgtattctcaggctggcatgcctancgtagagcatggctctgtgagtggagggtgggtagaagaagaaagccccctanctctagagcacacttgcttggattttagcctcagaaacactgatcttgggtgggagataagaaatacaggggacccacagt

SEQ ID NO: 634577 - DNA, 138 bp, Homo sapiens
cactggtttagcggtgctctaatactgtgtttgcagcggatgtttatggtaaacaggcggggataagatttgccgagttccttttacttatattaacctttccttatgagcatgcctgtgcaggggtctctggtgaag

SEQ ID NO: 634578 - DNA, 296 bp, Homo sapiens
gtgactctacaggatccctcaggagtggcttcaggactctgcgatcttcttgaggcaggaggtcaggacatggatgtggggcaggaagccgtcctgacgcgatgtgtcagcttggccagcagcttgtttaactcctcgtcgttgcggatggcgagctgcaggtggcggggaattatcctggtcttcttgttgtcacgcgcggcgttgccagccagctccaggatctccgccgtaaggtactccaacaccgccgccaggtacaccggcgccccggcggagtctgaaggcagtctgga

SEQ ID NO: 634579 - DNA, 356 bp, Homo sapiens
aaatggaactattttcttgctcagaatcttccacaaagcattgagccgttaggaatttctaagaaggatctggaatgaaaaaaaatctttgaaaaggtatttgtatagcttcagttcagcaagattcatggtgggtgttagagtaagtgctggtgttaagccaagccatgtttttcaaagactcatctggcctcaacgttggcaggatcagagtggcctcccaggatctatcacatcctcagaagagttggttcaactggcatgtacccagatctctttgagctagtatgatactcccttaagtcaaaggctgccacatcacatctcctttaagtccccctaagttcagagccagg

SEQ ID NO: 634580 - DNA, 554 bp, Homo sapiens
caagtattacatgtatatcaataaaagtaggcactataacaataatcctaaaccacatatatgataaatgctattagatattgtctagttattaatataaatatataatatgctattaaatacttaaatgttccttgagaccttagaacttaaatcctgatgagggttttactatatttaaaatactgaagtttattatttatgcatgttatacagaaaaatgagtggcttataaaagatcaaaattataggcttaaacatggaatctctaggacatataaaatatgagtagaactgtgtatatataagatgttaatgtaagactacaggcttgtaatatcttaaaggaaccacttcactgtaagggagcagttagtctttctacctttccaattgtattgagattttgcccagtatgtctttttacttaaacaccttggtgaaagctatccagcatcctgtttataatctccttagtagcacttaccataattactttcagatctgtttccattctcagaaactgaaactgtcagctcatgtgagtggggcat

SEQ ID NO: 634581 - DNA, 1031 bp, Homo sapiens
actttgtgactatacacattctgtcgctctttatacttattgtcttcattggttgctcttcctctctgaccttcgtctgctcacatccatgagtctaccgcgtcctcctcttctgtgtagttatcctggtggtcttgctcggcttgttgatacgatggattctatcctcgttgatcgtatccttgatgttggttccgctttccgtcattggagtggttttgcgtcattttgtttcgtctggcgtagtgctactatgtcactggctcatccgcacgtatccttggttcccgagcggtaattcactttctatggtggagtggactgtctcgctttcggcgcaagtagtctgtcactaactttgatgtatcctgtgtcactgtgtacccctttccgccttcctttgcgtcgcctacctggccatgcctgggccgcgtggtggacccagatgtccatcattcaactgccggctggtcctctggctttgtcctaccctccgggagctgccctccgggcaccaacggtctcgccaatgtctcttgacattcgtattggtccggatggtctagtctattcatgttgagttctctccaccgctctcgtgccgtgacctcattaacttggccaagttagaggacacaacatcattcctcgtgaatcgaggatgctgtgacacccacacaaataacacgcatgtctcatcgctatggtggatggtgatcttttgctgatgtggcccagccagacctagacaccggattgtggccactgaatgcaccacacacttcttgcgtatatggagggacactttgctgtatttccattaaggtcctaactgcattgtactccacagcctcagctgaggcgtgtttgcctccgaagtgaaaaagatgcaacaggagaacatgaagccgtcaggagcagtgactccatgagaacagtatgaaagagaccatgcagcggtcgtgggagtgtacaggccaccccccataggtgaagaactgaagttcagcgctttacggcatggggatatt

SEQ ID NO: 634582 - DNA, 1028 bp, Homo sapiens
tgcgcgcggtcgcggatcaatggagtggagggaatgaaggaagtagagggatgcggagattagtcagtgatggtgcgcgcaaggtctgcggattgtgcgcagttagtgggtggcgagagcccttgcttcgcttttgtccttgattgcttgcgccgcgttattgtcaaggggccgggctcgccttatatcggcatgtgtagtaagctatacgaccataggtagtcgagctgactggcctcctgaagggacggggaagctgctacagcgtaatacgtggggaagatcctcagaagcacgagattgtactcctgagaagctaagtcacatatatcgacaacgctttactcggattggtagggactccgattcggaggccgatctcatcttgattatccgagggttcacgaatccaccagatcccacaacggaaaattaattgggactacgaagaaagagagacgtccctaaaggcgggcatccataggacattcgtgactccccgagccagtgtttgccccttgactggacacaagcatgaccaatcagcccaggtgtgacacagaactgttcaggcaagaccaaacatccaaaacaaccagtagatagatgccgccagaacagcaacaaccgggcaaccgtaagaaccgaaaggccgcaggaaacgtatcagcgtccatccaaaggaatgggcacatcgccccgacgccacacctccagcaccagagcgccgacgcgcgcagtgcatcacgcgagctccagctagggagtccacctcagatgatgacagtagcccatcgacgcagcccagcgggcaaacctcaggaggcgagcccatcgagaatgagcagagtcacggaaccacggagacgacacagtatgcaaagcgcggaggaacatggagctataggcaggcagcgcggaacgatgcgcgacgagggcagcaccagtccaaaaccggagagcacgcaggcgccgacagcacggcagagcgcggagcgtcccgctgcacacgatgtcagcgtcaagag

SEQ ID NO: 634583 - DNA, 478 bp, Homo sapiens
tcagctcgaagtaatcaatataccaaactgacatatttggggtggcgtttcctgaactccttcaatggctagctttgtttaatgagctattcaagcatacttgttaagaatgagaaaatttggtgaatgtaaatggaataaatgtttataaataaactttttatattttcaaaaatctttttgaaatcttaaatttatgttaaattaaataaatattcataaaattagtcatttctaagtaaaatactgaaaaattaattgctaaacataaatttaaatatatattttggcatcttatttttatgtaatatagagaatctctatactcaaatatatttggctttggtaatgaacataaaaaattggccagggcggtggctcatgccaccgtgaggcatgggaggctgaggtaggcagattgcttgagcccagaagttcatgatcagcttgagcagcatggcaaaatcccaatctctac

SEQ ID NO: 634584 - DNA, 554 bp, Homo sapiens
cagagcatcagtagtccttattagccggcagccgagagacagctagcgctcaaaattctctggccccgaagaaggagctagattttcttttatactttggtttagacaggggagagggggagtctagttgaaacaatcttacagaagtaaagtaggcaaaaagttaaaaggataaacggttacaggaaagtaaacagttccaggtgcagaggctttaagtctatcctaaggtgatggacgccgggctttgggcgttatcaaccggacacaaacgcaggggctctgggtgctattaaccgggcgaattcctgggaactgcggatatagcttgccacagtatcttatcagttaattgcattcttgatgcgctgggagtcagcttgcacaagttaagtccttgaggaagggggtgggtaaggggctgcgagtgaaggagtcacgatggagtccgtctggctctcttagctaaggaagagtcacttcaggttaaaacaaggtagggtatcacactagaagcctcacatcattaagcttcagtcaggcaggcgttcctt

SEQ ID NO: 634585 - DNA, 886 bp, Homo sapiens
ggtctgaatgaccataggatgaccggttgcagagtgcacgacgccagtctcccttctgggagggccggtgcctgggggttgccattgcccccagccacctgtcatgtgcgggcagatcgagcggaagatgagaagcccctggtgctggagatgcttgaaggccggctgtgcaaggacactggaaaaacgcgtggccctccattgccttgtactctggcctgcctggccctgctcctcctggcggctggcaagcctgcggtctgcgcttttgtcctggtcttccttcgtcctggccctcctcctgccggtgttccttggctgtggccgaccgtgaacgctggtgcctagcgggcccgatgtgggctcgcttgcctccggcgggtggcctggggaggcccctgggtggccgtgcggggctccggtgacgtgtgtgcgggtcctggctctggccccatggtcacaatatgcagggggacggggcccgggtcagccgcctgtctgtctctcgctggcaccgacgccggggcagtgggcacggaggctgctggccttcgctggaggcccgggcatcgggcctgggctgggggcactggggggacccccgggacccggctacgtggtcccacgtggctgatgagcccgaccttgcaggtggatgggggaacgcggggaacttaccttccgaaagcgcgacatgtagcgcctcacccgccacgtgcccacccaaccgtcgatcgtctactgtcgcgcacctatgaccagtgtagtccattacggccaccctgacctaacagccaggcagattctaacatccgcaacgtaaccccttaaggaaagcgacatcccatagatcgcacccacacccacaactccaagtgccaacgca

SEQ ID NO: 634586 - DNA, 431 bp, Homo sapiens
acagtcatgctcggtacccctggtctgaacttagggatcatctcacattttgcagtaggttttttttaggccggtggctacatagtggctcatgcctgtaatcccagcacttagggaggcctaggagagtggatcacttgagcacagaagttcgagattagcctgggcaacttgggaaaaccccgtctctacaaagggtacaaaaattagccaggtgtgatgggacgcgcctgtagtcccagccgcttgtaaggctgaggtgggaggattgcttgagccctggaggtctagggtgatcacaccactgcactccaacctgggtgacagagcgaggctccatctcaaaaaaaacaaaaaagatttttctaatgtcattcctcaaggatagcttatactgctattttggctgtgcctaagttcagagccaggcg

SEQ ID NO: 634587 - DNA, 734 bp, Homo sapiens
tcagtctaggtctcctggttcggggtgatcatttgcaccttgttgcagcagacgcggatgacttgcgaaggcggtctaattagcgtgacattggctactccgatgttgtctgtacaggaccaaccggattgtcgccgttctggcgcgcttcttgaaaccacacctaaccaacgctagttggtcgtctaacggtgcgagaatagttggtgtctagtggcctatgtagctatacttcacgtcgggacatgcacttcagcttaatcttgttggcacgcgaccatgattgcttcgcacgtcgagcacacgatagacaagtagagaaggaaggtatgttgaatacctcattaatcatagtacttgtggacatgcgagatcctcgggcccatggaagagctcgcgtctacaactggttccactgaaaatattgctgtgtcaacatcttttggcatgcatgatgtgaaactatcattgacctcaatgacttgtactgacatcatgggactgactgaatgagataaatgagagcacttgcattgcaatggcactctattcgattcggaatggaagcgacacaatcctgagagaacaagaccaggccgacccacggtctgagccgaacacctacctcactcagcgagacgcagtactgtaccacggccctcatatacattgtgtccaaaacaccttctgacagtgccagggaaatggggatagaaggaactcaaggacaaacc

SEQ ID NO: 634588 - DNA, 228 bp, Homo sapiens
cggaacccataggcattgaccatcacggttcgtagaagattcaaggagtccagtatcttgtattgcccaacattgcgttattgcgcatatgcaactaataaaacaaagcacatcctgcccacgtggcttccggcaagttcctggtccacaacgtccaggagctggaagtgctgctgatttgcaacatatcttacggtgccgatgaatagcgaggtgccgatgacacta

SEQ ID NO: 634589 - DNA, 758 bp, Homo sapiens
tggtcagcaaaaatcttttaaataaaaaatgtaggaacccaggtttagtttttggtaccctcggttgggcccgtcggcctcgggcacgctcaaatcctcccggcccttggagcggacgtagggttgggtgtggctgtgcggggtccctgggggccttgccagaaaatgccgggtaccaccttcttctggccctttgcgagagaccggaaagcaggacagtcgccaacagccctataggggagctccaagggccatgctgtctcgaaatgtgagagattcttgcccccttgcccttgagagattagcggctatgcgagcgccctggctttggctcaccgccgcatgtgcacattaccttatcagttggggtaccctccttgaacccgcacattcattcagttattaggcttccccaaaaccacagaccgtctttgtttccccggccaggaagctacatctcccggggactcactccgggaaagggacagagtgcggccggtgtggtgcgacctcataaacaaacctctttcaacacaacctgggttgatttgtggagataggtatcttcatggccagaaacctgtaataacttgaccaacagcctcaggtaagatatccgtggactctagggctccttgagccgaacctttcggcccttgttcatggcggatgtccacctaaaagacccctcccctgttgttagctcaggagtcgaagccccgacaacattgggggggccctgtattaggcccaccgct

SEQ ID NO: 634590 - DNA, 753 bp, Homo sapiens
tactgggtttttttgttgtttgttttgtttggagacagagttttgctcttgttgcctgagctggggtgcaatggcgcaatctcagctcactgcaacctccgcctcccaggttcaagcgattctcctgcctcaccctcccgagtagctgagattacgggcgtggtggcgggcacctgtagtcccagctacttgggaggctgaggcaggagaatggcgtgaaccgaggaggcagagcttgcagtgagccaagatcgcaccactgcactccagcctgggcgacagagcaagactccatctcaaaaaaaaaaaaaaaaaaaacagagaaggtttttaaatttttaaggggcgggcgcgagggtggcgttcacccctggtattcccaggcatttggggaacgcgccggggccaaacaggattttcggaacccggcggcgcaaactgtggcgtccttaaaattccaaaaacttagcgctgggccttgtgtgggctttggccccttgtattcccgagcatccctgggaaggcggaagggccgaggaagaactctctggacccgggacagattgttgcctcgcctatgacaaaagaagcggaaagactcccttttctaacaaaagggtctgctcactattttcggcctacaatttggcacttcgtgtaagcatttggcctctggcggattagaccctttggcagactcgtaaacaaacctcgggagacaattagaatctcccgggctaaggggagaggagg

SEQ ID NO: 634591 - DNA, 809 bp, Homo sapiens
gcggcggtggcgcgcgctgcgggcagtgagtgtggaggcgcggacgcgcggcggagctggaactgctgcagctgctgccgccgccggaggaacttgatccccgtgctccggacaccccgggcctcgccatggctgaccagctgactgaggagcagattgcagagttcaaggaggccttctccctctttgacaaggatggagatgcactatcaccaccaaggagttgtgggacagttgaatgagatccctgggacagaaccccactgaagcagagctgcaggatatgatcaatgaggtggattgccgatgggaactgggaacacttgaggtttccctgcggagtttctgagcatgaatggtccgcgcaagagatgatgagacgccaacagatgaagtgacggacgagtacgacaccagagcagtgcgttcctctgtcttagacatgggatggggaaactggctacatcacgccgccgccagagctgcgttcacgataaatgacgaacctgggggagaaagctgaccgatgaggaggtggatgagatgatcacgggatgctgacatcgactggacgattggccaggtcaattattgaagagtttgtaccagatgatgactgcaaaagtgaaggcccaccgggcagtgacggatggccgtctcttgatctctctcttctcagagcgcgcactctctctttcaaactcccctgagtaacccaggttctaacaaaaccatttgatttgactggacaatctgataaagcaccacaagatttgtcccaagcttgatgattggttttctctttttcc

SEQ ID NO: 634592 - DNA, 342 bp, Homo sapiens
tcctgctacaacggactgatacacagcaagactgtgctgcgtggagttggcagccaaatggaaaagtgtgtctgtggtggacataaagcggagatcctggccagcggaaagcctgccacctcctactgtgcggaccaccatcaacaagaatgctcgcgccaagctcagcagcatcagacacatgatccgcaagaacaagtaacgccccgacctgcgcatggcagccatccgcatgggccagcgccatcctgcgcagccagaagcctgagatggtgaagaggaagcgtgacccgacacacaccaagagctcctgagcccacctgacccacagtgctacagagt

SEQ ID NO: 634593 - DNA, 209 bp, Homo sapiens
taatacaattgattgtctctttctctccctcctctccttctctcccatccctcctttttccttcccccttcattttgtcttcccttcctccaccttctctttccttttttttttttttttttttttttttttttttttttttttttttttatttttttttttttttttttttttaattatataatattatattaaagtgagaaacaaaa

SEQ ID NO: 634594 - DNA, 138 bp, Homo sapiens
atttgggaccggaacagacagatcttcaagaccaacacacagacttacccgagagagcctgccggaacctgcgcggctactacaaccagagccgagggccgggtcttaaaatcattcccgaggggtgtatgtgcctgg

SEQ ID NO: 634595 - DNA, 1678 bp, Homo sapiens
taacaagtaatattttcaaggaaaggaaaatggacattatgatggctgtcttttgtccttttgtaaatggtggttcttctagagctgtgctatctaatatgatagccactagtcacatgtagctatttaaattaaattaaaaatttagttcttcagtcaaaataaccccatttcaaggttcagtagctacaaatggctagtggctagcatattggaccacacagatacagactgttttcatcattgcaaaaagttgtattaaactctattgtatagaatattttgctgaaatatagtatatgtggctgggcatggtgtctcacacctataatcctagcactttgggaggccgaggcgggcagatcacctgaggtcaggagttcaagaccagcctggccaacatggggaaaccgcaactctactaaaaagacaaaaatttgcctggtgtggtgacgggcacctgtaatcccagctacttgggaggctgaggcaggagaattgctggaacccaggagggcggaggttgcagtgagctgagatcataccactttactccagcctgggtgaaagagcgaaactccatcccatctcaaaaaaaaaaaaaaaaagaaatataatatatgtaacatcataaatacataagtgaaattaaaatggatataatataagacacttgaggtggggtgtagtggctcacgtctataatcccagcactttgggaggtgaagacaggaggatcacttgagcccaggaggtcgaaaccaacctgggcagcaaagtgagactccgtctctataaaaaagaagaaacttaaaaaaaaaaaagacacttgaaacaggaattgacttcatcagaaagcaaagcaatagtacaaattaatattaagctctcaatagatattttattgggcttcaaggaagaggaatttaatatctgagtataaaaaatgcgtacaagcagtttgagcagctagcctgctgaagcaatgccttatcaaaaataacaaagtttcagttttgaatcagtgtcaattatgtatatgaataataaatataattacaggagttttattgtgtaataagaaaccataatggaagtatatatgtgctttcagttatgaagttatgctcgtcagccagaattttttgaaacaaatatcatttttgttattgtgatgaatacctttattaatgttacactattgactaagaagttgttatctttttaccctaatgtgcaccttgctagcagatagaaactagtgtgaaacaggtagcctgtgattctttgaattgtcacattttaagtacaattggctaacttcatttttctgtcccaagcctacttagttgtacttgttaacactttaaggttatttagatcagaagaaatctggatgtctcaggccaggtgcagtggcttacacctataatcccagcactttgggaggccaagacgggcagatcacttgaggtcaggagttcgagaccaggctggccaacatgtctctactaaaaatacaaaaattagctggtcgtggtggtgcacgcttgtaatcccagctacttgggaggctgaggcaggaggatcacttgaacctgggaagaggaggttgcaggttgccaagccaagataatgccactgcattccagcctgggtgacagaatgagactgtctc

SEQ ID NO: 634596 - DNA, 1075 bp, Homo sapiens
tagaggatcccccttgatatactggtccaaacccttcaacaacagattgaagcagatgtgtacagaagattaacactgatattggtggggtgcggtggctcatcccagcactttgggaggtgaagacaggaggatcacttgagcccaggaggtcgaaaccaacctgggcagcaaagtgagactccgtctctataaaaaagaagaaacttaaaaaaaaaaaagacacttgaaacaggaattgacttcatcagaaagcaaagcaatagtacaaattaatattaagctctcaatagatattttattgggcttcaaggaagaggaatttaatatctgagtataaaaaatgcgtacaagcagtttgagcagctagcctgctgaagcaatgccttatcaaaaataacaaagtttcagttttgaatcagtgtcaattatgtatatgaataataaatataattacaggagttttattgtgtaataagaaaccataatggaagtatatatgtgctttcagttatgaagttatgctcgtcagccagaattttttgaaacaaatatcatttttgttattgtgatgaatacctttattaatgttacactattgactaagaagttgttatctttttaccctaatgtgcaccttgctagcagatagaaactagtgtgaaacaggtagcctgtgattctttgaattgtcacattttaagtacaattggctaacttcatttttctgtcccaagcctacttagttgtacttgttaacactttaaggttatttagatcagaagaaatctggatgtctcaggccaggtgcagtggcttacacctataatcccagcactttgggaggccaagacgggcagatcacttgaggtcaggagttcgagaccaggctggccaacatgtctctactaaaaatacaaaaattagctggtcgtggtggtgcacgcttgtaatcccagctacttgggaggctgaggcaggaggatcacttgaacctgggaagaggaggttgcaggttgccaagccaagataatgccactgcattccagcctgggtgacagaatgagactgtctc

SEQ ID NO: 634597 - DNA, 265 bp, Homo sapiens
ctagaggatccccaagcagtatacagattcaggttgtgattgatgcaggagcactcgctgtctttcccagcctgctcaccacccccaaaactaacattcagaaggaagctacgtgtacggtgtcaaacatcacagccggtcgtcataactagatacggcaagtagtgaatcatggattagacccatttccattgtcagcgtacgtctctaaggcagattataaggacacaaaaggaagctgtgtgggccgtgaccaatttatacc

SEQ ID NO: 634598 - DNA, 306 bp, Homo sapiens
agtaatgttaattcttatctaagttattgatgttttaagtttatctttcatggtactagtgttttttagatacagagacttggggaaattgcttttcctcttgaaccacagttctacccttgggatgtattaatgattcttgcaaagaccctcaaaacatcccaggggtagaactgtggttcaagagggtctttgcaagaatcattaatacaaagaattttttttaacattccaatgcattgctaaaatattattgtggaaatgaatattttgtaactattacaccaaataaatatatttttgtac

SEQ ID NO: 634599 - DNA, 612 bp, Homo sapiens
  misc_feature (513)..(513): n is a, c, g, or t
taaaatcgtttttggtgtaaaaatctcttcttcctcaggagtcagctgggctcccttctgggggcccaggggcagcgcatagggggactcgtaccactggtcgggtacgggggtggctggtgcagatagacgcacagatggcatatttcttcaccaggggttctgggtgacagaacccagctccgtttattaagatggctttggtgagcacaacactcgatagactcctgggttaacgagtgtcacaacacttctttggagcgccccagggagagaaatttccccaacggtgccaaccctctaggggcgccgggtgattctctgggtgtacctctccccggcgaccacgggcactggtggtgggatcgcgggggggggccaactctgtgggcgtgtgtggcagctgtgtggcgcgcccccaactctcatatacttctccggcgtctcttgggggggtaggggcgattctcctctgtgtgcgccccgggtttggggggcggcttgtggtgccangtgtgctcccggagagaagattgcgccattcggctctcgggccggcgcaaacatgtggggccggggtttcggcccacaaaaccgggtgaaagaagggcg

SEQ ID NO: 634600 - DNA, 380 bp, Homo sapiens
tttagtagaagagatccttcctatgccatggcactttcccacatgaggcctcccatggagtgccgttaccatttgctgaacaggttctcctcgactcctggcagctctatactacatttaaaggttatccgcctatctcataaagcctctcactgcatggacttcacggatggatcagatttccctatttataaaccattcatagacagactgtacatttcatttcactagcgtttaccaaacagattatgatggcaaagatgcgtcagaggcgtgggcctatctccaatcaactagcgttcctatgcaccccaaggagctcaaatccgtgttatcctaaaataaatacttaacatattcgcttagatcgtatattttag

SEQ ID NO: 634601 - DNA, 242 bp, Homo sapiens
  misc_feature (39)..(39): n is a, c, g, or t
  misc_feature (44)..(44): n is a, c, g, or t
  misc_feature (50)..(50): n is a, c, g, or t
  misc_feature (54)..(54): n is a, c, g, or t
  misc_feature (65)..(65): n is a, c, g, or t
  misc_feature (73)..(73): n is a, c, g, or t
  misc_feature (99)..(99): n is a, c, g, or t
  misc_feature (115)..(115): n is a, c, g, or t
  misc_feature (122)..(122): n is a, c, g, or t
  misc_feature (124)..(124): n is a, c, g, or t
  misc_feature (129)..(129): n is a, c, g, or t
  misc_feature (147)..(147): n is a, c, g, or t
  misc_feature (149)..(149): n is a, c, g, or t
  misc_feature (154)..(154): n is a, c, g, or t
  misc_feature (158)..(158): n is a, c, g, or t
  misc_feature (195)..(195): n is a, c, g, or t
  misc_feature (238)..(238): n is a, c, g, or t
cccagtctcagggctggtacgaggaagaagagtgcacanaccanaggtcngctntatagggtctntctatatntggaggtaatgctgtcattccttgantcgaccactcagcatngtctgtntnggaanatctcacattcactggcngnctgangacnagcttgttgagggagagaccttcctttttagtccatntaaacttattcatagcatccatgaaagaaaggatttgcccatngcag

SEQ ID NO: 634602 - DNA, 933 bp, Homo sapiens
  misc_feature (31)..(31): n is a, c, g, or t
  misc_feature (108)..(108): n is a, c, g, or t
  misc_feature (116)..(117): n is a, c, g, or t
  misc_feature (120)..(120): n is a, c, g, or t
  misc_feature (124)..(124): n is a, c, g, or t
  misc_feature (140)..(140): n is a, c, g, or t
  misc_feature (142)..(142): n is a, c, g, or t
  misc_feature (147)..(147): n is a, c, g, or t
  misc_feature (194)..(194): n is a, c, g, or t
  misc_feature (219)..(219): n is a, c, g, or t
  misc_feature (222)..(222): n is a, c, g, or t
  misc_feature (224)..(224): n is a, c, g, or t
  misc_feature (226)..(226): n is a, c, g, or t
  misc_feature (232)..(232): n is a, c, g, or t
  misc_feature (243)..(243): n is a, c, g, or t
  misc_feature (256)..(256): n is a, c, g, or t
  misc_feature (262)..(262): n is a, c, g, or t
  misc_feature (286)..(286): n is a, c, g, or t
  misc_feature (303)..(303): n is a, c, g, or t
  misc_feature (315)..(315): n is a, c, g, or t
  misc_feature (319)..(320): n is a, c, g, or t
  misc_feature (503)..(503): n is a, c, g, or t
  misc_feature (515)..(515): n is a, c, g, or t
  misc_feature (520)..(520): n is a, c, g, or t
  misc_feature (529)..(529): n is a, c, g, or t
  misc_feature (532)..(532): n is a, c, g, or t
  misc_feature (534)..(536): n is a, c, g, or t
  misc_feature (821)..(821): n is a, c, g, or t
  misc_feature (887)..(887): n is a, c, g, or t
gctgctgcccatgctgtgtgagagcacattntgattcctctgcgggtctgtccccactacgagtgttgtgcgctgaggggctgagaatctgtcagagaaaatggaganaagctgannagncccncccccccccccccccncnacaantcctccgcttctgggcagcgtggccctgccagagtccacctgttggncaggagccttccgagcactccgggnagncntngctgcntgcgcggcgtnggggccccccccngcgatnccccgggtcttcggcacagccacntgccccagtgtctgcangagagggtggtntggnntgttattctctgccccaccccccacctccccccagaggccacctcgcccctccctctgggacctctccggatggggagtccttggccagggtctctgactctgtgtcacctgacatttgcccatgagagccgctgggccttagagaggccttggcccagctgaccggttctgaagtatgggcntccggggttagnagatnccagcagtnccngnnngtgtccccatgtcccggcatgaaggacactgctagagagttaccatgcacaccgatggtttcctgtatcacagcccaaagaggttctctggtggccacagctgtgtgctcagtcagtgcactgggcaagctagaagtgttggggggttaatgtccccaggagcagcaaccctgagtcaataaggagcaggacctcagcttcattgtccttgagcaggacaattctgaagtgtattctacataaactctcagaggatgcccagcaggatggagtcccagttgcccncagcagtaacccactcattcatgtacttctgcgggggctttcccttccctcttttccccactcccngcccttgggcttcctgggatggctcccaaataaacctcttgcaccc

SEQ ID NO: 634603 - DNA, 226 bp, Homo sapiens
ggtctttgaacataacctctcaggtaaaaagaagataccgacaggcacagtggatcacacctgtaatcccagcacttagggattacaggcatgagccactgcagagtactatcttgaggaatggtggtctattaggagaaaaaccaaaagataagacctgagaccaaggaaatagtagtctcaatgcaaagatacaatcagaacattgcacaagggagaaagaaat

SEQ ID NO: 634604 - DNA, 867 bp, Homo sapiens
  misc_feature (66)..(66): n is a, c, g, or t
ccttgtgaggagctcctccgcttgggggcaaaacgaatagtttcttttcgagttgggaagagtggngaattttactccacaaggggtgattttcgttatgtaaaaggaaccctcggagtgggaggacattgggtctatctctacagtgccccgccttagatagaatgatccgtggtaacccccgccggtgtggtaggtcacagacgaagatttcttttcgccccccgcccctacagtggcggcgttatacaatcttcgtagcgatagatcccccacagacaagtgctgtgcggtcacccacgacaaagtgggagcttctgttttgttcaagaacacgtccatcatggggaggcgcaatccctctctgtgaagccgacctcacaaactctgtgtggatgagaaacatcgtgtagatgaacgtgatcgcctcgctaaggcatttgtctgaggtgcgcccgacccatacacataaatatttgacacacgtgggtgagtgtcgagcaatgattcgcggagcactgttgaagatcgcctccgagcctcatggcccccactgactacctctctattatgagtcatctatctttactcctctatccttttcataattggggggtgtgaggatgagcagaggcaatcctcaccaggggagatgtagcacattggcctccttctaatatagtctcccttgccacccaatttctctctggcgagttatttgcccccgttcttggagaaaacatgttggcagacttccccacggtagcaaatgcataccttggctacatttatctattctctgtctgatgctgacatgggtctcccaccgttgattttcctccccctataaaatcgcccacataacaa

SEQ ID NO: 634605 - DNA, 578 bp, Homo sapiens
  misc_feature (73)..(73): n is a, c, g, or t
ggacccggcgcctcggaggacccatggggattcctcgccgactgtccctgcggaaaggcggccccggcgcggncctcggcccctcgcgccgcggtcgcgctcggggtcccgattccgaggaggccgagtttgtcgttgagccttgcccgggaacaaagaccccgtctcgtacggcggcactccggcaagggttgcgggcccccggtgggcgcccgggtcactcgggggcgccttttgtggcgccccgggttccccgcggcgggcacacccgctggcggggcattcggccaccaagtggggttgcccggttggcccctgttttaggcgcggccacattaacgttgttcccccagcgtgtggtggtttttttctctgaaagacccttttggcacctccccagtttattttcaagaaaacctttgggctggctaaggggaccttacctcccgttggttctcccacgacacgtgaaaccggctggacaaaccgttttccacgggaagagggaccaggtggtggccggagaagacttcctctccaagcctcaggatctgtgtcagctgtcgctggaatgttcc

SEQ ID NO: 634606 - DNA, 1621 bp, Homo sapiens
gttaatccaggcgactgctctgtggggctctggctgctcctggactttgcctgggatcattgtgctgcgtctcgtgagctactggcagtgtgatgcagcgcatccaatggcgaacgagctattaccgcacaaggacaattgagcggagcatatgggttaatccgtggacaagctagccggggtgttcaggtagtgacatcgttcacacaatgatggcgtcccatgtgacgtcaatgaacggaaagtcaaaagcatactacatcgagcttctgctccgagccgtgctactgtcccgattatcgcgtgaagtctgtggattggcggagaatcctgtgggaccttctcccgtgtgataatcctaggtgttcgcggtgacaagcgagggatgccaatgggcacgtagcgaacagcagaggttctacaagtgaggttactgtgcggcgggtgcctaacttaaacggtacaatacactctctgagtagtgattgcatggcgaacgtactctttgctattgaaagcaggggggaaaccgaacgacgcacatctcgcaggcgtggtgggagagactagggagtcgtagcagaatcgcagagcccatagaagggtcatagaggcgaagtccctttggtgcaaacctggccgatctaaagattgtcaaagcatttgagccgaaggatttgccatacatacgagcgaattcaagcgaggaatagcgatggctcgaatggctggcttacggagaacgcccaattggtagtgatggcccccattggagttgaactatggaggaatagtggtaccaccttgggcacacaccaaacgtaaataattacgtaaaggcagttccaaacgaattggtagattggattggggcccgcccgacatcagaaagccttccttatatggccaaatagcgcccggtctgggattagccttttccaaccggggggcacctacaattgaaccgcggccgatgtcgattggggacaaactttggattgggttggggagggaagatgccaagaaaaaagccccatgctggtgccaaccccccggttcgtgattagaaaggtgtttcccaatggtgccatgtccgagagcttgggattgggccgaccctgtaaagccctgttgactcacccttgtttgggaaataatactcataactgaaataattatataagaaatatcacaaggacaactgtacgacaacgagaaggtatataaatacacaaacaaaccacaacttagatatatgtaatataacacaggagacgaggacaggacacagaaatattatatttcaatagactagaaaagaataccaaattcattaatatccataagagaaaccagacaaagagagagtaaacaaacaacagagagcgaaaaaagaggtcgggaaaaagaaaaatacacaccgagataatatataaaagaaataattataatgggaccgagcataataatgcatagtatagaaagatagtatgtatgatgcgaagatagagaactctctggccatctgcgtccgtcggtatgacgagacggacacggagtaaataagaatgaatgtaatagtaataaaaaagaagaaaagagaaaacgaagaaaggaaggg

SEQ ID NO: 634607 - DNA, 1206 bp, Homo sapiens
gggcgcagggcggctggcacaaacgtgccgccggtggccggaggaaaaagctcgccaccctgaagggtcccttcccaagcccttagggacctgcagaggacttggggaccagcaagcaacccccagggcacgagaagatgctcttgctgtctgccctgcctcaccctgccccacaccaggcccggtggcccccagctgcatcaagtggaggcggagtgaggaggcaggaggagggtggcaccatgggcccgggctggtgccctccatgccctgggggatgaagacactgctgccatggacagaccagtgccagaccgcagccccataagatcaggactcatccactcagattaccagggtctacgagcagagacccattggagacctgagcctggccgggccaggatgggagtggacgagttacctgcccatgtcccactgatcccactcactacacaacatgtacagagagatgccatagatgagagcactcgagaaagaggaagtgaggaacaccacaagagaccacaagcaaactactaccaagtgccagaacctcattaggtaccggaaaatgcgccgcgcaaggactgagagagaagaagctgacagcgcgctagcagaggtagaaacgccgcaagaacggactgagaacagcaaaagcggtgacaagacgaaaagcgcagccccagggaccgccacagcactgaggacccaccagaacgggcagagttggggccgcaaggacatgggagggggcaatgcgcaatcagcacacaagacacagagagacgctgaggccaaggaagcaaagaaaccacggagggccaggccacgcaaaggcgtgcaaagaacactagaaacgagcacagaagaaaagagagcacgggcaacgcgaggagaatgggagaagtgggggacaggccaaagacacgaaaggagcggtccagagagagcgcgggcacggagcggggagacaagcagagggagcaagaaggacggagagaagccgagcggggagcaggaacgagagggacaacacaggagagaacgagaaaaaaggaagcaggaaacgaacagagcgggagaaagatgaacaacaaaaggagacggagagcgagagaagaaagaagacggagaatcggagcgaacacagaccagagcggagagaacgaggacggaacgcaaaaggacgagagaagaaga

SEQ ID NO: 634608 - DNA, 533 bp, Homo sapiens
  misc_feature (65)..(65): n is a, c, g, or t
  misc_feature (75)..(75): n is a, c, g, or t
  misc_feature (98)..(98): n is a, c, g, or t
gtggctggggatgtacacgggaccagctcacgtaatgcatgcctgtaacaatgtaataaaaagcntctttctttnaaaaaaaaaaaaaaaaaaaaaanaaaaaagatgttgttgtgcgcgcgcgacttggcggccctgagaaaaacgttataaacacaactgcgttggggcggcgggggccccaaggggtatatggtgaccaaccggtcgctatacggtggttcccctaaaggaaacccgtgggcacagggacttagggcgctggggatctcccccaagaaaaaaaaaacggaccgggggcgagagaccccgagcgcgtttcgggaaacaatctcccaagagggggcggtctgggagggagcacacaaggggagctctaaccaaccagaggagggttccaaagcggagcgcccggaaatatacaaatttaggccccgatcggtgagagcacaaaaagtcgacagcaagccagacacgcagtaaacgaagagctaaccaaaacagtcagcacgacacatagacagagaccagca

SEQ ID NO: 634609 - DNA, 269 bp, Homo sapiens
  misc_feature (256)..(256): n is a, c, g, or t
ccgcggttcactgtcttacgcttccttgtgggctaaccaggataggatgtttctttcacattctacaagtgatggggacaaaccaccatagttatcttcgactccggaggttggcatcgccttccaccactaggggtccatcaacaggcaccacttgtgcgcccccatcacctcagaaggcaaaacagaggatggcattgtgacgctagctatcacctgttgttgctctcactccccttacgaactcacaccgtangacataaccgcgg

SEQ ID NO: 634610 - DNA, 340 bp, Homo sapiens
tcggaataaagacacagggtctcactctgttgcccagacaggaatgcagtcatgtgatcatagctcccttgcagcctcgaactcctgggctccagggatcctccatctcagcctcctgagcctctgggaccacagttgcatgccaccatgtctggctaatatttttaatttttgtgtaaatgcggggcgggtctcactttgctgcccaggctgatctcaatctcctagttttaagcactcctcccaccccagcctcccaaagtgctgggattccaggcatgagccaccgtgcccggccaataaaaaagaagcttgctttactttcaatgaggatagttct

SEQ ID NO: 634611 - DNA, 908 bp, Homo sapiens
gcccctgaccctgcggcgtgttgaacacgatgaagcgcaggaaggagatcaatggatgtgcctggcacctgtgtcccatgaggaatgctgcaaggatgtgctgtgagtccaactctgcgcaatggtgccaatgcatgggttactgttgcatgctgcttgcgatgtgaaccactgacaatggctcgctttcctctgttggccaatggctgtgagtgatgtgatgcatgtgcttgtgcatgcggctgccctgtgggatgcattgtggcagcaactggtgccaccaaatgatcccttggacaaaggctgtgctgtgctgtgctttggcgatgtgaatgtgatggggccacagtgaaaacagatggggctgggatggtgaaattgcctaatttgtggcacaaacctttaagcccggctcagcccttttgcctgtttgggcccaggactcgcttgaaagagggaacctgcccagtgaaactcggccagtggtgagaccgcctttggggagactgcggaacttccccccaacaagcggtggttttgcaccctcgtggacatgccatttgctcatgggccacgggcatctcccccagtgcgggaacgtggttcacaatttcccgggtggcagcagtgagatgacgtgaaacccccaaaacagacgcccctaatttccgaaacggactttccgggggacaccgaagcgtaaaactttcttttccgactttaaacttattacaccacccgagtgacaactttgcctactttcgtcccaactttttatgttgcgccacgtgacacaccggtgtggtgacacgtgcccgccgtgagctgattgggcccccacggtggttgtgcccacacattatttccccccgacataaaattatgtggccctttgggacttgattggc

SEQ ID NO: 634612 - DNA, 909 bp, Homo sapiens
  misc_feature (1)..(1): n is a, c, g, or t
  misc_feature (162)..(162): n is a, c, g, or t
  misc_feature (878)..(879): n is a, c, g, or t
  misc_feature (884)..(884): n is a, c, g, or t
  misc_feature (887)..(887): n is a, c, g, or t
  misc_feature (889)..(890): n is a, c, g, or t
naacggtggttccaaatttgcaaagcccccagatttttgtaactttatcccctggtcgacgatgtagtcccagttaggaagtccgggacaacaacccaggttagtatcgccctttaggcggcggggaacaaaagatcttgattttcaagagtaaagattccnctgttttcacctgacccatcttttcccaagccaagggaagtgctattaacttcatgaccgggccattcccgtcagagcgggaccaggtaaggcctgattcccagatgagaattcaagatacagacaactacacatgtctttcaagaacagtttgctgggtgttgaccaacatcaaactgcttatccaggaaccactagaagtgaatctcttcttgagtattccatactgctgcccctgctattcacttggggtcccagtcagttgttactatatatttgtcatctattgtgagagtcgtgatatcaccttccacatcagtgatactgagaaggaacaaatctgccaaagatgcttcacagttagttgttacctttttaagaagactgtgcttgaaaattatggtaaaacacatttagaagaaggatgtgcattttcacatcagtctatgaagtataacttgacatttaaattaaaatgctgttcttcaaaattaatttttcctgttttaattccaagttttcttgtacaggggagaagaggtaaggggtagctctaatgtgttggcttcattcacagaagaaacatttttataaacagttaagtgatgccagctttctgttgatgccatcagatcttgcaagcaaaaaataagttaatttcaatatcagttgatattatttcattcaacctatgtaataaagactctgtctccatnnttggnctnannggtggagctctgcagccgg

SEQ ID NO: 634613 - DNA, 102 bp, Homo sapiens
gccctctcccttctccggtctctcgcccctgtctcctttcttcttcttttttcagcgtccgtctctcacaccccctccgttcccctgtcgggctagtcgggg

SEQ ID NO: 634614 - DNA, 310 bp, Homo sapiens
ttatcgcccaacactttgggaagccaaggtgcaaggatcacttgaggccaggcatttgagaccagcctgggcaacataggagaccctatccctacaaaaatttttttttaattagctaggcatggtggtgcgcacatatggtcccagctactcaggaggctgagatgtaaggattgcttgaacccaagaagttgaggttggactgagccatgattgtgccactgcgctccagcctgggagacaaagtgagatcctgtcaaaaaaaaataaaaagttttaaaaaaggaacatctactatgtgctaattgtg

SEQ ID NO: 634615 - DNA, 837 bp, Homo sapiens
  misc_feature (1)..(1): n is a, c, g, or t
  misc_feature (162)..(162): n is a, c, g, or t
  misc_feature (806)..(807): n is a, c, g, or t
  misc_feature (812)..(812): n is a, c, g, or t
  misc_feature (815)..(815): n is a, c, g, or t
  misc_feature (817)..(818): n is a, c, g, or t
naacggtggttccaaatttgcaaagcccccagatttttgtaactttatcccctggtcgacgatgtagtcccagttaggaagtccgggacaacaacccaggttagtatcgccctttaggcggcggggaacaaaagatcttgattttcaagagtaaagattccnctgttttcacctgacccatcttttcccaagccaagggaagtgctattaacttcatgaccgggccattcccgtcagagcgggaccaggtaaggcctgattcccagatgagaattcaagatacagacaactacacatgtctttcaagaacagtttgctgggtgttgaccaacatcaaactgcttatccaggaaccactagaaatatttgtcatctattgtgagagtcgtgatatcaccttccacatcagtgatactgagaaggaacaaatctgccaaagatgcttcacagttagttgttacctttttaagaagactgtgcttgaaaattatggtaaaacacatttagaagaaggatgtgcattttcacatcagtctatgaagtataacttgacatttaaattaaaatgctgttcttcaaaattaatttttcctgttttaattccaagttttcttgtacaggggagaagaggtaaggggtagctctaatgtgttggcttcattcacagaagaaacatttttataaacagttaagtgatgccagctttctgttgatgccatcagatcttgcaagcaaaaaataagttaatttcaatatcagttgatattatttcattcaacctatgtaataaagactctgtctccatnnttggnctnannggtggagctctgcagccgg

SEQ ID NO: 634616 - DNA, 818 bp, Homo sapiens
  misc_feature (3)..(3): n is a, c, g, or t
  misc_feature (13)..(14): n is a, c, g, or t
  misc_feature (37)..(37): n is a, c, g, or t
  misc_feature (118)..(118): n is a, c, g, or t
  misc_feature (155)..(155): n is a, c, g, or t
  misc_feature (199)..(199): n is a, c, g, or t
  misc_feature (204)..(204): n is a, c, g, or t
  misc_feature (209)..(209): n is a, c, g, or t
  misc_feature (221)..(221): n is a, c, g, or t
  misc_feature (264)..(264): n is a, c, g, or t
  misc_feature (287)..(287): n is a, c, g, or t
  misc_feature (315)..(315): n is a, c, g, or t
  misc_feature (317)..(317): n is a, c, g, or t
  misc_feature (327)..(327): n is a, c, g, or t
  misc_feature (342)..(342): n is a, c, g, or t
  misc_feature (373)..(373): n is a, c, g, or t
  misc_feature (383)..(383): n is a, c, g, or t
  misc_feature (408)..(408): n is a, c, g, or t
  misc_feature (420)..(420): n is a, c, g, or t
  misc_feature (446)..(446): n is a, c, g, or t
  misc_feature (516)..(516): n is a, c, g, or t
  misc_feature (532)..(532): n is a, c, g, or t
  misc_feature (534)..(535): n is a, c, g, or t
  misc_feature (566)..(566): n is a, c, g, or t
  misc_feature (678)..(678): n is a, c, g, or t
  misc_feature (715)..(715): n is a, c, g, or t
  misc_feature (724)..(724): n is a, c, g, or t
  misc_feature (744)..(744): n is a, c, g, or t
  misc_feature (800)..(800): n is a, c, g, or t
gcngctgctactnncgccgctgcttcttagtgccgcnttcgcacgcgctgcggttgtcaccggcgccgccgccgaggaatgccactgcaaccaggaccggagtgcgaggcggcgcganatagaagcggcgcaggcccgctccatagcagcacgtngggtacggtccgggtcggggccggggcgagaaggaaaatgcaanatggnagcancaatggaaacanaacagtctgggtgttgagatatttagaaactgcggactgtgangagaatattgaatcacaggatcngcctaaattggagcctttttatgttgancngtattcctanaatcaacttaaaaanctgcttgccgataccatgataaatatcatgnctacatgatngctaaggcaccacatagatttcatntttgtcgaagangaatgatccagatggacctcattcanacagaatctattcaccttgccatgatctggtgatgcacacagtagaaaatacactgtatttacttctganattcccaaacactatnanntagcagcagcagctcttaattgctctcttgngaagcctcttgttggatcttatttcaggcaacactggactatggaatgtattctcgagaagaagaactattaagagaaagaaaacgcattggaacagtcggaattgcttctnacgattatcaccaaggaagtggaacatttctgtttcnagccggtantggaatttatcacgtaaaanatggagggccacaaggatttacgcaacaacctttaaggcccaatctagtggaaacnagttgtcccaacatacgg

SEQ ID NO: 634617 - DNA, 592 bp, Homo sapiens
gctacgaggtgctttattatatggttgttacactcgtgcaccagtggaactcagaaactagtccagaatatcacaggtccggcgcaaaggaccaccatgcagtttgggttatgagcaaggtgagtctcagaggtggtcttggtgaccagatggagatgaagttctagatgcactgaaacaagctctagacagtagcatgctgcccaataactgtacgaggatccccagcatctggattccatgtttctgctcctgtagcctccatgggtgcataagcttgtggtttacttggacctctgcctcatctttcttcttttgcgcttcagcctgcgcattcgcttcctccactaggctctcatggtgcagaggtttccaagaagatggtgtgaaggccgagatcatttggttatattataaaatagaatgcaaattcacacaagttttagttttatatttatttatttttttagagatgaggtcttgctatgttgtttagtctggtctcgaactcctggcctcgtgatcctcccaccttgacctcccagagtgctgggattacagagctgagggctgagccactacacccaaatga

SEQ ID NO: 634618 - DNA, 1350 bp, Homo sapiens
  misc_feature (615)..(615): n is a, c, g, or t
gatcatgtgctccctcccacttgccaggtgaggaaatgttatccaggtcatggatgccatgtttggtcaatgattcgaagactgtaatggttggccagattcaggatgcacatgcgtttctggacgctcctccagcactattccctcacatggagttccattgccctctctacgtgaggatatgtcaggtgtagtacgttactcggtctgatggactacttgagacgtcagtggacacaggcaccagtacgcctgtggtgctagcgagaactgggtgcctttgagcgcgaaggcgtgccgaggtattccaatgtaatagcagcagctggcccgttcatgctcatcagtagtccaggccacggaggaggttcactatgtatactggggtccgacctcctgacatactagtgcagactcaggtgtgtcggccgatggtgagaggttagactgctgacccgtgggaggacatatgcatatcccattgtcggcattctgtagtaaacgcttgcatcgcgttgtgttcttggacattattatctctggcaaagcgtgtgacagatgttctgccagcgcgtctcgcaatcgagcaccatgtgagataactatcttgtacanctcaatcgttagaacgatctcgtcggtgatcgtacctatcatctggtacaatattgctgtggctggccacccggtcgtgagagccgagcaagtaaccatagatcggggacccttggatcaccgatgcaggtaactccattggtggcggacaggccaaagtgcctgtgaggttccctgggaacatgcaagaagaattcagtcgctgctttcacaggtcctcaaccgggttgatgaaatgaacctcaagaaagctgaaggggcattctcatggtcagggtgtggccggcgacccaccacggtaattgaaattggtccatgcgtgtcctagcttggttccgtggaggccacctttcttgttgcacacgtggggctgcaatcgggcggggcccccaaaaggggggtcgggataaccttccgataacgcccaggtaaccgtacaaaacatacgagcgaagaagtatcacgaacctaacaccgcgaggccccacactggcggggcggttcacaccccacactagtaggcgggcgcaattggagcgtaagactcacccaacaatccctcgcgacggagcacaaccgaatggacgcacgcgccgcaaacaacaaccagaacgacgctacaagtgagcgcagacaagaaggacacgcaccacccacaatacaaagaccggcccacacatactaccacaccaaacatcacgccatcagtggccacgcgcagcagcgacaactctt

SEQ ID NO: 634619 - DNA, 672 bp, Homo sapiens
  misc_feature (55)..(55): n is a, c, g, or t
  misc_feature (77)..(77): n is a, c, g, or t
  misc_feature (93)..(93): n is a, c, g, or t
  misc_feature (97)..(97): n is a, c, g, or t
  misc_feature (100)..(101): n is a, c, g, or t
  misc_feature (118)..(118): n is a, c, g, or t
  misc_feature (120)..(120): n is a, c, g, or t
  misc_feature (181)..(181): n is a, c, g, or t
  misc_feature (189)..(189): n is a, c, g, or t
  misc_feature (196)..(196): n is a, c, g, or t
  misc_feature (210)..(210): n is a, c, g, or t
  misc_feature (227)..(227): n is a, c, g, or t
  misc_feature (250)..(250): n is a, c, g, or t
  misc_feature (258)..(258): n is a, c, g, or t
  misc_feature (267)..(267): n is a, c, g, or t
ccccctggcaccaggttgccaaggaagcggcccacctgaaagaatttagattganaagaaaaactgcaccttcctgncaaaggtcgggggtcncggnggnngggggggtggtggggtngngggggcggcggcttcttctagcggctcggccataccagccactgaggtcctaactgcggcnggggggcngttctgngcatgtggctcacnctctgtgctctgttccncacggggcaaacgcacatgggancgttggtncgctcaggnactggttctgtggtggaacggtggatgtctgcgctgtgacatcagctgagtaagtgacaacgactgagggtgcgggtggcccgggggtgggggggggggtgccaggtcgggcagggttgggtgtggtttgctttgggaggagagtgaacatcacagggaatggctcatgtcagccccaggagggtgggctggcccctggtccccgggctccttctggccctgcaggcgatagagagcctcaacctgctgccgcttctccttggcccgggtgatggccgtctggaagagcctgcagtagaggtgcacagccagcggagagtcgtcattgccgggtacagggtaggtgatgaggcaggggttgcagttggtgtccacgatgcccactgtggggatgttcatcttggc

SEQ ID NO: 634620 - DNA, 1041 bp, Homo sapiens
  misc_feature (1041)..(1041): n is a, c, g, or t
tggttttgaccaaaatgctgatagtgatatggaaaataaagtccaggttgaggaggtctcagatggagatgaagagcaaaggtaactcttgtcatgctttagcaaaaagactggcagcattttgcttctgccatagagatctgtggaacttggaacttgagaaagatgatttaggcatccggtggaagaaatttttaaatagcaaggcattcaagatgtgacttgggtgttgttaaaagcattcagttttctgtattcacaaagatatggtttggaatcagaacttatgcttaaaagggaagcagagcataaaaatttagaaaatttgcaggctgatgatgcaatagaaaagaaaaacccattttctgaggagaaattcaagcctgctgcagaaatttgcgtaaataatgaggagaaaaatgttaatcaccaagaaaatgcagaaaatgtctccaggtatcgcagagagatttgcagcagcccctcccatcacaggcctagaggcctaggaggaaaaaatggtttcgtgggctgggccatggcctcgctgctctgtgcagcctagggacttggtgctctgtgtcccagccactctagctgtggctaaaagaggacaggtacagtcaggctgtggctttcagaggtgcaagccccagcccttggagcttccaatgtggtggttgaacctttgtgggttgcccagcaggtcaggaatgacggttggcaaaccctctgccgtagttcacgacagaaggaggggaagcaccggatgtcccaggcagaagctgccgtaaggggtacgggccccaatgcacacccactgcagggctggtgaaaaggcaggggggggggcccaaagaccatttgggacgccacggagcggtaagacaccaaccgaaacacaagggatccacaacctgcggcgcggaaacgcacatctgcacaaaaacaggagagacaacaagagcaagaaactcttacagtcagacacgcacaggcgcatagcgcgagcgcaagcacaaacatcacatgtatggacgn

SEQ ID NO: 634621 - DNA, 243 bp, Homo sapiens
tgaagtactcacaaacattataaaaatactattcaagacagtgcaagagagtagattagcaaaaggtaagtttttttccctagcctgtctcattttgccatcattacacagactatttggaatgtcttagatgtcctcggtattgtaattttctgtgtaggtagaaataaatgtagctttcttattttacacaaataggaacttactgtatatactgttctgcacttggcttttattaaagat

SEQ ID NO: 634622 - DNA, 219 bp, Homo sapiens
ggcttcatcgtgttgaccgcggtgttggcacgaaagttgaccaaacccagtgggcttcgtattagcttaggtttaacgagtcgctaattgctaaaggttattcttagctgttcccctgtgtgaaagtggctaggctaagcgttttgagctgcattgctgcgagcttgatgcttgtcccttttgatcgtggtgatttagagggtggcgtggccagaagga

SEQ ID NO: 634623 - DNA, 633 bp, Homo sapiens
  misc_feature (475)..(475): n is a, c, g, or t
  misc_feature (572)..(572): n is a, c, g, or t
  misc_feature (632)..(632): n is a, c, g, or t
ggacatccatatcacaaaaatgaaccttgacttaaatgactttatacaaaaattaactcaaaatgggtcataaacttaaatgtaaaatgtaagactatgtaacttttagaaaaaacataggagaaagtcttccagatctgggctaagcaaagagtttttagatttgctaccaaaagtacagtctacaaaagggacaattagcaaacattaaaattaaaaatatttactctctgaaagcccatatgataaagagaatctccagacatatttgcaagctgtctatctgacaaaggactcatatctagaatatataaagtactctcaagacatcagtttagaaaaattcatctagacaattggcaaaagacataacatttcattaaagaggatatacaaatgtcaaatacagaaaagatactcaacattgctggctattagggaaatgcaaattcaaaccataatgaatatattattntttacctgccagatggctacaaataatgacagcatggaaatctggtgactatgtggagaaactgtatcacacatcactgctggtgggaatgtgatgntatgggtaggttcttattgacacgtgcaggtacccatctctagccattggactattgggnc

SEQ ID NO: 634624 - DNA, 212 bp, Homo sapiens
ttaggatgggtctgtgtccgtgtgtgtgtgtttgcatcctcagggaggactcagcccaaccagccaggtgtgtgtgtgtgtgtgtgtgtgtgtgtgtgtgtgtgtgtgtgtgtgtgtgtgtggatcctcggggagaactcagcccaaacagccagctagagagcagctgacaccctcactatgtcccctcaaggggtctctagagataaata

SEQ ID NO: 634625 - DNA, 1661 bp, Homo sapiens
  misc_feature (1454)..(1454): n is a, c, g, or t
ctggttatgttgtgtcgctcgctggcgcgccgttggttgtggaggcgccggccctccccccgggctggaggatattgtgttgtgtttgtgtgcgccccccggctgtgtgtgcttctgtgtgtggatgcccccccccgcgctgtgtagtatgaagtgagggtgtgctgtcgcgtctcagccgcgtgcgttattaggtagtggtggggcaacgccgcccctgcgttgtccccgccggcggggtggtgttttgtgtggtgacggatgaaggagtgaagagggggaggggttgctttggccttattaaagggcggccgtcgtgttgtgtgtgcttattaggcgccgtctggggtagccgcccccccgtcgtgtgttgtgcccgccggctggattgagggtgggctctataagagggttcccccccgcctccttgttttttagtatagaacctcgttgtgaggattgtgctctgtaatgagcattagggggcccaccagaaggaagaatagggggtcccccccccccacagatggggggattagtaacctctgtgtgtttccccacgtctggtggtgtttgtagtaggggcttcacacaagcggagataaaaaaaataaattttcggcgtcctccaccgggggtccttctctacaagtagcaccccaccgccttcttgttcttctacatcgcagccgcaccacgcgtgttttttgatgaataatgggaggaagcatcacccgccgtcatggattagtagtgctcccccaaccagttgtgggttgttttaatcacccacccaatggtaaggcagtaagaagtttgatggaagtatttatgagaaaggtgtaggtgggcacgaccagcacacacaacagggtgctcttctttgggcgagtgacgataatatgagcagatgagatgatgcggtggatgagaatatttatactacaacaggccgcggggctgataattatccccaccaccaacataggaagattgggtgtaccccaccagcatgacacattaggaagatgtgttctctcctcgggtgccctcgtgggcgccacaccacaccgttcttgggttgtggtggcccccaacagctggtgggagagagcgtgtgtatttgagctgtgtgggaccctctcagaggagactctgctgggcctcttttttgtctctgttttctgtgtggtggtctcacacactcgtctgggacgcgctccacccctctcggagagatagagagatgaccccacaccccacgaggatagagcgcgccagtctgtgtacgaccagagattgggtgagagaacacactgtctctgagagagagatatagatattgtgcgcgcacagaaacactctgtgtgacacgccccctgtggagaagtgtgctctggtggtctctggtgtgtttgtgtgcgacactgatattacctggcctgttgtctttngggtggcgccagaaaacatctgacacacttgcctaaggtaatattggtgttcttagattatatccagaagagagattaagaatggtgatagttccacccgcgcccatccagctggaattgagactttggaataagcaccccggtgtttcctagccccgtttttgtttttaaagttatgaagaaaaaaatcccataaaatttctaaaa

SEQ ID NO: 634626 - DNA, 501 bp, Homo sapiens
ccttagcaagatgtgaaccacaggccgtccttatctagacttgactcttaacaaagaggtgtctgtgtctaacctgttatgcattacactatgggacacactgcctcttgcacatgtaaataaagtcacagagttacatggcggtaacgattgtacaaaatttgtcccacataacttatgttgtatggcaggttcggtgttgcaaaaatcaactctacatctctcttgatggaacatgtggcctctagatactgccactccaccccttcctaatgctagagacttgcattacctgttttggctcctgaaagcattaagagttagtaatccctgctttacttacatacgttaatctgattcattctttaatataacttattgaacgggagtatcggagtacagtgaccagatctcggctcactgcacgctccgactcccgggatcatgccattctcctgcctcagcctcccaagtcgctgggaatacaggcgcccaccacca

SEQ ID NO: 634627 - DNA, 331 bp, Homo sapiens
  misc_feature (57)..(57): n is a, c, g, or t
  misc_feature (72)..(72): n is a, c, g, or t
  misc_feature (82)..(82): n is a, c, g, or t
  misc_feature (113)..(113): n is a, c, g, or t
attatccatagcatagtgctaccagttgaactttctccacatatcaaaatttaagtnagaattacgtgattnctgaattttnatttcttgtttcaagccagggtggattaganatgaaaaaaaaagcatgcatttcctttaacttttgttgcagaaactcagctgtattaggaatagtgatcatctgtttgaagctgtgaattgagagataaaggtgcaagctaggagtccgtggaactgggtcatgacacatgatatggtttataacaaggaagggggagcaaggatcagaaagccttgtgagtttcatacgtacaggatggaagggttt

SEQ ID NO: 634628 - DNA, 807 bp, Homo sapiens
  misc_feature (444)..(444): n is a, c, g, or t
  misc_feature (737)..(737): n is a, c, g, or t
tccaacaaaaaagtttttatggagcgcctactatgtgccaggcatgtgttcttaaacccccccccaaaaaaaacaaaccaaaacaaccacgactatagagggatcgtaaacaaccaacatttctaggggagccgacgaaacgcggggccacagttgactataacgacgcggtataagagagacactcgtgaacacatgacccgtgcaggtagtgatgtgggagcgtctctgctataaaggcccccttttagggcctcctaccgaaatacctccctcctcttcattttggggggggagtatcctctggagtacctgcgcttgagaatcactctgacgaaagagcaaatctagcgagtgtcacgtcacatgtgtggggctctcttacgagacttctacaggagaaaaactttacactattctccgtacacaggtcctctccgcttntgttgtcccccatgtggagacgaaaggcgcccttcacggcggggagcactcttggagccaggtgaacccttggtctcccgaaagatggcgctctctagacaaagacgtctcttcgggagaatggggcatgaagtgcctaatgtcgccaacataggaaagtcgtggagcattgcgccaattctttaagggggccccacaaagagttgcagggactcttgtcccaaccaacgcaagcggcatttggatctctcgagcaaacaattcgaagatagaggagcgaagtaactacaccnagtaatcccaacaaacaaaaatgattcatctcatcgcatgagatcacccattatgggtatccatcagcgg

SEQ ID NO: 634629 - DNA, 133 bp, Homo sapiens
  misc_feature (1)..(1): n is a, c, g, or t
ntctagaggtcctgatatgtgtctcacctggcataactgttacagcttggctggcccagtgggggagctgtctcagttcaccgtgatctgtatcgggtatggattctcaacagagactgtgtccccttcctgg

SEQ ID NO: 634630 - DNA, 500 bp, Homo sapiens
gactgggtcgaagaccggtctgtgaatttctgttttcatatcacctgtgtgtctgtgaattttcgtgttttcatgcccacctgcgtgtctgtgaatttccgtgttttcacgcccacctgcgtgtctgtgaatttccgtgtattcacgcccacctgtgcgtgtccgagaatcagcgtgtttacacacccacctgtgcgtctgtgaatttccgtgttttcacgcccacctgtgtctgtgagtatccgtgtgtccacgcgcacctgcgagtgtctgtgaatttccgtgttttcacgcccacctgcgagtgtctgtgaatttgcgtgttttcacgcccatctgcgtgtctatgaatttccgtgttttcatgcccacctgcgggtctgtgaatttccgtgtttacatgcccacctgcgtgtctgtgaatttccgtgtttacacgcccacctgcaagtctatgaatatccgtgtattcatgcccacctgcgggtctcgcggacaca

SEQ ID NO: 634631 - DNA, 954 bp, Homo sapiens
ggtcctgagcctggcgcggaggctatgggcagccgaaggaggtgctgggtccacgcggccggttgtctcctccggtctcctcctgcacggtgtcgtatcggcagatcacctttgtctagaatgcatttattcttcgcttcctgtcaaaggaaatcgtgggcgtagtagaatgtacagactaacgactgctttattcaaccaccctcttcctggactcagtagaggctctcccgacagagcatgtcgtcagtgtgggtcacccaaagcggaggacatgggaggccatgaacactgccaaccttgctgtgagctaaatcagtccgccctggggtgtgtttaggtccttattcctgggcatggatctggttgcagctgcttgaaggtgcctgatcctaatgttgtccctcactattgcaactatggagtggtgctgtataggtctcatcgcgcagttggtggagcttctaggagagccctgtaggcgtcttggcacaaggcacatatgtctgtgagagctcacggtgattgcagagagcctgtcggtaattcttaagagcgtctgacagtttttctcgtgctgtggtatgcctcactgggggattgtacattttctctttggaccagctttttctataccacagtctggtgctctgctcatgttattatttgcaccaaaggttactgggttcccagaatcaagcaagcttcaaagtcttcctgtcttccagaatacaagatctgttacccaatatgacaagaatggagcgtttataactggaaaggaggctaacctgaattggaagtttgcaaacagggttctgaaacaggtttgacggaagggagcgatagtgataacttttgaatgcttgaactggggagacgggggggtgagaaaggaaaaatgagggaccttcggacaaactcatcacaagacgcgaagggaatttaggaagg

SEQ ID NO: 634632 - DNA, 157 bp, Homo sapiens
cggtccggcgcgtggtgtagttgagggaactgtgcaggcacagtcacatcgctgggattcgtgtagtgcttcactgtggcatgtcactggacttgcctggctagtgcacttgtgtgtgcctggcatgggtcagcgtggctgctctgtggttgtacag

SEQ ID NO: 634633 - DNA, 194 bp, Homo sapiens
aggtaatttttgtattttttggtagagacagagtttcaccatgttggccaggctggtctcgaacaactgaactctagtgatctgcccaccttggcctcccgaagtgttgggattacaggcaggagccaccacgcccggccagagccagagttttaaattttgccaaactcctatccatccatcattcctttcca

SEQ ID NO: 634634 - DNA, 179 bp, Homo sapiens
  misc_feature (1)..(3): n is a, c, g, or t
nnngcagagcactgagcttattacaaacttccacagaatccctcaccctccaccccagggtcctccctctctggaactcatggcatgcagacaatgcttgggtccacccacctgcccaacctaacggacatgcttgggcctgagctgggagtgcaggggattccatctcctgggtgcgc

SEQ ID NO: 634635 - DNA, 139 bp, Homo sapiens
gcggccgcctactactactactactgctcgaattcaagcttctaacgatgtacggggacatgtatcttgcttaaatttctgtttattaatttatatccacccaagtacataaagcaaatttggaggaaacaataaaaaa

SEQ ID NO: 634636 - DNA, 490 bp, Homo sapiens
acctgataacatctatggatcaaagaggtggtgtttgatatgggatgaaaaacaccacttaaaggaggcatttgcttatcagcgacaataagcaaaagcttgaagggtatgttattctctcagtactacttctccacttcgcaggcatatctattcaggagggcatcttgaaagaggagcagggtcacccacgacttcttatatctcctgcagtgcactggccaagtgtgtgtgtattgatatgcttgaagcccctagggttctcaacatgccaaatcacaaaggggttcaatttgtggcctgcaacattgcccccaagcaagactgtcatccagtccctaaaagacttgaagcctggcattgctttggtctacctcatggatcaaagtcctttcaggcatctgtttccagaatagaaaggtttcatccatattgaaaatttgttctggcaagtgattttcctccagactcagcttatctagagtttccc

SEQ ID NO: 634637 - DNA, 585 bp, Homo sapiens
  misc_feature (496)..(496): n is a, c, g, or t
cctccgaaccagatgtgccggagatcagcatcgtgataccaacgtagatctacgaagctgcatcgtgtgatggttaggaagtgatcgatacccaacagggtacttcgaatatggaactcattcaaatccatttcctccaagatccaatcggtcccgtacaaggcatcctcctggctgtgcgtaggagggactgaccaacctatccacagccagccattcggaggagcccgccttagccttgtcgctgaagaacgcatgaggtcggacagtgttaggcacctcaaggtaatcatctaagagacctaggctttcttcagcccccaaacccgacgggtcgaagggggacatcaagtcccccaccaacacctcgctgctcaggaagctcatttcggtcatgttgcggtgctttgctggaatcgaggaatgtgcttaattcgaaggtgtctttgtcggttacagcaacgctgctgctgaatgccgtgagaagcgccatggnttaagccgctgggggttgccgctgcagagcctggtgctgctagcgccgctgcaaaggccaatggctgcgcaggcactgttgccctaata

SEQ ID NO: 634638 - DNA, 174 bp, Homo sapiens
  misc_feature (28)..(28): n is a, c, g, or t
  misc_feature (98)..(98): n is a, c, g, or t
  misc_feature (168)..(168): n is a, c, g, or t
cattaggactacgggcatgaaccacctngcccagccttaattttggttggtggagaaagtttttatttctcttgggttttggaaggataatttggcanggttcaggattctaagtgggggggttttttcttctcaatatgatatttggtcactctcttctggctggtnccgcgg

SEQ ID NO: 634639 - DNA, 191 bp, Homo sapiens
acctggtagccggccatgtacgcctggatgaagcattaccatgtacgcccacgtatctgtatggctgaccaggactcgtataacgagctgacctgtcccgtgaattcttcgtgcatctatgtgtcgcggcctgcgtgccggcgaccacgatgcgtgctggcgcgtgttccgtggccacgcctgagcttcgc

SEQ ID NO: 634640 - DNA, 414 bp, Homo sapiens
tatccactaatgacctcagggaatattttttttgtttggactgtgcaacaacctgccttgttactacatatatgatactttaccttgagtgagggtgtttttcagatctgtcttcccattcttactaatactggttaattaagctgaaagcaatggccaaaaatggtttcccgacacgctctttttttgagacttggcatatcctataatttttgctagtgaaaccacacaaacacctccatgggaatgccggcttgcctcactttgagggtgctaggggaagaattacacatacactttatgccactgacatgcactttatactacaacaaccgggccaggcatggtggcttacgcctgtaatcccaccactttgagaggccgaggtgggcggatcacgaggtcggaagttcg

SEQ ID NO: 634641 - DNA, 180 bp, Homo sapiens
  misc_feature (7)..(7): n is a, c, g, or t
  misc_feature (14)..(14): n is a, c, g, or t
  misc_feature (79)..(79): n is a, c, g, or t
acacatnacccacngccagtatatctcgaacaaagtctcagacgatactccctgaaattgtaaagcttaatacaggttntggaaatcatttaacacccgagaatgtcccatcacagtcttccgtcaaaatttagcctcacaacaacaacaacgcctacgaaattctaaattcagaaggaa

SEQ ID NO: 634642 - DNA, 356 bp, Homo sapiens
cttcgtgcagtttgcttcaaaggagatagcagaaaatgctctggggacacacaaggacagaatagggcacaggttggggattggagagtttgggattggtgttaaatttttcaatttttgggggttgtgggtcactattgcttaaatgggggggtagccatacatttttctggggtagttaaaagattataattatctaaatctaactgggaacctacagatttggggtgggaattaatgctaatagataactaaactgagattgtcccatctctctataggatgttgttgataaacgtcttagtatactacctatccctatacacactctatgtctagagcgcacgtaaactatc

SEQ ID NO: 634643 - DNA, 768 bp, Homo sapiens
  misc_feature (288)..(288): n is a, c, g, or t
  misc_feature (308)..(308): n is a, c, g, or t
  misc_feature (325)..(325): n is a, c, g, or t
  misc_feature (396)..(396): n is a, c, g, or t
  misc_feature (403)..(403): n is a, c, g, or t
  misc_feature (723)..(723): n is a, c, g, or t
catctgacttacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttgnggtttggtttggtttgattntttttttttaaagcggntaaaagagaaaacactgaaaattgaattcttatcttccagaggctacaattattataatggacaatacttntaccttngtctctaaagatcagattagttttatttggtcacttacgtgctttgattatcccctcttgattatagacccgagcttggtgttagcctaagagaagatttatgtagtattttcttctcaggtattggaccaacgtcataactaacatgttggccagaatatgaccaatggttaacatatttaatcaccattaagtgaccttatcaatattccggattagacaacaaataacctttctggggggtctcttggaaaccatacttccggttgaatggtaactttgggtgcttaaggtaaatttaaagaggtttgggtcaagtnatagtctttgaccttcaattcccacccttttcattttagcacact

SEQ ID NO: 634644 - DNA, 189 bp, Homo sapiens
  misc_feature (64)..(64): n is a, c, g, or t
  misc_feature (81)..(81): n is a, c, g, or t
  misc_feature (167)..(167): n is a, c, g, or t
tcgcaggagttacagactggcgcacctcctcctgacgccttgtaggtttcagttcatctcttgnaacaatatcgatgaganaatcaaactgatcaaattttgtaattgccatggcgatatcatttctctgtagagtccggcgcttgttatcttctgtgtgaatccanggcccgagagtagcgtaccgag

SEQ ID NO: 634645 - DNA, 329 bp, Homo sapiens
aaaagatttattggcgatggaatatggacacgaggtcattcaatggttatacctagttaatggaatacctagttaataatagtactaaaacttactgtattgcaatctttgccaagaacctgatgacggaaaccacgaggtaactggaaattcccaaatagcgcttaagaaaaatactacgagacttgacaattttttaacgtaacttcctaagtgtacgatgacaaaatttgacttacgggatattctggcgttaatattcccgtccgcctaaatgtggggcaaaaatacacagctacgttatattaagcaaatattaaccgtgccta

SEQ ID NO: 634646 - DNA, 146 bp, Homo sapiens
tctcttgtgctcctagtcattgtttgtcaccatttcctaatccagaaaatttggtcatcatattgtctactgatgtcgtggtgttgtagccaattttcttattgttagtgctgacttccttaacaatttcctcatatctcttctgg

SEQ ID NO: 634647 - DNA, 809 bp, Homo sapiens
  misc_feature (114)..(114): n is a, c, g, or t
  misc_feature (177)..(177): n is a, c, g, or t
  misc_feature (376)..(376): n is a, c, g, or t
  misc_feature (381)..(381): n is a, c, g, or t
  misc_feature (398)..(399): n is a, c, g, or t
  misc_feature (437)..(437): n is a, c, g, or t
attaaattaacaagatgcaaatcttccacctatccacttaactaagttgagcaataacactgcataaaagttcattttagtaggtgctatgcaaataaacaggacatggatcangccatgacttcctcagagatggaaagttcgcttgggctacctgccttgaaggaccgaatatgncagatattcaaaactgtcagcacccaaaggcaccggccttgataaggctatggaatggatagttgaaacattaaaaagcagacagtaattcagtccattcttccgccctgaaatgaggactacatcacctctctcccttcggaaacagccaagtcgtacttcacactactagatgtgaaaactatatgactatgcgccnagacncacttactgcaatgttnngagtaaacacgcaacctccgttttaggttgagggctanaagaccaaatcacttgaaagtgcttagtaacgaaaaacattcttcccttgcctggtcgggtagaggtacgtactcgattcgtgcccaaagctccatccaaatacaccaccattcagaccagcatactccctctcggacgataaaaaccctactttttaattcgcaatcctctactctctttgtttccattcttccctatatgctaaccagttccccctgcccctctacttctaaccatcttcccgcggattagattatagttgtcattgatctatgaacctaaaatggttaaaaaatcatcatctaatataatagatcactcccactaatatgttttctgtactagccctgggctcaagattgatcattgtg

SEQ ID NO: 634648 - DNA, 327 bp, Homo sapiens
cgatgctacatcaagattatgctctgggggcaagaataaaaaaaagagaggctaggtgtggtggctcatgcctgtaatcccagcactttgggaggacgaggagagtggatcacgaggtcaggagattgagaccatcctgacccatatggtgaaaccccgtctctactaaaaatacaaaaattagctgggcgtggtggtgcatgcctgtaatcccagctactcgggaggctgaggcaggagaatcgcttgaacccaggaggtggaggttgcagtgagctgagatagcaccacttcactccagcctgggcaaaagaacgaaactctgtc

SEQ ID NO: 634649 - DNA, 369 bp, Homo sapiens
  misc_feature (17)..(17): n is a, c, g, or t
gttgcacagcttctcanactaaacaggtactgacagtggatactgtattatttaaataaggcattcaccctgcatttatttgttacgtgtacatatgacgcttaaaattctccactacaataatgcatcataatctcacttaagatcctaatcatttcttaaaactgatgaagttactgatgttcttggtagacaaatttatttctctttaggatatgttatttttatgatacgcgggttttatgtaatcacacttcaccagtctgaaaagccacaaaccaaaaccaaaagaaagaaaagtcctgttggatgaaataatttcttgctgagcacaatcccttagtctagaactctgagtatatttttcag

SEQ ID NO: 634650 - DNA, 323 bp, Homo sapiens
tagagatagatggactttggccatgttgcccaggctggtcttgaatgcctgggctcaagcaatttgcctgccttggccttccaaagttctggggttacaggcgtgagccactgcacccgacatataaaatcatggtctatagttttcttgttcatatcataatcttaagggccagacattgcaactgtgtattctaaggctttttttaatctatggatggtcactgcttgtaataaatggggagggaattcattcttaaaggagggattattcttgcaaacaggccaaagagagggaaacagaaatctaaaattatgcgactg

SEQ ID NO: 634651 - DNA, 360 bp, Homo sapiens
  misc_feature (192)..(192): n is a, c, g, or t
  misc_feature (231)..(231): n is a, c, g, or t
  misc_feature (323)..(323): n is a, c, g, or t
ccccgactagcccgacaccggtgggtaccagcaatgaccaggtgcccatcgctgagggccctgccccccctgcgggggcctctctccctgtgactggcagctgtgaggccctggtcatcggccagggctccatcttcctgtctggggattcagtggcatgcctgggggcaaaggcttcccggtggccattgnagaccccctcttctacggccccgcctcctcggcagcagnatccagaccttcgagctcaagggcttcctcttcaaaggccggggctccctctgcagcccggttggcgtggcccagggctggggccccatctncctcaacaatggcctcgtccctgtggggaaacacacg

SEQ ID NO: 634652 - DNA, 252 bp, Homo sapiens
ttcgactgtggtgactcagagtgtccacgtcctgatggagaccaggcaggacctacccgaggctgcgccccggtgcccatgcgttttgtgatcccaagtgactctgtgggaagggtggggacgaggcgtcgggagggtatacagggagcccctcccgtgcatggttgcccccccgttacattttctccaccacaggccgctttgcacgtactagactacctgtggggtccccttttcttttaactactacta

SEQ ID NO: 634653 - DNA, 184 bp, Homo sapiens
tgataagcggatacggggttgtaggaggtctttctaaatccagaaaatctagtggtctttcactcagtggtaagtacacgaggtgctgttttcagtgccaggggtttaaagggagttgactgaataaggtcaggatctgctggtcttgaagattggctagatcttgcattatttcctgctacaa

SEQ ID NO: 634654 - DNA, 186 bp, Homo sapiens
gaacaggcccgcattaagttatctattgctaatttatcactttcacgaattattcccgcttcagttagcagtcagtaggtaccccattttggggtatttgtggcatggctattgcataggcatctagcagcagactttcccacgaaatgtgatagcttgattgacgtgccctgaagaattaagtct

SEQ ID NO: 634655 - DNA, 299 bp, Homo sapiens
aagcttggcacgaggctcacgcagaggatgccaggcagggtgaggatgggggagtagataccgcttatgcagtggctcgcactgctgtggccactcttgaccactgaggctcccagcggaaggtgttcacagtcagatcccggtccacgaagctcccttactcgaagttctccttcagcatagattacacgtgatccactttgctttcttgcttctcacctcgcccccttgaacattgcctgacaccctcatattggccagtctgtaatctcgtgactatgggactgaggctcaatctt

SEQ ID NO: 634656 - DNA, 440 bp, Homo sapiens
tatataagagactgggatgtaaagaaaatgcaagagagacacaaaaccctagagtagtgacacagttccctgcactaagcaaaaatatagaggatagcatcagactaaaatatggaatcagaaatatagaggaatgtatcacgggtacacctctaaaatcccttaagactaacaattaaattcacccaaaatttaccttgcattagtctcaggccagacacagcttacaaaatgttacgaaattaaactaccacacagttcaggcacagcgataacacacctgtaatcctggaaatatggaaggctgaggctggaccgatcactataaaggtcaggagataagagaccagaacagcttggacaacatggtgaaaaacctataactactaaaagtacaacaattagaagtgtgtgtgagtcgcacacttgtaatcccagca

SEQ ID NO: 634657 - DNA, 104 bp, Homo sapiens
catacccaggctttctctcttgagacgcggcggacgggtgaagtaactgcctaggaatctgcctggtagtggtgggataactgtcctggaaacggacgctaata

SEQ ID NO: 634658 - DNA, 133 bp, Homo sapiens
ccggatgtatgccacactatcagtatactctctatcattgaatggctctacaggtatcatatcttagttgtaatatattatctactctatagcagagatgagctactgctgaaagggctttgaatccttttca

SEQ ID NO: 634659 - DNA, 111 bp, Homo sapiens
ggccgaaaggaaagaaggccaagggaaagaaggtggctcccgccccagcttgtcgtgtaagaagcaggaggctaagaaagtggtgaatcccctgttttgaaaggctaagaa

SEQ ID NO: 634660 - DNA, 880 bp, Homo sapiens
cgtctttccgtggcgccttcatctgctgcgggggtgtatgcgttgccccaatgggttcgtttataagggaccgcgcttggcgtcgccagggctattctctcaccccggggtgccacgctatgtttttttgagcgccttttcctggagcggcattattagcctttggcctagcggaccccaacagtgttgttggttttcacgcccgcgtgcctacaaaggggggttccgcccgccgcgcagcgcctctttggggcaccgcacattgggggggtgccccgccggcctcgcagttgttttaccaaaaaaaggagagtgcccttttaaacctggcccccgaccaaaaaaagggtggtcggaaccttttacaagatgtcacccagggcggactttccggtatcatggcgacaccaaggaggcaaggcgaggcttcttgcgtataaggggccgccccccctgttcgtgtctggagaacaagagtcccacgtctattgttaacgatttatctataggcccttttcattgtaggacaattatatgagaccgggcgcgccccgctccccagcgctgttattatcccacctgcggtcggtcggcagtgttctaaacaggagtcctcgttagttataaggcgcacacttctttccgcacagcgcgcttttggggaggctccgactgcctttctttgccctggtagtatcctggtcgcaagtatgaaccaaaggggggggggtctttcgaataataacacgtgagacaaacattcttccttctttctgggctggccatccaatgaggtcccagaatccacaccaccgtggtgagctgaagagttcttgcctgtgggtttttttttaaaaaacaccccttcgaaatcataaca

SEQ ID NO: 634661 - DNA, 167 bp, Homo sapiens
cgtatttatcaccttccacccttactacacaatcaaagacgccctctgcttacttctcttccttctctcctttatgacattaacactattctcaccagtacctcctaggcgacccagactattataccctagtcaaccccttaaatacccctccctacattcatcaa

SEQ ID NO: 634662 - DNA, 268 bp, Homo sapiens
ccaagctagagtacagtggcataatctcaactcactgcaactgcaacctccacctcccggggtcaagcaattctccagcatcagcctcccaagtagctaggactacaggcgcacgtcaccacacctggataattttttttgtattttttgtagagatggggtttcgctatgttgctcagactggtctcaaactactgagctcaaagtgatcctcccacctcagcctcctaaagtagtgctgcgattacagtcatgagccatcacacct

SEQ ID NO: 634663 - DNA, 428 bp, Homo sapiens
ttccagattcaagcgattcttgtgcctcaggctcccaagtagctgggactacaggcattcgccacaatgcccagctaaatttttacatttttagtagatatggggtattaccatgttggccaggctggtcttcaactcctgacctcaagtgatccactcagcttggcatcccaaagtgctgggattatagacatgagccaccatgcccagccttgtgagtctttttgatcatagccattatagttggtatgtagaagtatcttgttaggactttggtttgcattttgttaataataattaatgatgttgaacagcttttcatgtgtttattagacagtcacatttttctttgataaaatgactattcaaatctcatactcatttttaaattgggttgtttgtcatttattgatttgtaagcattggtt

SEQ ID NO: 634664 - DNA, 433 bp, Homo sapiens
  misc_feature (6)..(6): n is a, c, g, or t
  misc_feature (9)..(9): n is a, c, g, or t
  misc_feature (38)..(38): n is a, c, g, or t
  misc_feature (42)..(42): n is a, c, g, or t
  misc_feature (45)..(45): n is a, c, g, or t
  misc_feature (60)..(60): n is a, c, g, or t
  misc_feature (71)..(71): n is a, c, g, or t
  misc_feature (107)..(107): n is a, c, g, or t
  misc_feature (112)..(112): n is a, c, g, or t
  misc_feature (186)..(186): n is a, c, g, or t
  misc_feature (197)..(197): n is a, c, g, or t
  misc_feature (206)..(206): n is a, c, g, or t
  misc_feature (297)..(297): n is a, c, g, or t
  misc_feature (332)..(332): n is a, c, g, or t
  misc_feature (337)..(337): n is a, c, g, or t
  misc_feature (339)..(339): n is a, c, g, or t
  misc_feature (342)..(342): n is a, c, g, or t
aagganggncctcagcggttctctcttaggaaatcatncagngcnaggtttttaattaangaatctcctcngatgcggctcagttcttcctggtgtgtgtatgtgtnttttnaaaactcaccaaagcttgggtttttctctcttcctctttctacttaaataccttaatattttattaggattctnaaatatccagngaaatattnaagtagtgaaatatcaagcccacgactttctaaatctcatcttcaatattatctcaaacatggctttcccggtctctctccatatctcttntcattcactagcactcactctcccaatctcctacnaagcngnggncctcgtgccaccactaactcagtaattcctgaaccccggtgatcaataactcttccaaattgggtcttggatatgtgcccaatcttacctt

SEQ ID NO: 634665 - DNA, 318 bp, Homo sapiens
  misc_feature (99)..(99): n is a, c, g, or t
ttttattggggctaacccaaacctgaatcccagaaatgtatgcttaccctacaggcatttaaaaatatgtacctgggaggccgaggctggcgggtcccnaggtcaggagatcgagatcatcctggctaacccagtgaaaccccctctttactaaaaatacagaaaaattagccgggcatggtggcgggtgcctgtagtcccagctactcgggaggcttaggcaggagaatggcgtgaacccggagggcggagcttgcagtgagctgagatcgcgcccctgccctccagcctgggtgacagagtgagactctgtttcca

SEQ ID NO: 634666 - DNA, 326 bp, Homo sapiens
  misc_feature (132)..(132): n is a, c, g, or t
gtccaattttttggccgggccccaaaaaaaaaccccccagtttgggttttggggggctaaaatttttccccccccccccccatagggggtcctttggggaaaacccggttgggggggttttcccccaaaaanttttttaaaaaaaaggggggggggagcgcccctaaaaggggggccgggggggggcctttttttttttcccggggggggtttttccgggggcccaccccccaacccgttttttctttcccagccccctctttttttttccaaaggggccccaattttttttgggccgccaaaaaaaccccctttttggggcccta

SEQ ID NO: 634667 - DNA, 304 bp, Homo sapiens
  misc_feature (5)..(5): n is a, c, g, or t
  misc_feature (51)..(51): n is a, c, g, or t
  misc_feature (68)..(68): n is a, c, g, or t
  misc_feature (107)..(107): n is a, c, g, or t
  misc_feature (132)..(132): n is a, c, g, or t
  misc_feature (185)..(185): n is a, c, g, or t
  misc_feature (250)..(250): n is a, c, g, or t
  misc_feature (260)..(260): n is a, c, g, or t
aaatntggaacaatagaaactgtacagatttgatcaatctttttggtttgnttttaaactaaaatctntaaacacaccaatgtcctattccaaaatattgcacaacnttctgaatacaaaacccttgattgnattcctccttcactgaagaaaaaagttcatgaccctgctcccgggctcctctncaggcttgcgtcaaagcccccttccatccctagggagacttgagaatctataacttactggattnagagacatcnttctggactaacagtttccattctttagaagattccaccttttg

SEQ ID NO: 634668 - DNA, 146 bp, Homo sapiens
cataaaatatccgtactataccatgtccaattctctggcttaaatgggtcactttctacatgatacatgaataacggaagataattcgggatacatagtcattcactaagcttcatggtgaaaactaagtggcaagctgtgtccgt

SEQ ID NO: 634669 - DNA, 102 bp, Homo sapiens
aagaggaagggcagagaagtaccacttcaatatataaaagaattttcttcttttcttttctttccttctttctttctttctcttttttctttctctttcttt

SEQ ID NO: 634670 - DNA, 132 bp, Homo sapiens
atgtgatcgaccaacaccattgagacacattacctgaatgagcaggtgacagccatctaagacttgggtgtaccacgttgactaaattgcgcaagatgggagcgccccgactctggcttgggggaatatctc

SEQ ID NO: 634671 - DNA, 738 bp, Homo sapiens
gattaggaggtcctcgtgctcgtagatcaaacatgcactttactagcagttctatggtggacttcttcttctcagagtcatattctccaagcatagggaagcatggatcctatagctgagctttatctcagttatcaggagtgagacgtctgcaggaggacagcttaattcctctggcccttccgcttctcagttacaacaactgcagatgcagctgcagtagaacggcagcatgcccaggcagcacggaacaattggagaccgacgcaacgcaacccgggtactaacacaagcagtgtcaccactacaatcacacaatccacagagaaaccaaatagctaatacagaaagcagtcagagactctacagaattcccagtttcttttaacaaggttgaatgatccttaaaatgtctgaaaggagcgcagtccatggaaagcgagcgtgcagaaccggaagcctgttgtgttccaaagagctccttttctgtccaatttagggggttgaagagagttcatcctcagatgaggaatgatcggggggggagatggcagatttgtggtgctaatgggctgggtagaatattatgcctttagatggttcgttttagaaaaacctaatttaaaagaagagtaataacggaaatgagctccaacactcctttttgatgacatcccaattcgcaaaatgtccttggtgctgatttgccatgaaggggcaccactattgggttgttgc

SEQ ID NO: 634672 - DNA, 277 bp, Homo sapiens
tttccaaaaaaccaaaaaaaaaaaaaaactggggcctgtgtaacccgtgggggctattttgtgaaactaatcataaactgcctaggcaaccagctacaggctttagcttttaattcatggttttaaaactaaacggaatttccccttggggctagatccccactgaaaataaccaaagattttagtttttagggccttttatccggaggaaaggtttggaaaaccaaccccgggggatttattgtttaaaccaaaaaaaagttttatttttgcttga

SEQ ID NO: 634673 - DNA, 827 bp, Homo sapiens
agcggaggtgtgaaccggccacacacaaccccaattttctgtttcaaagatttgcagtccacacttaaccaaaactttgtattcatgaagaaagttcatattaatatctagcgcaagatattcatatcacgtttcaacacacgttttctacagtaaattcagtcacacgatatccaattcgagtttattagcatcaaatttgcatgaagccagtgcataaatggaacacaaaacagttctatcaactcacacatcatatcattcttcagattttgcttattttttgcagccatttattacatttgaaagattttgtgcatattgtctcattctgaacacaatgtgagcttattctgttttatttgtattagtgaagagtgtttgctattgtaagaaatattcttttacctgtctagccaggtcacaagtttttcccatttgaggagcttcaaatttagcttgtgcatatgcagcgtgatacttagggagaaaatgtgaatcacagtgctactttttgtctttgattgaatattttggtaagcatttcttcttgtcttcaaggaaatcttgcaattaggattttctagtacaggacaatccttatcacaattctctttgtaacgtcatccaggtaacattggtcaaagaaacaagatcattagatacatcgtcttgtttatccagaaagtttcataaactgtcaacattctatagccttgttgtgcatatgtacctgaagcaattataacacattgtatccgtgacctcgtgtcttggagctcgtgcttcagacacaacttgatcacgaatatttccagtcatgtctc

SEQ ID NO: 634674 - DNA, 373 bp, Homo sapiens
  misc_feature (17)..(17): n is a, c, g, or t
  misc_feature (59)..(59): n is a, c, g, or t
  misc_feature (65)..(65): n is a, c, g, or t
  misc_feature (306)..(306): n is a, c, g, or t
  misc_feature (358)..(358): n is a, c, g, or t
actagaaattgggaggnccaaaaggcttgcccaaactttaagataccctgcttccctantacccnggttatgttggaaatttgtaccttctttgcctatatatttaaaaatattggctgggtatgatggctcatgtaatgtcagcactttgaaaggccaaggcaggaagattgcttgaggcccaggagttcaagaccagcctgggcaacatagggaaaccctgtctctaccaaaaaataaaaaattagctgagcatggtctcatgtacctgtggtcccagccactcaggaggctgaggtgggaggntcacttgagcctgaaaggtcgaggctgcagtgagccctgatggcatcactgnactccagcctgggcg

SEQ ID NO: 634675 - DNA, 107 bp, Homo sapiens
ctgtgctcccaaagcactgggattacggtgtgagccataggcctggcctagtgcaactgttttgatgttgaatatgacaagtatcttttgaaataactagtctctcc

SEQ ID NO: 634676 - DNA, 357 bp, Homo sapiens
aacttcgtggtagatggatgatggtaatggcaggacaacaatgagaatgtactttatccactgaattgcatatatcaaaatgtgtacgctggtcagttttatgtaatatactatttgacctcattgagaatcaaatagtaacttacatattcactgaagaagccaatgcttagctcttatcagacttcccagtaattactacggggtcacatgtttgttcagctttgccctgtgctgtcattcataatagatgattgaaacgtctcataaacctgttctgtatgggaaggttatcttttgttccaggcttcggaggtaaatatgcttggcccattattcagcagtctctctgtctct

SEQ ID NO: 634677 - DNA, 517 bp, Homo sapiens
tcgtagtggaggaacgggtttggcgtgtgggacacagtctgcctctgatactggtggagtcacggagtgtggccggtgctccagggacatggctggctgtgcctctgccgagtgtcaggttgctgcatggtgtgcggcggacgacggaacccggtgcgcatcgctctcaccgatgccttgctccctgccctgtccgactggaccatggcgctcgtggacggccaacatcgtaaccattgaacgtacaactaagcaggcacacacggacacgacacaccactttagccaatggttcctcattgtgcaacaccatgacggagaacacttggccatcgcaggcggctgactcgcggcaccaatgctcgaaactaaacaaacctggccgctggctccttacgaaacttggctggggccggcgcatcttcattacgtcgaacgggccttgaatcagtaaacactttcacagctgcaatttgttacgacttacttgcgcacgatttgaacgccattatttcca

SEQ ID NO: 634678 - DNA, 1100 bp, Homo sapiens
  misc_feature (1100)..(1100): n is a, c, g, or t
ggccggccagcctgaggcagctcgagcccaagtccaggcaggccccaagaagcgatgctgccggagatgcatgcccacagtatgcagctgccattgtgcgcgtggtggaacagccttaacatcgactagagctcattggacggacaggaacctgtgtcaggactgcgtgtcgatcaggtggagcttacgaaggactcgccccgtctctgtctggtgcacgactggtcctccgaggaaaaacaccgttcagtcaacaagtcacgccagctgtaggtgggtgaccgtgagtgggcacaagaccaggtcaagtggtttaacgtgaaatgggcgtgacagcttgggggccacagatgtccggatgatccggggactcaactgcgtgcagggatcggggaaactttaaggcagtggcattctatcgttaccaaagagctaaccgtctgggggcccccaacctttcaattgtcgacttgttcacgcaagactggacaagtaacgctaggtccgtgctggactgggacaaagaacggtgtccaccggcgggctggagtcataggaagaaaactgtcatgaattgggccatcgcaggctttcggcgttccccagatactgacctcgtagtgaccccttcgccttcagcggttcaccaacagatttgcaagcacccattttctttccgcaatacgaaccagaggaaaaaccaattcaaatcgttcaaggggccaattaagcacgcagttaccccattacttggcttggcaaaataccaacattgggagctggatgaggccaagcggacgataaattggacacaaggaataaaacgtacagcaagttaaagccaaagtaaatcaccggtaccacgttggatggatggaattagggaagaaacggttaatagagtcgcagcagaaagagaaggattttataagtatatagccgtgagaaattataaaggagagaggacatccttctaaggatatttacaaataataggacaaacagaagaaacagtatacaaagaaatagatatgagtagtgaggagacgtcgatcagtatcgagaccagtagtaatgagaggaaatttagtagtaaaagn

SEQ ID NO: 634679 - DNA, 714 bp, Homo sapiens
ctgttttggtgtttcacagagttaaagaatattgggcgccttttaataaggggtaaaatataaaaaaaggcaattttttggtataataatcaaatgttgaaatccttttattttggtggaccagtgggtaatatcatgattagtgtgccacagtttattgtgcataatatgaaaacaattatgccacccttcattcgggccaggttaaaactgctttataccacttcttccgtcaaaggaacaaggtggttccaacaaggcgtgaggctgcacagggcgctctaacaatgggcccagctacccatcattacgctcagcagagaccgttgtcagggaatcccgcacagatgctgatgcactggctaattttgtagtattgaacgtaaaggtgcacagtgtcttgctgttattttatgatggaaactgattttgaaaccaaaaatagctaactacctttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaactgatgacttgagttcaagtgggatgagcaagaagatgtgttatcttgttgttcaccagtattgagtgtgaaggaaattttgatgaaaaaataaaattccacagcgcctgttataaa

SEQ ID NO: 634680 - DNA, 270 bp, Homo sapiens
gcggccgcctactactactaaattcgcggccgcgtcgaccacttttgtttaagtctaatcactaacttccctttcttattcattgtagttacggcagtcccagtcctactgcacagacacagagtgtcttcaggaatgtaagtaccactgagacaggaggaaggatggcattgggggcagaattagaggccagatgcctgtgaatatttgtcagaatttattcttacattgcctattctagtggttaccagaaaaaaaaaaaagtcgacg

SEQ ID NO: 634681 - DNA, 253 bp, Homo sapiens
tagcatctcctgctctgactactcttctgctgacatctgtcacttctaatgacccttctgatatacactggggccacccagatactccaggataatcccctcatctctaggtcattaatttaatcacatctgcaaagtcccttttgccatgtaaggtgacatattcacaggtccaggggattaggacctggccatcttaggggggccattattctggctaccaaatgcacaaaacattttcgatgctggacga

SEQ ID NO: 634682 - DNA, 910 bp, Homo sapiens
gcacagacgcattagcagactcacctgtcctgtttcatccctcgccctccacaatttcttattttctttctttctctttttatttttgagacagagtttcactcttgttacccaggctggagtgcaaggatgcgatcttggttcaccgaaacctccgcctcccgggttcaagcgattctcctgctgcagcctctcggtagctgggattacaggcatgtgccaccatgcccggctaatgttttgtatttttagtagagacggggtttctccatgttggtcaggctggtctggaactcctgacctcaggtgatccacctgcctcggctcccaaagtgccgggattacaggtatgagccactggcccagcccacaatatcttattttcatgttttttgtgtgttagtttatttttcgagatggagtctctctgttgcccaagctggagtgcaatggcgcgatcttggtcacttcctgggttcaagcgattctcctgcttagcctcccaagtaactgggattgcaggcacccgcatcatgccctgctaaatttgtactttgtagagatgggggttcaccatgttggtcaggctgatcttgaactgtgaactcaggtgatctggccaacctggagctacccaaaggtgcctgggataccggttgtgaagccaacatggctggactccgtgtgctgcaggatctcaaattaagtggggagcccacgacacactttttctaattagaggaaaagccccacgctttggaaaggtacactcctccgagtgcagcggggccctctgggggaggacaggcggccagcatccgggcaggaagaaaaagaggaggggagcgcgcaacataaaacacataagacgacacatcgaaccagagtaagacgaccacgcacaaaatat

SEQ ID NO: 634683 - DNA, 377 bp, Homo sapiens
tccatagtttgaaaccttgccttagaaacagagacaggggctgggtgcggtagctcacacctgtaatcctcagcctccaaagtgtgggattacaggcgtgagccaccgcacccggccaaaacatgatctttctaataattatggtccacttttgtttaagtctaatcactaacttccctttcttattcattgtagttacggcagtcccagtcctactgcacagacacagagtgtcttcaggaatgtaagtaccactgagacaggaggaaggatggcattgggggcagaattagaggccagatgcctgtgaatatttgtcagaatttattcttacattgcctattctagtggttaccagaaaaaaaaaaaagtcgacg

SEQ ID NO: 634684 - DNA, 408 bp, Homo sapiens
  misc_feature (406)..(406): n is a, c, g, or t
tctcttccacatactgacttgctttcttttggatatatacccaatagtgggatggctgggtcatatgggtagttctatttgtagcttttttaaggaacctctatactgttttccataatggttgtactaatttacattcccaccaacaatgtgtgagttttctttttcccacatcctcaccagtaagttttttgtctttttgataatagccattctaactagggtgaaatggtatctcattgtggttttgatttgcaagcaaatcacaatttaggataacagcattcaggtttagagaatattttaactatgacatgggatatgtgtaaataaaacattctatttaaaacatattggatgcttcaggtcattaaatctgtcccctgtaggatcagttatggagggntg

SEQ ID NO: 634685 - DNA, 85 bp, Homo sapiens
cagctgcaagaggaggcccacctcaacacctcctttaagcactttattttctttgttcaggagtttaatctgattgataggcgtg

SEQ ID NO: 634686 - DNA, 147 bp, Homo sapiens
  misc_feature (37)..(37): n is a, c, g, or t
cagtcggggcagggacatttttaaggctcttgtttantttgctgacatgccttccagagaagggggcctttatcttctgtttctgtgcacccgtgaattactgttttttataggcggtaaaaaagacgactgcttggattacaagga

SEQ ID NO: 634687 - DNA, 148 bp, Homo sapiens
agatctacgggtgcatgcatgtgccagaggaggagaactgtttaacacctagccaacaatccgggaaatcatcaaccaacagaggaagaggctgaatcacctggtggatagtcttcaagcagctccgcctttaacaaacagacttcct

SEQ ID NO: 634688 - DNA, 454 bp, Homo sapiens
  misc_feature (303)..(303): n is a, c, g, or t
  misc_feature (349)..(349): n is a, c, g, or t
  misc_feature (428)..(428): n is a, c, g, or t
ggtaatccacccacctcggcctcccaaagtgctgggattacaggtgtgagacaccaccccctgcctgaagaatctcttgtttgtaaatttattctcaggatttgtcctgattcccatagttaggtggaatagtggctaactgggatattctataaacagagaatctaaatgcttttcatattaaatggtcaaaaaaaaaaatcagctgggcatggacaactgtaatcccagctactcaggaggctgaggtaggaggattgcttgagccccgggaggtggaggttgcaatgagctgagattgcnccagtgcactgcagccttgagcgacagagggagaccctgtctcacnaaacaaaaaacagaactacacaaaaaaagaaaaactccaaaactttagctttgagttacaagggtcctatagcacccanactccttcttccttgccggggcccca

SEQ ID NO: 634689 - DNA, 401 bp, Homo sapiens
cgtggaaagcacaccccccgtgcctggcgagggggacaggccttccagttatagttggatattctggcggactcctcactgattgcgatatgcaagagaaccttcaaccatagtcattaaacacctctgtaatcacgcaccttgcgttagcaatttgaaaagccactgacaagttctgatttcattggaaaaaacggcacccatggtgagtaagtgccgctcggcaagttagccgatagaaatgttaaccgagctcactgtccttgatgttagcgaccgggccgaggatagagggatcgaaatcaaccagcgaatcaccatgggcgaaacggttagggaagtccgggttcgccaacgcgcctttacccagcgcgatgatatctgcgccatctttgatgacg

SEQ ID NO: 634690 - DNA, 1104 bp, Homo sapiens
gggaagaggcctgctggacccgttcccgtatgccatgcggacaccggccgtcattcagagcccctcgcctggcgctaaatttaaaaacgtaacacgagcagcaggttggatctcggaaaccgaaacgaaattcggtccctgggccctcctcccgggcgcatcccggatccctcagcgcgccgagcaacccggaacagaccccttctcccgccaatttacggccggggactggcaagcaacttgaggaccctgcggcagccctgaagacctgcggagggacccacgtgaaagcaggccgggcacggccaatggcaccgcatggcagatgcaactggagacgaaacgggcgaatggcacgcccgggaaaacaacggtgtatcccatggctttccaggaactagttaacacacgaattggttcagcaagaggcatgcacaatcatgggggctacaatgtcgcagctacacaccagggcatacaccccctggtccaagggagaccggacaccaatccaacctctggttcaccacttcatggagccataacaaggcagcttgttctcgcccctcacaccgtttgttccacgcgcgaaaagacagccaacacctagagctcattctcacattccactacagctcccaccccccgggaagggatctccctacaatagttggccccaacctggcgcgcccaccctacaaacagagggcaccacccagtacgcaccaataagcgccgaaacggacggcgcaggcacccagcccctggaccacagtaggagcaggaacaaccgggagcccacaaggccccttggaggagcaacaaccggcacccgcaagccccacaaccatgcgaccgagaaacggcaaccaacacaaccacccactattcagacacgcaaaacacaacaacgcgcgcccaggggactacagggccgaaagagcacagggcagcaatcaggacagaagggccaacgtgccaacctccgcaccccgcgaccaccggcgcgaaccaccgccacagaagctcacagcaccacgcagcgcacacgcacaaaaccgatgacgagacacacacagtagaatattaccgagcccctccccc

SEQ ID NO: 634691 - DNA, 413 bp, Homo sapiens
atcccaaaagtatgctggggctatttgaaatggaaatgtaaggttcccaggaaccctgaagtgtgatctaaatttgtgatctgaaagtgtgatctagaggtggagtgtagcccccaagtgggcaagtgcagccttctttttgttgtaaaaacacagctagagaaaatgtttagtgaaaatttttatagtgtagggcacaatgtgtcttcttgcccaagcctaaaatcattactgccccagaccatcacccaggaatgaagaaagccatgagtcttcagattgagaaggcccattaagtaattgtcaacaaggataactaaaagcaatctgcacataaatatatcacagaaaaagtcacataacaataaaagaaaatataaacttcagaagaaaaaataaattttattacctaa

SEQ ID NO: 634692 - DNA, 127 bp, Homo sapiens
tgaatgagaagaaagacattacattccgaaatacaactcttctagacataacctcaagacctagaaacattttatacatttatgtttagtattcctctatctatacaaacttcagcttgtcgaaatg

SEQ ID NO: 634693 - DNA, 640 bp, Homo sapiens
  misc_feature (190)..(190): n is a, c, g, or t
  misc_feature (236)..(236): n is a, c, g, or t
  misc_feature (289)..(289): n is a, c, g, or t
  misc_feature (310)..(310): n is a, c, g, or t
  misc_feature (357)..(357): n is a, c, g, or t
  misc_feature (439)..(439): n is a, c, g, or t
gatgttatcttaaaaggggcgacgcgggccagttattctcaggtttgccccagaacccttttttctaagccccactataaaaggtatgattcaacaaacaacgcaccatgagtgaaatctgcgagagctacagctcctgccttgcagcccttaactgctaacaatatttttgtacggcgggtgggtcacnccatcccaaccctatcattgaaatattctccaacttggtccagggnggccgcctctgtccacggtcacccaggatgccataagcaccccccccccgcanccactctcgtaagacttcccngccccctcccaagccctaagagatttctatctctttcactgtctccncctcccccgacccgcttccccattacgtcccccacccgaaacctcccttgctctgccccctttcattacccctccctttatnacctcccctcttttcccctctgtggctctctctccaccccatcccctctcctctcccccacccccccccgttaccctcccctactcactctccctctctccccccttccatccccttcccctttacttcacccccctcctccttcctttttctccgtagtgcatccctctccttcttcttttctttctcttctacctccta

SEQ ID NO: 634694 - DNA, 1584 bp, Homo sapiens
  misc_feature (561)..(561): n is a, c, g, or t
ctcgtggtgtgttgtgtgtgtcgggaagggggtttcctttaatctatatactcagaatctggccacaatagaacggggactttccgtgtcgtatttataacgagagtcgtagaagaaccgcgcgggtttcacatgagaattgtttcccgtgctcatcaattgtaggggatgttgaatactgtgtcgcactaagtttttcctccaatactcttggccgttgggaatgttttcctatcggggaggactacccgtttctctccaatctgtaagtggcgatgaaatgtaattctaatctctcccggtggcgtatatccgccgtgaacgattcctcacgaaatggctacgtcgcttttcctccggagtgaaaaactcgtttccgctattgaccgttcacacgcttagtgggtggtgctgtcgtgggtcctcatagggcagaatttccccgtcggatacgttttataagatgcccacaaatgttgctggttgccaaaagcactatgtgccgagtgtggggatcctcgaatctcaaaaggcgctgttatggttggacgcactcccacncttctcaaggggagccgcgccttactactttcttaaacgggattttgaatcccatataccgcttaatcttaatcggtactaataccacgagaggggtgctacgttgggctaagtcctctactagctagaataatagggacctatctggtgggagccttggcgggtttagatcccgtcctgctgttggcttccgccgcaatatgctttttgctcctgcttggggcgtatatatataatgccgggttcccgatccgtcccacctcggacgggtatacaccggccccggggatccacggaacgattggagagttcgcccagcggagcgtccgcctcccacttgcgcgtggtcgcagacagcacacagtcgccgtgacctcatgctcggacagctgtaagagagctctcaggggcacgcaatggcgggcgcgatggctcactgcgctcgtatgcgtgcctcagagtcttctggagacgagcgagatacggacaaagagcactattgacaagtgtgtcccttgcttgttcttataagggtccgttagctccattgtgcaagggaggtcacatgtgttgtgctccgtcgcgggaatcaaagagcgtatcttctcagttcaaaggttgccagcgctctggacgcaccgaaggaaactatcagtagcatctctcgcagacgtcgtgtcacaagtcgtgcgtccactccagtgacagaacagagtctcctgtgatccgttactctgaacgtagccacgagccaaacacagagcacaagacatgatcgaggctgaccactatgtttctgataccatgagctgttggaacaaggcacgcttcaggccagaacgagctgagcaaaagtcacctctccgtctagcgcagagcgtgcagcttgtgatcctaagaagtaagctatcatatccgggctgtgcccctatggggtggaaggggcaggaatctgcgagctgctagttgcattatctccttacgctaaatttcattgtgttgatttattaacgggccccataa

SEQ ID NO: 634695 - DNA, 253 bp, Homo sapiens
atgctgaggtactctaagatcccgcgcagaggctgagcgcgaggaaatcatcagtgctggtcgcctccttgatgtgacagagcgcgcatcttgcgcaggctctccagcagccggtgtggttttcgattgttggccacacttgtcggtaaatagccctcggaggtcaagccgcactgggtgatgtagtccacacaggggtacacgatcaccgggatatccgaagtcccccaaaagctggcttgttcccggagaa

SEQ ID NO: 634696 - DNA, 421 bp, Homo sapiens
gataaaaacatagtctcaaatcaatcaactcaacctctatggaaaagaaaaaactagaggaagaagaagttaaaccaacagcaagtagaagaaaagaaataatgattaaagacgaacgaattcaaagtaatagaaaacagaaaaaataatagatgaatttaataaggttacatcctactaaatatttaaacaggaaataatactaaccctacaaaagctctttcagaaaacggaagcagaaagaacgttttttttcaatgtgtcctgtgaggtcagcattacccagacacaaaaaccggagaaagacattgtaagtaatgaacacaacagacctaaaattctcatgaatgtagatgcaaaaaattctaaatataattttagcaaattgaatccagcaatatataaaaagaataatatagcc

SEQ ID NO: 634697 - DNA, 461 bp, Homo sapiens
  misc_feature (46)..(46): n is a, c, g, or t
  misc_feature (82)..(83): n is a, c, g, or t
ggggaaaggggcctattccggggcctggaaaaccccttcccccctnggggggcctctttgggaaacctggaaaatttttccnnaaaaaaaagggccctggttgggccccctttccctgcccaaggggggggcccccccccttcaaaggcccttcccgggggggggcccccccacccaagttcccccaaaatttgggggggaagggcccggcctggtcccccccggtttgggggccccctttttttttaaaaaaccccgggccctggggggactttaaaggcccccgtccccccctggggcccccccccccccccccgtccctgggggggggggggggggtaaaaaagaccccccccccccctttccccaaaaaagggggggggggcccccgggttcccttgggggttcaaaaaccaggaaaggttgggggcccggtttttccctttttaaaggggggaagg

SEQ ID NO: 634698 - DNA, 1481 bp, Homo sapiens
gggagtaggaatgcggccgcgatgtcttttgtgtcctacaagcatgccggcggcgccgccgagtgaggggacgcggttgcggtggggcggctgcgtgccgaggagtgcggcggagtgaggggccgccgcggtccccggctcactccggcactcctgggccgctctggcccccatgcctgccctgatctgctgcatgctggtgtcccaggtgaccagcgccatgtccagacaggtggtgggcatttgagcctctctacatcaaggcagagccggcagccctgacagtccaaagggttcctcggagacagagacctgagcctccatgtggccctggcccctggtccagctcccacatcgcttgctcccaggccacaaggaagaggaggatggggagggggctgggctggtgagcaagggcggatgggaagcttggtgctcgagctacacatggacaaggcactcatgggcgtggataatgtggaaggacgataggagcagtaatgagtttaacaagtgatggttgatgggatcactgtgaggcctgaatagaagactttctttcaagagtgaacaatccaaggggagcatcagagtagaggattgtctggaacttccaaagaggtgtagagatttaagccaagaggaaggaacggcaaagtgagccttgagcaagtggcccttgacacaggattatcacaccaaaagtagacacatgcagagaattgcgagcagattgatcacaaaggaagtggaagttagctagcctggacacctgactggtacacgaagagattgggcacgcgaatgataggataacaacgagcaagtgctctggagcagggaaggtgagaaccaccaaatagcaacctatccctcagtgacaccactttacctcatagacttggcggcaccatgggaaagacaagaatggaagaggagcacccaggcaaaaggaaaaagaagggcacccaagagagaaagcgaagggcatgcatacaaaatagaaggagatggtaggagaccatgacaaaaggacgaatagcagaaggcatagaacacacggaggacacagagggaaacaacaccataacagagagataaccgaaaaggataaccaaatgaccgagagaagcaagggtacaacaaaaaggggacaaagaggacaacacacggagataaaaaggagaggacgagaagaataggacaacaaaagtaagaacagggcgcaaagagcggtacagacgaggacacacagaaagagataagagacggacagagccaagcaaaagaggagagaagagggcaagaagtagagaagcacgagagagaaaagaggcgagcaggagaaacagcaggtgagacaggaggacaagaagaagaaaagagagaacgaacaagcagcaaagcgagcagaaaaggcacaagagagacacagcgaggagcgaggaagaggggaggagaagcggaacgagaagcaacaa

SEQ ID NO: 634699 - DNA, 951 bp, Homo sapiens
aggactcgtgaagtgccatctgtcccgtcgaccggcgcgtgatgtgcgcactagtgttactcagggtgggtgccatgcagcgtgagtaccgtagtagtacctgccggtgcaactgtagcattactgacgttggcggttgcacctataatgacggtcgtcggatgaaggatgaacagaaatgaatgcattgatgtcatggaatatcgatcactggccaatagctggcagagcagctatagctgaggacaatcgtgttgagcgaatgaaggtatcgctgccctgcgcagtcagaatgatcgcagaggtggtgctcgaatgggtacaggatgcacgagagaatagcaatggaacagatatataggttgcttgccttcatgccatgtaagagaaaagttgagtgcgggtaaagaaccaaattattcatcgtgggataatctcggaatgggaagggtagaacgttatacgttttggggacgaatttcccaaaatgggcgaggccaaggtgggattcgcgaaattttttatatcggtatgggccttttaaaagaggttgcagcgcgcatattgtgtttggagacagggcagaagcggacgtgttctccaaaccaattaaatacgggggagcggaaatgggccattggaatgttacataataggccaaagattctcggaaaaagccaattattgggttcaaaactcaaagagcggattacattatggaggagtggctcagggcatcaggagttgtgggatgggaatatataggggtccataagtggacttttaagagctttttttaaagggataggaacataggaggattccgttaagggaatggttctttgggccaccaaatagaatggacactccaatgtttagaggagacttgtggcccacaaaaggcaaaacccaaacatattggacttttgtagttgggaacagatagggtca

SEQ ID NO: 634700 - DNA, 201 bp, Homo sapiens
tctacctggtattcactatgcacgggcaggcattgctgaagccggtgccccagtgtgcgatgtggggattgtgaccgggtgagcgtgaacagggcgtgaggtgcgcgtagcgggtggccgtgtgaccgtgcccggccctcagaagaggaagcagctgctccgtggggtgggccactgtggtcctgccgtgggtcccaatgt

SEQ ID NO: 634701 - DNA, 327 bp, Homo sapiens
cactccacggagtagcgaaggtcctagggtggcgtggcccttggggctttgtgctgccttgtgccctatggcttatgggttcagaactctggatcttgtccattgtcctcgtgtgtctatctcagtgtaaacctcttctcagaccagttttctaaacatatattgaggaaacataaggcgattggtttggcttaaggtatcccatgtgtattgattagtgtattctgtacttcagacatcagtgaaagcttgctttgactaattgctttgtgagctgtaatgaatagcatgtaaattactggcattatggcttgggcaagacctttt

SEQ ID NO: 634702 - DNA, 467 bp, Homo sapiens
agtttcggcactagtatatatatatatatatatatatatatatttatatatatatagagagtgatatttatatagagatatattttccccctgtttgttttcccctttatctttttctctttctttctttttcttctttctctttttcttttttttccttttttttcttttttttttttcttcttattttcttctctctttctttttttttttttttttttttttttttttctttttttttttttttattctctttctttttctttttttttctttcttcttctttttttttttcttttttttttttttttctctttttttttctttctttttttcttttttttctttttttttctttcttcttttcttttttttcttttttttctcttttttcttttttttttcttttttttttcttttctttttttttttttttttttttttttttttttttttttttttcttct

SEQ ID NO: 634703 - DNA, 625 bp, Homo sapiens
gacagggacggatctaagcctgtcccacgtaatggtatataaaccctccccaccgaatgcgaagtggcatctccactgtctggtgttcatcttaacatagagtatccctgccctgtaccaacaagtgttgcagccaacacgacagtgtgctatagacgacctgtgcgcaagatgcaaacaatgactgtgcatagaatgaattccagtattgcctctccgaagatcgtgccgagatgtatcagcacatcacctagtgactaactcatgacatgtgcaggtcctgtgcctacagcagtggagctcttgttagacagggtgatacacttcaggtaagtaaaccatatctggatgagccaacgagcccgcatgcatggctgtcatatatggacgacacaaaccagtatctattcaaaggagactgccgacagcgaggtgacagatgacagatggaacaaacactaccttgcggccaagaatgaactacatggtattaaggcaacataaaactgactcaaggccggtgaaaccgacgactatgagaccattaaaatgactcaactcctgaggtgaaaactatacagaaccaaacgtgagcggaacacgcgaggggcagcgacacctgaca

SEQ ID NO: 634704 - DNA, 714 bp, Homo sapiens
ctctatgactcatgcctgatttcacagcgctctgggagaccaaggctaggatggcattcgagtccaagcgtttgacaacggcctggccgacacgttgaaacgcgatcattactatcaaatccatgactttgacagaagtctagttcatcgcctgtattcccatacactctgtgactgacgcagtaggtcatgattagtcctgtgaagcagtaggatgcggagcgccatgatgacgccattaccagtccaggctagtgcaccagtaacagggtccatactaggctacaaagattacaacggccgtgatgatcttggcctcggcatatccacgtcacacgagcatggccaagacgtagacagattatgctgcgcaaagatatactgaggtcagcaagctcgagactctgactgtccagacatattgaaagcagtgtgactacttaacctacaagggtgtagctgctgtgccattatgtgcttgtagcccaattacttgccaaagtagggcaagatactcactcgtacccatgtatcagaggttgagtgaaccaagatctaacatcggtctcaaccttgtcgcatagcgagacccccctcgacatattctcaggactacttctataacatgcctaacgcctgaaaccaacctgtttctaaccccatttcattttctcaagctcacgtccgcgttaagtggccaattggcctttggcg

SEQ ID NO: 634705 - DNA, 135 bp, Homo sapiens
tatgctatgacttggctgctgtgggtgagatcagtatgatggggtcggtggactggtgaaaacctgtcggtagtgtaggaagctgaataatttatgaaggagaggggtcaggtttgattcgggaggatcctattg

SEQ ID NO: 634706 - DNA, 786 bp, Homo sapiens
aacagcaaaaaaaaaaaaaaaaaaaaaattcaaaataaaaggcttctacttttcaggggcccctttgaaaaaggggaaaggacaccccaaaaatgggggcaaaacaaatttattgggtgaaatcttcactattattggggtaaggggacattaatatacctaagaataatatttaaggggacactccggtatggctcggaaaaacaataagggacaacaccattttaaacatggggcgcacaaggggcatttaaaatatagaactatttcctctaatatggaagtatttcacaatggggcgcgcggaaaaacgccacttgtggtggtaaggagccaacttcaaacacctctcaaatatccagaggctcatattatatggccaatatcaggagggggcttacacaaagagacaggagacaatccccaatatttttccacacccacctattattagagcatagggcacgacaatttagaggcaccctagagggaactcttaaaaacaccttacacgggggaaaaaaaacacagtgtggcatataatatagagcgagacaaaatcttcaaatggttgacaacagcgagggaagtgtgtggaagaacactttgtggaaaaaaccttttacattggcgagtggaatgggggtggcacaaatgtgttaatcaggtggggtgtattagcccagtggtggtgaaaaaacaagagtttggggcaagagtttccctaaaatataaggttttaaacaaaaaagggaattttcccattttgttacccaaagtaaggtc

SEQ ID NO: 634707 - DNA, 134 bp, Homo sapiens
cggtacccgtttgagtaagggatcgaacctagtgaatctggctcagtcctcctcctccatctctttcttgatccagtccacgtagttgagcactttggtgtagaagccatagcccctgctcccaggacacgatg

SEQ ID NO: 634708 - DNA, 228 bp, Homo sapiens
  misc_feature (25)..(25): n is a, c, g, or t
tctcgaagaccagaatgacattggnccaacagaggtgggaagattaagtgaagaaaagataccaaagacacacaggggaacgcgtgggaaatctgtttgggttttggggtaattggggtctgccccataacatttccttggaagtattttggggccccctataattattttttttcctggctaactgtagaaaagtttcctgattaacctttaaccccgttattttta

SEQ ID NO: 634709 - DNA, 880 bp, Homo sapiens
acacgagttgagatctccttgagatggtatgaaatcggcatgtagtatcgttgagatcatagttgccccctgtggcgtagacttatcaaagacttgatttgcagttgctcatcacagtgatgagagcagtttgaatcgtgatgtgccggtctggacttggtagaagtggaattgggaatgccataatcttctcgacatgaataggtgtgacccgtaaagcattggcgctatctagtgtatactaactacttgagtatggttcaagcacaatctccattgtcatatgtttacaccataatatcgcagtgtgccgaactgtaaactgccttaacagtccgaaaagacgtatgagggaacatttgtcgtacgagacctgtgcggaagtatcgttcacagttactgaagatacctctgcgcgtacaaaccaccggaaatctaggttagcattaatagtgccaatttttgcttgtttgagaagcttgtttggaccaacctatttggcggacactgtcaaagttgctcaacaatgccctagggttcaaaggtggtttggaaaaggtccaccccggttggcgcaattgttcacatggccttttgagaaaacgggctatgcttggtatgaggagtaccttgtgactggcaatccttacccaacaaaactttggtcgcatctttgattaaaaccctttgtgctttgaatacacccgggattgtgctacgaaacactttggtggcactggtacctggtccgtgttagcccgtgttgaggatttgttgtcataaaccgcggaatgcgtaaacacgtttgtccaagttgacgtactcacgtttgtctcagcctgttaaattcgctttccgcttaaaggaaccctctgggaaa

SEQ ID NO: 634710 - DNA, 168 bp, Homo sapiens
aggttatgtgaaaaaagccagtcacagaagaccacatattgtattatatcatttacataaaatgtctagaataagcagatctatagagaaagagagttgattcgtgtttgctttgggctggggaaagaggagggggtttgtgtgggggccttgtacttcgggggaccg

SEQ ID NO: 634711 - DNA, 512 bp, Homo sapiens
gcggagtagcttctcggctctaggttctggagtgccgggagcagtgaggtgccggacccgggggacgaggaacacggtgccgtaggggagggccgggtgcgctcggggtgtctgggccggggtctgagggatgaggaggggccgtggtcggcgacggggccaggaagcgagttctggaagacggcaggcgagagaaagctccctgggctagtatcacagtcgacgtgtatggtgccccagcacaccctccctttgaatccgaatctgttacatggtcactttggtcaggtccgacggccaagatgcgcgagcagactgagtgaagcgtcaagagggtcggcgaccttcccgaggagttcgagagcaattaccagctgatgcctgggacggcgtaggggaggactgacgatgagctcctggaccagtggggcggctggagtagcctgaatgtccgcaggtgggtcaatggagacgcgcaagcgcgtgtgctgcgtaaccacagccagcggcag

SEQ ID NO: 634712 - DNA, 765 bp, Homo sapiens
gagatatcatagatgagtatgatcgggaagttcagaaaactaaaagttgatttgttacagccactccaactatagaatcattgagaatttagtcatttatggataaattaaaatgaacaccgtggactcttgttaaaatcgaggaaagtccaagaccgaaagataggcacttcccattcaccattctgttgttaaagcagttagaaattgaggtgccctggtatatccacatagcctaaattgagtacacccttgaaccagagcccctcagttaatggggtgaccgacatggggtagctgatcccagggggcattcccctctctgagctaggccctgcactgggtggcctggggattgtagcttccttgcacagtggtgcacatttctatgtgtggatgagatttacttgtcaacttttcctgccaagacactaaatgcttttcagtgctaatactgacctgatagtagagatttctttccctgagtcggatggtagcaggatttacttggtaacccgtagggtttaaaataccggtttacaatgtctgtgtaaagagttcttgagttgattaaggaaataagatcaataggcggagggaaattgtctctatcatgcgacttattcaaataattccaagttaacaaccctgccctgggcataaaccgtgaatggaagtacatgactgacgtaacagtaatctaattcttcagccctgatcgttgtatcggggacttgtatatgctttcttgactgacaatagaag

SEQ ID NO: 634713 - DNA, 275 bp, Homo sapiens
  misc_feature (150)..(150): n is a, c, g, or t
aggacgagatagggactgagcctgcccgtcggactgcccccagaaagcctcctgccccctgcctggtgaagtccttcagtgagcccctccccagccagcccttccctggccccgccggatgtataaatgtaaaaatgaaggaattacatntttatattttaacgaacaagccgggaagcggaaacacaggttattatttttttcaattccccaacaattgcctcgttgaccaaggcaattgtggggaaaaccaggccaagggtttgggacttgcc

SEQ ID NO: 634714 - DNA, 166 bp, Homo sapiens
gccactccacctggctgctcccaggtcacccagagcacctagaaggggggatgctagtagcgcgccccacgctacactccagagcatgtgccccaacagaggagggtgctggagccctcacatgcttggctcagcacaccacacctaagactcagcgcagcccgag

SEQ ID NO: 634715 - DNA, 279 bp, Homo sapiens
tcggtaaatcccttaagactttcttacctctgtatttcccaaatgggcaccatatatatcatacgctgtctgtgtacataattaatttcctgaaataacattctaatctagtacatatttcatttgttattttccagaatataaagtgaaatttggcctttaaagtctcctcactgagaaggtttgggcttccttggcgcgctattgtgtgagcatgttcagtctagaccaatccatcccctgttctctcagcactacttgggtactacgctttggcat

SEQ ID NO: 634716 - DNA, 356 bp, Homo sapiens
  misc_feature (8)..(8): n is a, c, g, or t
  misc_feature (15)..(15): n is a, c, g, or t
  misc_feature (92)..(92): n is a, c, g, or t
  misc_feature (128)..(128): n is a, c, g, or t
cttgattnggggatngatacattggtacggttctgggccttgcgttacttcttccgatttttcccttggggtgggctgtcggcatgctcagnggcctgccggcacttgggaggggcggcatgtgcagngtgtttactgaagttgtgcacatactcactagagacattcctcccttaccagtcttgttcctagaggaagctcatataccagttctctaccattttgcctcttagtgagcatgtttgagcccactctccctcttgtccacaagctgctgatcaccagattctagtgttttccatctattgggagaatgcctttccctgacgccggttgagacgtgattattttagatg

SEQ ID NO: 634717 - DNA, 191 bp, Homo sapiens
  misc_feature (185)..(185): n is a, c, g, or t
gcagaggacccgtactgggtgtaccgtctcactatcagcacccctactagtctaaccacatgactcctcccccttatactaatagctagccaatctcacctatcaaaagaaacacaacccgaaaaaaactatatattaccatactaatcctcactacacactattccataatatataaccttcanccgcca

SEQ ID NO: 634718 - DNA, 488 bp, Homo sapiens
tacagagtgaatgtccacttgatgcgaggcatggaggtgatcgcgacctacctcagcggccttgagagcgccgaaaaaaaccccactcagtaggttttttcgcttttgcccttgatccttaggtgatgtagcaactttcttatcagggattgttgctccatcagaaaaaacaaagaaccaaatcataattagagccgactcagcgcgcagcaaaatcccacgtatagctgggcaatcaccacacacataaatatcgggaaaaacatctaatacatttgtataccggttcaaacattcaaccagcttattatcttttcccagcaagacacacctttccatccactgcgtctgcctagtgcaagggcctcgccgtgcgcgtgagcgcgctcaagttactctcgcactcacaactataatatttcaacactgcttttagagcactcgcaacaactcataggcgtcaaccatgtacccacattcactctgta

SEQ ID NO: 634719 - DNA, 339 bp, Homo sapiens
ggtcgacaatagaactagtagacagaaattactagtggtatagaatgcttgaaggtggtctgggcgttgtagctcatgcctgtaatcccagcactttgggaggcctaggcaggtggatcacttgaggtcaggagttctagaccagcctggacaacatggtgaaacccctctttactaaaaatacaaaaattagttgggtgtggtagcacgtggttgtagtcccagctactagggaagctgaggcacgagaattgcttgaacccaggaggtggagactgcagtgagccaagattgtgccactgcactccagccttggtgacaggggtgaaactctgtctc

SEQ ID NO: 634720 - DNA, 330 bp, Homo sapiens
tcaggaaactaactggggggggactctggataactagacggagttttctgagcctattaaaagaagcagcagtagtagtagttgaggggtagtattagtagtggcactgctatccggtgagcacttactacaccagcagaaggcctcatcagcgccctgaaagttatcccagatttacagatgacgacgagaagtctcagagaggtagaaatttacctgctgtgcacagctgctcagcaagtagccagggccaagtgctgcaagagaattcttttcaccatatccattgtcatgaaaccccccagatcacttagtttttctttgcctaga

SEQ ID NO: 634721 - DNA, 475 bp, Homo sapiens
aggggcaaagttagagtggggaactgattgcagctataacaaattattaactgggaacaagactaaatccggtgggcatggtagctcctggctgtaatcccagcatgttaggaggctgaagtgaaaggatcacttgaactcctgggctcaagatatcgtccctgcttgttctcttcaagtgccgagattacaggcatgagctaccatgcctggctgaaaatttatgatgccagatcaaattgcccttctttctgtattgagacttcatataacatccctctccaagaaaaataaattttgtacaaacatacacacacgcacaaacacacacgcctaaacagctgttgattcttaggataatggattcatcactgcgacgacagagttccatggtccagctggccgcgaacgctggcccaggcaggttccagcttcgtttcaaccctggcttccctggtgctgtctcttctgcacc

SEQ ID NO: 634722 - DNA, 135 bp, Homo sapiens
gcctttcgcgacgtggaagccgtcgatgaagaccgctgataccgttctcgacgtcgatcggttggcgcgtgcagcagttaacctgggtcgtcatctcaccttggtccgtgtccggggtggactccatgatgtggt

SEQ ID NO: 634723 - DNA, 167 bp, Homo sapiens
ggtagagacagggtttcgccatgttggccaggctggtctcgaactcctgacctcaggtgatctgcctgccttgccctcccaaagtgctgggattactgtggcgagccactgtatccggccacaaataccttttaaatatatgaaagactcaacctcatccataataa

SEQ ID NO: 634724 - DNA, 347 bp, Homo sapiens
ggctccctcaaaagaaactttcaaaattgaaaagcagctagacatgatgggtcccccctgtaatcccagcccttcaggaggctgggaggattgcttgagcccaggggttcgagaccagcctgggcaacatagtgagaccctgcctttacaaaaaaatgttttttgaatcagccaggcatgggggggcccgcttggggtcccagctactcaagggggtgagatgagggggtcccttgggcctgggggactgggggtgcaatgagctggggtcccccccttcccctccggtttgggcaacggggcaagcccctttttcaaaaataaaacggaccccaaactgaaaagca

SEQ ID NO: 634725 - DNA, 556 bp, Homo sapiens
ggacagaacgaggggacgtaacggagggcaggttggagccgctgcgtcgcatgacccgcgttaaccagcgtgagctcgcccgcagaagattatgaaaaagcagagggatcggtaagggaaagcgccgagatgacgggtttctgtgccgcccgaagcagagggcactcggagatcatgcagcagaagcagaaaaggggcaaacgagaagaaggaggaacccaagtagtcttgtgtggcttcgtgtcaaaccttcttgccctttcgctctgtgttgcctgagccagtcccaccacgctcgcgtccctcctgtaggtgctcacaggtccagcaccgatggattcctcttttgcccctgagtctgcacgcgcgtcccttcttgtgtgcttccttccccttcaggtagccttctctccccctggggccactcccgggggggtgacgggggttacccctttcccagtgttatttatcccgtgtgggggctcaccccaaaagtattaaaaaggtagggtttgcgaaaaaaaccacccacatcatcaaaatacacaaaacgtgt

SEQ ID NO: 634726 - DNA, 106 bp, Homo sapiens
ccccccccccccccccttttttaaccagtgtttcttgggcccgggaaatttttccgtttttggtatttttaaacctttaaattaattgggaaaggggggaacttta

SEQ ID NO: 634727 - DNA, 1268 bp, Homo sapiens
aatcaaacctgcagtagtagttggtactaacgttgttaaattatgctacactatttagagatcattgcaaactcaacacaattgtaagtaatgatacagagggatcttgtgtacccttcacccagacctcccccaatggcaacatcttgcaaaactacaatgtagtctcataaccaggatattgacattgatacagtgaagatacaggacattctcatcaccacagggatccccaggatgcccactatccatccaacccaagaccccagacgtgtccctaaacacactggaaaacaggaatccaattctcacattatactatacactgttgtacataatcaagaactgtctatacacactggaccatcatatacgatatgtaaaccaagtactacgaagctcaaacaaaaaaaatgatatcaccatgacctttcactaggcggaaacacatacaaaatgcacaaatagcacacacaacaaaacaaaaaaaagaaaaaaagcacaacaaaacacagacaacacagaaaaacacaaagcaacacacacccgcacacaaaaaaaaaaaaaacacctaacaaagaaacagggcaagcgagaggggagacagggagaaaggagaagagcagggaaggagaagaagaggagggagggaggggggggaagagagggaggggcccgcggaagaggaaggagaggggacgcgaggacaggaggcgagcaaagtaaagataaggacacaaaagagagaaaagacaaatactggaaagagaagagcgaagcgtaaaagccatacaaaagaagacgagacagagcgaaaagagacgagaagaagatagacaagaggaaacctctataaaataaatcacacaagaaggagcatgaaagaacaagggcaaggagcacgagaggaacgagaggacaacagaagacgaggagagcagcgagggggcagaaggaggaacgacgaaggacgcgaaaagagagcaggaggagaggcgaggaggaacgacgaagaaagggaggcgcgcaggatgagcaggcgcaaccgacgtgcggcaggaaaaaggaccagcgaatcaggacgccaggacgcgtgacagcagctaagaacagacgaacgaacaatagcgacagaggaccacaggaagagagcgcaagcgccagacacacagctcgagggggagcaaagacaacgagcggagagacaagaaagacgatacagaagagagaactgaagagggcctagaacagtgacgacgcgaggacaa

SEQ ID NO: 634728 - DNA, 432 bp, Homo sapiens
gggtgggtagcacagtccagtgcttcggagatacaacgagaaggatcctcagtcgtgatgccaagatggtaaaggctgccgaggagtgcaagcccacgcccgaagatcagaaggccttcgaggactataagtgtgcgaagtcggttgattcgccaggtgataagccactcgtgacctgtgatcgtgaacgcaccatgaaatatttgtagtccccggtcgccattaccggcacccaggtcgtcagtgctgattcaggcatcccgcaggggcagttgtcctacgtggttaacttgaaattcaattccattggcaccacctcgttcagtgacgctacgacatacctgtgttctaagattgagcccacagaatcagtttgcggtcgtcctcgattggtcagttatctcttccccgcagctcaacgggcaggggatc

SEQ ID NO: 634729 - DNA, 283 bp, Homo sapiens
gttcctcccaggccccggggcccctttgccttgccccaagcacaaagttacctaaggggttgacctttgcccccctggagctcccctcccgggggcctttggcctacccttttccctgccagctgaaaagactgccggcagcctggacgtcctggttagctgaaggcagcttaaatgtgggcccccctatgtggggtttaggactgaattatgggtttggggttttgcttctttttgtagacccccaaatatttttttttgaatagtaaaaagctgggcccca

SEQ ID NO: 634730 - DNA, 864 bp, Homo sapiens
agtttgtcagaggcaatacgcatgttttgcccgcgagtgccaatggaccagtggccgagttcaaaggttctgtccctgccacggtaatgtgcctctgatgattgcttccgaggttgaaagagactttcctgaggcgctcgaggagccgttggatcgatccccattttctgtgagggatgcctccggaacatggtagagtagattcgatacgagcgcctagtgatcgtaactaggcgggatccatggaggccggtggagattccactaacggttgctcataagactcgcgaaaaccctcggcccgtgaagtaatttgtgctttcgagttcaaaagtccaagcgccgcatgagatggaggattacaataatcaatggttaggttccgtggtggtgtggaccgaggtacccgagactgtacaaggatgatttctttcagacagtactcatgagagggctgtgggaccatttgtcgcttggcacactgatctcctgggaccttcgaggaccgtgaggtcagaaagactgttgagatgtcggagacctatggtagaagtggacacgactgcactgggcaactctatgtgcttaaatgctagtcctggatagcatttgaggtaccagggatcttagagggtggcggcctaggctatgtgtatgcttgaagttggattcccgacttcgagagaccggattgttgttcccaagagtgcattatcataaagatttgagagatgaatggactgtacccctcattctaggatacgtatggggtgacgccactgattccaggttacccaggggggtctgcccgatctaaaggcccagccaaatcttttgcagaggctccctggacattactactct

SEQ ID NO: 634731 - DNA, 634 bp, Homo sapiens
  misc_feature (26)..(26): n is a, c, g, or t
  misc_feature (105)..(106): n is a, c, g, or t
cacggggtccaatcacctagacagtnaaagatgagcatttgagctaccactgaatctagcgctatcccaaacagactactgtcctctcagcaaattaagtactcnnaagtacttaacaggaagtacttaatagaaatgtgaaactaccagtcaagttaaaagaaaaaaattaaggcacccagctcaggtaagtgcatttttcacgtagttttcaacctagccagtgttccagaaacaatttcaacactctcctgaggatactcacctgaaacagcctcaagtttagcatccctctaagagcttcagtaaataacgtccttgcaagggatctatataacatgtttttcttacatagaaggaaaacaagatcacacagataaacttggtaacaccaaaaataattaaagctctgtggatatttatctggcattagtatcctcctcaaagacacactacaaatgaactatcatggtctcatctctgaaaaatgataagtcttaaattctgctcatatatttcaaagccactccctaaaacctagataggccggcgttgtggctcacgcctgtaatcccagcactttgggaggccgaggaggcagatcacgaggtcaggagatcgaaccatcctggta

SEQ ID NO: 634732 - DNA, 92 bp, Homo sapiens
gacttcacgaactacacaggtcttaccattgacctaagatcaatctgaacattcttagcccagtcagggagctctgcttcctagaaaggcat

SEQ ID NO: 634733 - DNA, 381 bp, Homo sapiens
  misc_feature (107)..(107): n is a, c, g, or t
  misc_feature (135)..(135): n is a, c, g, or t
tgtgaaagcacaccttctcggcattgcccgggccgtgggcgctgaagttcaacgaatcaccgccacgggcgtagtacatgtagatatggccaccatccagaaacaangccttacgcttttctgtgtagccgagtnaggcgtggctgcctttttcggccacgtaataggcttcggtttcaataattcgcgccgaaagccagagatcgcccacacgatgacgaatgacttttccgagtaattcacgcgcaagcagttgggcatcgcggtcgaagaagctatcgggcagcgggctggcggggaacagtgggggaaagtcgggcatggcggtcaagggttgatacggctaaatgtgaccgaatcataacaactctcaccttaatt

SEQ ID NO: 634734 - DNA, 641 bp, Homo sapiens
  misc_feature (13)..(13): n is a, c, g, or t
  misc_feature (63)..(63): n is a, c, g, or t
  misc_feature (79)..(79): n is a, c, g, or t
  misc_feature (107)..(107): n is a, c, g, or t
  misc_feature (112)..(112): n is a, c, g, or t
  misc_feature (133)..(134): n is a, c, g, or t
  misc_feature (239)..(239): n is a, c, g, or t
  misc_feature (254)..(254): n is a, c, g, or t
  misc_feature (305)..(305): n is a, c, g, or t
  misc_feature (416)..(416): n is a, c, g, or t
  misc_feature (521)..(521): n is a, c, g, or t
  misc_feature (530)..(530): n is a, c, g, or t
  misc_feature (632)..(632): n is a, c, g, or t
caatcacaaacanaccaaaataaaacaaacaaaaaaaacataaacaaaacaaaaacaaaatcncaaggggcctgaaaanattggcaaaaaaatatccaaacctcacncatcnaaatacaaatagcaacaaaannaaaaacctcaacacaataaaaccactaaaaaaataaaaaaacctcaaaaacataaaccttttcaattacaaagaaaccaaccaaaacaactaccgaaaaaatatntacaaacacctcccncaactcacatatctcgacggcaatagaccggaacagacaaggaggcccctnactcggatgctgagggctacgtggagggcctggatgatgaggaggaggatgaggatgaggaggagtatgatgaagatgctcaggtagtggaagacgaggaggacgaggatnaggaggaggaaggtgaagaggaggacgttagttgagaggaggaggaggatgaagaaggttataacgatggagaggtagatgacgaggaagatgaagaagagcttngtgaagaanaaaggggtcagaagcgaaaacgagaaccttaagatgagggagaagatgatgactaagttgaataactatttttaaaattcctattttgattttacttttttnccatatccc

SEQ ID NO: 634735 - DNA, 903 bp, Homo sapiens
ccttgttcacgcgttggtttgccggttgtgaaaacgtctctccaagaagaaccgtcgtgggtaagacttggccgttgggcgttcgacttgggtttttgccaaggcatccccccttggtgttataagctcccctgtcggccccctaactcctcgggtgtccccctttggtacagcggggggagcccccatctggttaacacaccgggattgtcgagcccgcctctaaacaatggtggtgttactataacgctctttggtgaatctttccgcgcgcccactgtgtactccctcggtttgccgctgggatagtttttctctacacgagggtgttaacaccgtatatgccttcctatctcccccccccattcttctccctcgatctccacttgccaaacaacaagtttttatacaccaaatgcaattaactaggctactctttctcccctccatgtcttacaacgtgacgaagatcacaccatgtctcaaagagctagagaacatttttccaatgagaatatcctgtagattcaattccccccaaaagcgcggaaacccctcaccacccctccttcaagagacactctggcgcccctttttattctctctatgctatcatagatgcgtcttagggggcaccatcaatggtgtattgctctttgtgaaattctccccccccatatggcccagcaagtttccccgatgccccacatgttatctcttgaggacagtaaggcagctggaatcgagatgaggaggttgcactcccttagaagcatgtaaaccacacggcgacctccccgtttatgcggcgattggcgaatacatcttgtgtgtgcagcaaacggagataaataaaaactttggggttttttcaacttaaaatttcaaacgccacacaaaaca

SEQ ID NO: 634736 - DNA, 626 bp, Homo sapiens
tttcccactttgccgagtctcttctcaggttggcgaaatatgaggcccatggtgatgtcatcacctttaaaggcaactcagagcacgtgggtctttcagccacgcgccgatagcggaactcgccttcgtggtacatcatagatgctgaacacgtctctccatcagctttgtagaacagttccttccttgtgttctcagggttgatctttgacttccacaggcccttagagtatatggtgttacccagcaccagaacagtgagctcattgatggcttccgagggaatgacatcggtgattcggccttccttagagtccaggggctggagcttggctccatataccaactcactgatgtcgtggtaggtctcattgaagtgtaagggatttgtctccaaaaaggcgattggttgatactaacttgagaggatttgttggcttttcgatagagtcgccagttcagtttgccaaagaagaagtgtatctgatcagatgttttctcagatatggtgtcaaacttaaatacctccatcagttgttgagagggtgtcatcacaggcacacagtttgtgtcatagcaaaagctgtggatatactcaggggtcacaggaaaatgatatcagtgtc

SEQ ID NO: 634737 - DNA, 108 bp, Homo sapiens
gtcattctccctgcccattaaggaatcagagatcattgtcatcatcctgtggcctgcatctctcaaggatgaggttttgaacgattatgccacgtgcagaacgcagac

SEQ ID NO: 634738 - DNA, 104 bp, Homo sapiens
aggagtattacaccctgaggggagtcatagtaccccgacgagtaccattcaggagtcaacaactctagtgtacaccaacgtcctaggtccagaacagcctgcgc

SEQ ID NO: 634739 - DNA, 219 bp, Homo sapiens
cgcccaccggcgggcgtgggtctgggttacaggaacccggtctgcttcatgattatcttatacttgggtggagatatctgggtaaaggaaaacgcagtcatatgtcaacaccgagcgctgcacagactctggggaatgaatggggtgtgcggcgtccctcatcccctcaggtgagggccttcacgacgatggcatattcacctggggccgacaacggct

SEQ ID NO: 634740 - DNA, 357 bp, Homo sapiens
  misc_feature (75)..(75): n is a, c, g, or t
  misc_feature (180)..(180): n is a, c, g, or t
  misc_feature (203)..(203): n is a, c, g, or t
  misc_feature (227)..(227): n is a, c, g, or t
  misc_feature (276)..(276): n is a, c, g, or t
  misc_feature (285)..(285): n is a, c, g, or t
taagtcaccccatcatttatgcctcaccttcctcatctgtaaaaatgtgaggagagccaggcaccgtggcgcacnctggtagtcccagcatactcaggaggccgaggcgggaggatcgcttgagcctgggagttaaaggctgcaatgagctatgattgcaccactgcactccagcctggncaacagagtgaaaactcatctcntaaaaaaaaaaatcaggcccgggncgggcacaagtggctcacgcctgtaatccagcactttgggaggccgagnaggcagatnacgaggtcaagagatcgagaccatcctggccaacatggtgacgacctcatctctactaaaaatacaaaaatt

SEQ ID NO: 634741 - DNA, 717 bp, Homo sapiens
accgggtcctagtgtagatatgtcgaccacgcttcgcttgaagtaatctcttggtagtacttggtcactctatgggtgctgctataggctacatcctcagtggatatgtccatcaggaggactgacaaatggtagtgggcgatatatctctgacagcaccatggagcagaagcgaaatatcgaagtgcttcaagcgtttccagatctatgtagctccagtcagccagtcttttctccttcccggctatcggtataataggtctgatattatgccttctggccgcagtagattattggaagatttcagaaacaaccgcttcccaaaccttcagcttagagacttgattggacatatagttgagttatctcaagaccagcatggttctagattcatacagcaaaaactagagagagctactccagctgagcgacagcatggtcttccaatgaaattctgcaagcagcctatcaattacatgactgagtggtaaaggcaacgtatgtcataacagaagtgttcctgagtaaggagagtctggatcaaaaataagccctggctactcgtattacgtggacatagttctacccttagccttgcgatgtatggctcgccgcgttactcacgaaagcattagaatctatatcctttctggacagcagagtgacatggtaaaggcgctggatggacatgtgctcaaatgtgtgcaagctccgaag

SEQ ID NO: 634742 - DNA, 927 bp, Homo sapiens
agcgggcgaacattttgacgggtttggcttgcccggcgtggattactgagtgtcccctatgctcgactcgcttttatctctctcccccttctccgagctcgttcccttactactcgcctactactctacctactataactatctttactactatttgctttacctactatactgtaaagactatttctataaacctatatacctacctatatataccttggtagaccaccactgcgactatttctgcagtactactactactactacgcccattactagacactacagatcaacgtcaacatgtacacatcgccgtgaaggcactcatacaaagcagcaaggggactcaccaaaaagagaatacacggaacagaaaagaggacgagacgacaacgccggcgggtcacaccgagagaaagaagcagagaagagggagagacaacccgagaagggaaaaccacagaaatatgcagagagcagccacgcatgaaagacaccgtaagcgggagacacgcagagacacggcaacacacaagcacgaaacaaaccgacagggggacaacagagcgacgcgcggtagcccacgcagtgaaaacagcacacacgagaacgacaccccgaagaaccacaacctgatagcagaaaaacggaaaacaagagcgcaaaccaaggcagcagacgacgcagccaaaaaacaaagaagaagaacgcaaaaggacgcaaaagaccaccaaacgaaaacaggaacacaaccgtaacacaagaaggagatgacgacaagacacacaaccgagacacaacaacaagacgcagaatagcgatgagaaacacagaacaaaacacagagagaaaacaaagacgaaaagaaaaacaaagaaggcgcaaaagacgaacgcacaggagaaaacacaaaagagagaacaaaaa

SEQ ID NO: 634743 - DNA, 120 bp, Homo sapiens
cgttaacatagtctgatgacagcacactcaatgccatgttttcttcgcctatatctgctctgaaatcaagctgtgtctgtctagccaggggcctagagaacataggaaaatagagtttat

SEQ ID NO: 634744 - DNA, 303 bp, Homo sapiens
  misc_feature (270)..(270): n is a, c, g, or t
tgaaaaattttggatttcacatttttggatttggatgcacaatctatatctcacttttttgcctgatctgaactattagacacctacaccagcttcctataagacagtgagctggcttttcatgtcccaagaagtagcaaggctgtaaatatgactaaacaggttacatgaatttagataaatatcattaatccaaagtagtcaataagtagttgttgggttttgcattgcccaccccctccaataaataaatagttttaaaatagattnccaacatcttgtcttgcagttttcaaaaatatt

SEQ ID NO: 634745 - DNA, 399 bp, Homo sapiens
taacagattgcatatatctctaattcgtctctaataaaagtaagtgctaaaaaaaagaaaaaaaagtaactgctatttaaatttatcttaacatttccatatagtaaagattcatttgtactaaaaattggcaaacagaggattgttgtgtcactgagtatcaaaggcaagtctatattaacatatgttaaaagtaaacatgttgtaagataagatgagatatagaaactaggaaacactgatcccaaaagtttaattccatgaagtggtggtcatctggctgaatatagtgaaagggacatcagaacagatgcataagactcaagaattaaaatgggggcagatacatgttaaggcgatcttttagttccaaaacatgttagcagtcaaggactgagg

SEQ ID NO: 634746 - DNA, 349 bp, Homo sapiens
gcctcggccccgttgacgatcctcagactcaagaacatgcaaggaaacaggatcagacagcgtttctttgcattaatactaactttctatctcagccagaaccgttaattctccttagttcctgcatgccgtggtggtcacgctgcaaggagattcatagtgtcactgggccaactctaaatgtccccaacgatgtataaagcacagccagatagcatggtaacttgcagcattcggatttgctttaattgccttgaggaataaagcttcagattccttgtatttctgggatttccccagcacgtttgccaacgagaacatgagagagtgatcattaggtattaattcc

SEQ ID NO: 634747 - DNA, 944 bp, Homo sapiens
  misc_feature (172)..(172): n is a, c, g, or t
  misc_feature (176)..(176): n is a, c, g, or t
  misc_feature (196)..(197): n is a, c, g, or t
  misc_feature (201)..(201): n is a, c, g, or t
  misc_feature (244)..(244): n is a, c, g, or t
  misc_feature (581)..(581): n is a, c, g, or t
  misc_feature (583)..(583): n is a, c, g, or t
  misc_feature (611)..(611): n is a, c, g, or t
  misc_feature (726)..(726): n is a, c, g, or t
  misc_feature (746)..(746): n is a, c, g, or t
  misc_feature (748)..(748): n is a, c, g, or t
  misc_feature (769)..(769): n is a, c, g, or t
cctggtacgcccccgggattacgggatcttcaagcgccggcggacgcagcagtccggacccaggcgcgcccctcccgccccagaccaccccggactgaccgcccgtgagggcgaacatgccgcgctccttcctgcgtgaaatactgcactccagccacagggtcccaactancggnggctggagacgcagagaganntcantggtgcctgctctgcctgtggggggctggtggtgcccctcctnccccgagacaaggaggccccttctgtgcccggtgaccttccccagccctgggaccgctcctcggccgtcgcctgcatctccctgcccctcctgccacggatcgaggaagctctgggggcctctgggctggacgccttggaagtcagcgaggtcgaccctcgggccagccgggccgccattgtacccctcaaagacagcctgaaccacctcaacctgcccccactgctggtgctgcccacacggtggtccccgaccttgggcccagaccggcacggggctccggaaaaactgcttggggctgagcggatgccccgagccccgggcggctttgagtgcntncactgcacaaaccctaccacacgctggncgggctggccaggcaccggcagctgcactgccacctgcaggtggggcgtgtcttcacctgcaagtactgcgacaaggagtacaccagcctgggtgccctcaagatgcacatccgnactcacacgctgccctgcancntgcaagatctgtggcaaggcnttctccaggcctggttactgcagggccatgtccgaaccacacaggggagaagccctatgcctgctcgcactgcagcagggcctttgccgaccgtccaaccttcgggcccatctgcaaacgcactcagacgcaagaagtaccggtgccgggctgaccaagacttttcccgatgtca

SEQ ID NO: 634748 - DNA, 106 bp, Homo sapiens
attgttgttcctttaacagatggggtgtggggctatagtactcagattatgccctaaaataacgtgtatacaaacgccctgaagtattgctgtggatgatgatacg

SEQ ID NO: 634749 - DNA, 333 bp, Homo sapiens
cgaaaacctactgtactagattgaaagatttacatttgcagaggaaaatggacctttccttgggactagaatgaacagaatagatgctctaatagatctgccggggtgttgaaaagaaaggcagaaatggggttcctctgtactagtggaaagggacaaaaacattgagtgtgaggcggtggggaaggcctgtaaggttggaatacgacgacgggaaaggagggtcagtgaccacggcaccgctgagtagaactaagggcctcccctgagactggcggtcattgttgtgtaagagctccttttctgtcggatggatttccttcagcagtgctg

SEQ ID NO: 634750 - DNA, 170 bp, Homo sapiens
aagcgttaactacagatcaacgacagataactaatgtacacctgacacagatattatgcttttcagtctgctgcgggtccaggcagcttacagactcccaggagagtgccatacaccagttgcaactggaggctgtactcgctggccttcgcgggcatttacttcagcac

SEQ ID NO: 634751 - DNA, 232 bp, Homo sapiens
tgcactgtctacctcagaattaagaagtatggtaatccttacctgtatacagtgcagagccttctcagcaatcacagaatatttacgagatttcctattatgtgaatttttaagctgcaaatctgatggccttaatctcctttttgacactgacagttttgtacaaagaaatcatgtccatacactattgtcgcacgcatgggaagtctaagaggtgctttatcgacactac

SEQ ID NO: 634752 - DNA, 133 bp, Homo sapiens
  misc_feature (80)..(80): n is a, c, g, or t
  misc_feature (96)..(96): n is a, c, g, or t
gtaaaaataagtgtttattaacaaatgggctcagagtagaaaatgcagacagatgggttcactttaccataattcggtancatcatgttattgcgnacagcactgtaggcttgtaaacgaaaccaaaggctgg

SEQ ID NO: 634753 - DNA, 108 bp, Homo sapiens
  misc_feature (41)..(41): n is a, c, g, or t
tgggtggctgtttactgactggatttcttacccttttaagnaaggaatccccctctaaaatgaagattgttctatatccagttggtgttggtattaggagatctgcac

SEQ ID NO: 634754 - DNA, 253 bp, Homo sapiens
ctgtggtgtaccgtcacacttgaagttatagcacccttttattattctaaaactgaaatgcatagattgaaacctgcctatgttgagttttgcgtctttttttttttaatgggccacaaccacggcatatggaggttcccaggctagggatcgaagtgggagctgtagccaccggtctacactacagccacagcaatgtgaaatccaagccaaagtcttcgacctacaccatggttaccgagctcgaacttcg

SEQ ID NO: 634755 - DNA, 298 bp, Homo sapiens
ttaccacagcccatttcaaacactatttttttacatcacctcccactcgggcactggccgctctcaaatctgtgtattggagggcttcggcgctggaaaatttctcttgcagttatgcttacatcctaaccacagtttttagctatgttgcctattattataaatagcaatcatttatatagataaaatttgtacttaatgtaagattgagattatcaaaagtgctcaatataaaaagtatatggatacacatacagtacatacatgtacacaaacacatacacatatatacagtcta

SEQ ID NO: 634756 - DNA, 208 bp, Homo sapiens
atttttttggcaaaaggggggggggggtttttccccggggggggggggaaaatttttttgcccaaaggggtttttcggggttgggaatgggaaaattgggttttttttccggatttttttccaggggggggaaaaagggtttttttttaatggggttctttccccggggggttttcggggggaaaaagggtttttttcccctttccca

SEQ ID NO: 634757 - DNA, 168 bp, Homo sapiens
agaggatcccgatagctgagaggcacgaagcacctggctcattctactatcaacattactaataagtggctcctttaacctctccaccctatatcacaagcagcaagaacacctcgtcaagctatcatcatgccctcgtcaagctagcatgcagggtaccgagactcg

SEQ ID NO: 634758 - DNA, 86 bp, Homo sapiens
ggacccaaaaatggggggttgccccttttggcccccgggttccccgaaatttacccccaataaaaaacaggcctttccccggcgga

SEQ ID NO: 634759 - DNA, 1240 bp, Homo sapiens
gcagctgtttctggtaactgctttgccgcccgtgctcccgcagtgaggatgctggtgtgtgtgagtgtggctgaactgtgcctgctccctgtgtgttgtgggatgcctgagggctggtgcatgtgccctcctgtggagctgcctggtgtgttggggtggcctgcactggtaggtgctgcccatgcccctgctggtgcccctgccagaactctgcgcctggtgcctccctgctgcttgctgattgccctgaagatggctgctggctcttgtgcctgagatctggctgcctgtgactcttggtcagctgcccctgctgtccatggactctctgtgcaccacatgccatgtgcccttgacattcctttcaatgctgccagcaatgatgtgagagcttccagtgatgcagagctgccttggcagctgagtgcccgggaggaccctgtcgtcagtgagctccttggatgaatgattcactggcagtggccaggcttgctaaggaagcagaaaactagaacaggcttcagggggccatgctcaatgccaggattgcctgtgctcgagccatggcttgccaaaagaggatgagaccagtgatggccaggcttcgggagaagcagtgaggaacgcttggccctcgtcttcccaagcaggacctcaaatggggtaggccccttgcccagatctgctctcctttgtccagcttggcactggcaggcctcgaccgggtcaaggcaggcccttggattggtgtgtccagtctaaaagattggccccaccgcagggccgcccttgcccaaagagggtaggctaagagtatcttacttagaaccttgttggaagctagggttcttccctcagtggcggcttggaaagttccggagttagcattccctgggccaatccttgtgcccccttccggattccgggccaataattcgccaatggctggccccttgtagaaacatccctctacagagcctgtgttcttgttggggcgcttgaaccacggttaagagccgtgctcacgttcaaccgagcagagtgatggttgttataccccctaatgggtagcgcgtaggacccaacacaagtggagttgttgttgtgagcgctcttgtccgcctctgtaggaagagccaagagagggagagagcagaaaaagcattccagagaggggggtaagccagaagcaccgtttctattactctttaacgtttttgaagcagatcgaagtgagaaa

SEQ ID NO: 634760 - DNA, 153 bp, Homo sapiens
cgccggttgaacttctcaactcgtccggcggtgtcacatcttggccttgcctgtatagaacgggtggctggccgaggtgatgtcgacgtcgatgacggggtaagtattgccgtcctgccacttgatctcggtggaactggtgaccgttgacct

SEQ ID NO: 634761 - DNA, 316 bp, Homo sapiens
atgctgtcctagagaacctcctcctcaaccagcctgggcaacagcgagactccatctcaaaaaaaaaaaaaaaacaaagataaaaagaatgtagcggccgggcgcggtggctcacgcttgtaatcccagcactttgggaggccaaagcgggcgattcacggggtcagaagatcaagaccatcctggctaacacagtgaaaccctgtccccactaaaaatacaaaaaattggccgggcatggtggtgggcacctgtagtcccagctactcgggaggctaaggcaggagaatggcgtgaacccataaggtccgtctca

SEQ ID NO: 634762 - DNA, 316 bp, Homo sapiens
ggaggcagtgaatcgagctcggtaccatctcgtgacggcgattatcactagtcttacaggttttgggataggcggtggagttagggacaatgttttgcgggcagggatggatctcacaaagtacattctcaagggtggggagaatgacaaagaaccttcttaagggtgggggagattgcaaagtacattgatcagctagggtgggacagaaacaaatcacaatggtggaatgtcatcagttaaggctcttttcacttattttgtggatcttcagttgcttcaggccatctggatgtataatcgccggtcacgagat

SEQ ID NO: 634763 - DNA, 194 bp, Homo sapiens
gtgtagtgtctagaggatcccttttttctgcacgctggcagtgtggcaagggacacgctgatggaccgtaggaagaaggcactgatccgactactagaaacgctgcgtggccttctttcgtggaggaggaggagcatttcctgcaggaggctgagcaaggagcgaggggctccgctgagtgacgagctgggctg

SEQ ID NO: 634764 - DNA, 281 bp, Homo sapiens
gtcatgagccggagttatgaaactactagaagaaagcattggaaaaatgccctaagacattggcctgggctgggtgcggtggctcaggtctgtaatcccagcactttgggaggccaaggtgggcaggtcacgaggtcaggagatcgagaccatcctggctaacacggtgaaaccccatctgtattaaaaatacaaaaaagtagctgggcgtggtggcgggcacctgtattcccagctactggggaggctgagccaggagaatggcatgaacccaggaggcg

SEQ ID NO: 634765 - DNA, 215 bp, Homo sapiens
acccacagtgttgggattacgggcatgagccaccatgcctggcccacctcagatctttaagagggattcacatacacctgaggatagatgcggggaaactgccaattcacggaaaaaggctttcctcttttttttcaacataccataatgacttcttacttgatttcatctcatctcagatgtgtgaggttcagggagacagggtgtgagtgagg

SEQ ID NO: 634766 - DNA, 198 bp, Homo sapiens
gtattggagtaaggacttcaggcccagaagggtgtggagtatggggacagaaatggacagacatataagaggggcggggcccgggagcttatagtggctaaagggagcagacacacacgcccaggttattcaagaatcgctggagttggtcccagcaccccctttctacttctcggcctcggtcattctagggtggtg

SEQ ID NO: 634767 - DNA, 701 bp, Homo sapiens
  misc_feature (621)..(621): n is a, c, g, or t
gtgcgtctgcggctgatcgcggagctggccctgccgcgtgcgcgccctgctgggagcaacctgaacatgtgcctgcgcgactcccagatctacgcggtggactacgagaccttgactgcggcctgttctctggacgcctggctgcctggtcctgggcctggtgcctgactgtgctgcctgctgatgagcctgcctcttgcagctgctcggcctgcctccctgctcttcgtgcctgggcctgcctggtcacgcgcaagtcctggcttgtggcagcacgacgagccgtgctactggctgcctcactgctgggtgctggcccgactacacgtgtgcagaacttggaccacgtggaatggcctggtggcatcctgaccttcaaagggaagactgagagcgaggcgctgggagatcgaacacgtcatgtaccatgactggcggctggtgcccaagcacgatggaggaggccttcaccgtgttcacgcctggcgccggaagacatgcctggcctccgtgccgtacccgcctctcctccggggccatgattatcgcagaacgacagaaaaatggagacacaagcaccgaggagcccatgctgaatgtgcagaggatacgcatggaacnctgggattaccctgcaaaacaggaagacaaaggaaggcgcaaggcacccccatctaaatgccggactgtcggctatcggg

SEQ ID NO: 634768 - DNA, 834 bp, Homo sapiens
gattcaatgtcctgctatcaagactggtgggccttgagcgtggagatcgctaaccgaacatcatacttggtgggtcaagttgttaccctatcatgaccagggcactgcccacgtgggctgcatctttcctaccccagttctacctgcgcggaggccaggaccatctggtaaaaacctgggccgaggtatacacagcccgctcgttaagctcaacagctatgtgcctgtcactgctacactggaccctcgttgaggacttccttagtggtttccaggtggtgttgctcaccaagaccctgcctgtgaggaccagcatgctgagtggctgagtactgtcaattcatcgtggcatcaaactggtggtggcagagcactgcggggcctgttgggcagggtccttctgtgacttccggagaggaaatgctcctcatcagattccacttggggagcagtcacctcagtgctatggtttctatggttaccaaggaccacccccggtgttggttacctgcctgtactgaaggacccgacgatggggtactaagacgaggcgggggactattgtgctcctctttcagaagtcccaggggcatggtgaggaatggtcaaccggaagagtcagcccagtggcaggatcaacagctcctgcgtccttataccttttagacatctgtgacagtctccgccattctccgattagattcgtggaggcaatcgtcgagtcagggtcgagacgtacctacagacgattctgctttaaactccttgggtggtcctcacagtcgggagcctgaccttgtgtgccggacttgcgccaaggttgttgccctgcta

SEQ ID NO: 634769 - DNA, 1109 bp, Homo sapiens
ggagaagctaggggtgaggaagccctggggcgctgtcgccgctttccttaaccacaaatcaggtcggacaggagagggatggggtgggggacagtggggtgggcattcagactgacagcactttgctatctagcagccggggctcccgatggcggctacgaatagttccggccactctctgccgcttggtgttgggcgaagccaggaccgtgccgcgccaccgatcaggatatggagctagctgtcgccgaccggctccgcggacgtagatcctgacgggcgcaccggaaggactctctcgtgcctcctttgaccaaaatcggacgatgtatctagtgacgagccggtggtttacgattcccctggaaccttgcgctatctttctgaaagaccgtggagcctctggggccttgagtgcaacagctgggcgtcgctcgcttgaaaaccgcggaaagagcacgtcggcactttgccctgcgggcggtgtgcatcccggaccccgtggcgcacgtgaggacgtagcagtgtgtcgcgcgcccagcggtgcagcaccaggcgggaccgcgtgcataatgtgggcctgcaaggcgtgcaagcgcaagaacatcagggccgaccggcggcaaggccggacgaccgatgcagcgagctggagccagcttgagcaaagtaaagtgaggccttaggatgacagtcaagcagctgcactgtcgagcgaatcagaccaagcggtagccaaggtgggagatcttgcgaaaggcatccgaaaatcgagggcctgcaggtctgctgagcgaccaggaggcgaagacctgcgcggagcgctctataggcggggcgtgcccgggccggaggggcaaaaaggggactacaggccaacacgggccaaaggcctgagacgaggacacagggcccgaaaggtgcgggggggagcgctcaaagggcaaaaaacggagcaagacaacagcgataaagggagggacaaaagggttagtgagggcctagaagagcgccattgaaaatcatcacacaagacgccgatagacccaccgctgcgacaattgtggcgtccttctcacagttgtcgctagcctacacaggcgaagaga

SEQ ID NO: 634770 - DNA, 163 bp, Homo sapiens
gaattcgggggaagggaaactcatgctttaaatagactctgaaaatcacagagtcagtcaaggaagagtccaagatctgcccttacgaatctcaataaaaatatgaagtgatcctttttactatggtaattcttcataatataaaaggctttggtcctggaat

SEQ ID NO: 634771 - DNA, 103 bp, Homo sapiens
ggtatctcgcctcgctgctggtgatcgtgctgctggacgtgccgtggcagatctggagccacctgaagaagctgcgcatgtccaaggaagacgtacgccaggt

SEQ ID NO: 634772 - DNA, 110 bp, Homo sapiens
cccttttccccctttttccccctttgggttttaatcctttgggtaccttttaaaacaagtttttcctacaacctttttttttggggaaatttaaatttttccccccttga

SEQ ID NO: 634773 - DNA, 436 bp, Homo sapiens
atgctagaattgcgacatgactcagtgatatgaagttcatcatcaataattggtgtacttctgcagaacatgtgcgttcgaacaaaggtgcgagcttcggactcagtggttgggcggcgttgtcatagctacagccagcgggatcaccttggggatgctgatgaagaaacatgtacacatccattcatcagtggtgtggtggaggttgacgccgctgtcaccccagaggagcgccacctgtccaagatgcagcagaacggctacgaaaatccaacctacaagttctttgagcagatgctgaactagacccccgccacagcagcctctgaagttggacagcaaaaccattgcttcactacccatcggtgtccatttatagaataatgtgggaagaaacaaacccgttttatgatttactcattatcgcacttagaca

SEQ ID NO: 634774 - DNA, 127 bp, Homo sapiens
cacgatatgtacttattgtctatgatgaatataacatataaaaatacagaatacgcatataaaaactacgctctcattaatgtacgatactataatttagggagagcaaaaaggaatgatgatatta

SEQ ID NO: 634775 - DNA, 924 bp, Homo sapiens
tgcgacactgcttctccctcaagaatctacaatactagcataatacacatttatttaactcttatgagcttgctagagagatggcagtgtacgttattccctttaatgcttacgaatttactgtgaaaattactagtcttactaatagaagatgagaaaagtaggccagacttggaagacagcttaatagtgagttgcgtatgttgtggtagttgatctgctgtctctcactaggtccagtcttctgaggtgtcatttattgtatactcaatggcctggaaggtcaagtgtgtgtgagacagtattgtaagtccctttgattctgcatctgagaataataactgtgcaatttgattgctcaaagaactcttaccagggaagtggtaatgtcttgaagtcgagaagcattatctatctttcaagtgggctatgggagaattaatgtccagcaactgtatgtcacaacgtatgaggcaagaatacactttatagcatgctgtagacaagcggaggcataagccaccggcatgaagaaaggttgacactcgcctttgtaacacccaatgctgatctatgtttgggtatctacagttgtgagtcccatgaattcttattgggggagaactagtgttattgtgaggcaatctgcttttagactgaatactgttgaatgagaagctatttactactgtattcactacaaataattacggttctcggacacactattgacgtcccaatctcccccaggcattccttagtacagccctgattaacttgtcaggggcatggacaccgattgtgatttactccggaaaaaccaaaatataccagtttgtccccttaccgtgtcaccatactgtggtgttctcacaaaaatgcatgtactttctatggaaccaatacgaggttagccccatataa

SEQ ID NO: 634776 - DNA, 375 bp, Homo sapiens
gtgattcccatgcctcaacttcttgagtagctggattacacgtgtgcgccactacacccagctaatcgttgtatttgtagacaacacggtgtttcatcatgtcggccaggctgatctcaaactcctgacctctaatgattcacccacctcggtctttcaaactgctggcattacctgtgataatcaccatgccatggctgtattgaagtaatttcctcaacaattactagaatagcgttattcctatactctgatacatggtgtaccttctttattgatatgcaactgacatacaatgtgcacaatatatattaggtcccttccttctctattgttacttgacatgtggcatttccatgcatgatgctatccttc

SEQ ID NO: 634777 - DNA, 94 bp, Homo sapiens
gtaggaaaagagaaccgaggaagcacgtgaacttactaattctattcgaggattttacaatggcatatttttcagtattaaacgaaaatgtttc

SEQ ID NO: 634778 - DNA, 452 bp, Homo sapiens
aaatgagtgagacctgtatggatggagagacgccactgagtggtccacacagactgtggggactggggcttgagtgtggggaaccttctgctcaagaaaagcaggataggccaggcacggtggctcacgtctgtaatcccagcactttgggaggccaaggtgggcagatcacttgaagccaggagttgagacccgcctggccaacatggtgaaacctcatctctactaaaattacaaaaattagccaggcatggtggcaggtacctggccaacatggcgaaaccctgtctctactacaaatacaaaaattagtcgggtgtggtgtccagatgcctgtaattccagctactcgtaaggctgaggcttggagaatcgcttgaacccgggaagtcggaggttgcagtgagccgagattgcgccatactgaactttcagcccggtgatagagcgag

SEQ ID NO: 634779 - DNA, 360 bp, Homo sapiens
  misc_feature (1)..(1): n is a, c, g, or t
  misc_feature (126)..(126): n is a, c, g, or t
  misc_feature (230)..(230): n is a, c, g, or t
  misc_feature (354)..(354): n is a, c, g, or t
ngttaccaatctgaagtgggagcggcggatcacagcgcgtgcccttgcgggggtggacccgtccctcttggagttgacggctctccgagtccctgcggtcctggcatcgggcaggggtcctggggnttgcccacacacctcgtgtctagcctccttttcttccccggcccctgctgcttgctcagcaggaccccggagcctgacttctccagaccaccaggccaggggtncctgttcccgaactcctggcccttagcagccctagtgagcgccggattccagccccctcctcagcctctcctgggaggcccagagaaaagggtcaggccttgtgaccatgtgcaggacaagttnccccac

SEQ ID NO: 634780 - DNA, 331 bp, Homo sapiens
catcttctacaatgtttctgggaaaaatcaatttataaaatgaaagttcagtcaggcatggtgcccacacctgtaatcccagcactttggcaggccaaggtgggtagatcacttgaggccatgagtttgagactagtctgtccaacatgctgaaaccccgactctactaaaaatataaaaattagcccagcaaggtggcacgtgcctgtagtcccagctactcgggaggctgaggcaggagaatggcgtgaacccgacaggcggagcttgtggtgagccgagatcacgccactgcactccaggctgggcgatagagtgagactccgtctcg

SEQ ID NO: 634781 - DNA, 199 bp, Homo sapiens
agaaccttgtagagagagtgaaaaatttaacacccatagtaggcctgatagcagccaccaattaagatagcgttcaagctcaacacccactacctgagatatcccaaacatataactgaactgctcacaccccattggaccaatctatcaccctatagaagactgatgttagtataagtgacatgaaacattctcctcc

SEQ ID NO: 634782 - DNA, 792 bp, Homo sapiens
  misc_feature (38)..(38): n is a, c, g, or t
  misc_feature (54)..(58): n is a, c, g, or t
  misc_feature (63)..(63): n is a, c, g, or t
  misc_feature (70)..(70): n is a, c, g, or t
  misc_feature (72)..(72): n is a, c, g, or t
  misc_feature (77)..(79): n is a, c, g, or t
  misc_feature (84)..(85): n is a, c, g, or t
  misc_feature (88)..(88): n is a, c, g, or t
  misc_feature (100)..(100): n is a, c, g, or t
  misc_feature (109)..(109): n is a, c, g, or t
ccttcctctgggccatgactccgccgccgccgccgccncctcccccgggccctnnnnnctggncgacccntncgggnnnccctnnccnctggcctggatnatggtcgtnctcttcggggctacggcgggtgcgctgggacgggacctgggctcggacgagaccgacttaatcctcctagtttggcaagtggttgagccgcggagccgccaggtggggacgctgcacaaatcgcgtggttcgtgccgaggcggcctcacctgagtacgcagtgccagcgaggcgatgcggactgagcgccgagagcgcatggaagcgggcaagagacaggtggacaaggatgctgcaaggcagtatcatcacagctggtgaacggggagtgtggctattgcatggggagggaggggaggggtaagaattgctagtccgtgcggaggcataggcagagagagcaggcaaagcgaaattttagatagagagaagagtcgagtgggcaggccacagagagaggaaaataccatgagaagaagaacagagggtgaagagataccactagagacagttgtcaacagtaacgatcgccgttgcgtagttaggagcgcattcactggaaagagaagaactatacccaaataaatggcaaaaggaggtcccaaaagttagagaaatatgtagcgcttagacaagtagagaggcgacacacaatgaaagagacgagaacagcgagagaaacgaagaggaattataaagtgaaagattgagattaacagagagtagagcaagaaaagaagaga

SEQ ID NO: 634783 - DNA, 481 bp, Homo sapiens
  misc_feature (173)..(173): n is a, c, g, or t
tatggcacattctcactcactcactactcctgcattccagcctgggcgacaagaacgaaactccatctcaaaatatgtatgtatgtgtgtgtgtgtatatatatatatatatgtatatatatatgtatatatatgtatttatgtatatataaatcaaaatgaaaaaccttttnggatactaagagcaacaaaatttagggaagtaatttcttaagtatagattaaaacaaatatttatgcagcctggtgactagaaggctgttgtgtaactaaacaccatgaaacttaatattgcgatagtcctccccacatgaagagagagtgtgagtgatgaagggccatgttcttatatctattaaaactcaagagggaatttggttgcatatgaaaggacttaggtattataaagggttagatacttggaagaactgcaagtttaataagatgctgaaataagttgccaacagaaatgttggttatt

SEQ ID NO: 634784 - DNA, 133 bp, Homo sapiens
tgggatgcaccatatgttccatagatttttgtcaaacagatatgcgccactgttttacactctaaacttgtgcgtgaatgtgcagatacaatgtccatgttacagagcgtgtaaaataactgtttgccgctga

SEQ ID NO: 634785 - DNA, 279 bp, Homo sapiens
caaggtaaaaaattctgtcccttaacacatgcacagtaagggaaataaatcaatgtggagtgcctcagactaagggcttgcctgtgcactgggagattgggatagacccaccaggaattcttgcatcatggggatggggcggggtaggagggatacactggcctatgcagccaatgtggtccatggtgttcaatctgtgagctaggaacacacagcgtgaccccctcttcttttgatgagaactttcgtgtaataaattccactttcctcacctttgta

SEQ ID NO: 634786 - DNA, 853 bp, Homo sapiens
ccctgctgcctgccaaacaccccaccattggcctgtcaagccacccatgggctgtctgctgagtgctaacaacagactctcatcactccttcacttggtctgtctgtctctgtcttggtagttgccggtggacagcatggtcgtgccagcctcccaccactgaggccaggtctaccccccatcataccagcccccaggaccactaccccacggccagccagggtccagagtctagcccagtgctggggatctcgacgtcagacaagaatggtgacaatgccttgagtctgaggcatcctctgcctgctttcctgcctgcccacctgcctcatattgtgtgggcctttttctgttgtctcattcattgtcttttattggtgtaattattttaaatgagattttggtctcgtttaaatgcaatatctctgtatacagactggctgggcccaccccctggtgtggtcctcccacagtattttgtgcaattgaagccctgctcgcaggcttgcagagacagggacacaggccctatttggaaccctgatcatcaccagagcccctgggattggctatgggaaagcatgccacgggcattcgccttcctacccccgggccgcatccccagttgcacagggggatctgcggactcaccggagactctgcgaaatggcccaggtggggggcccccactccttctcctcctggagttcccgagcttgggctcctttcttctcaggcttccccaggccaagtccctttgtcgcattccaatctggtgcgttgggtaagggcctcgagacactgtccctcggggggccaatgggtcttcccaccgcgttgcgcaccggttcag

SEQ ID NO: 634787 - DNA, 652 bp, Homo sapiens
  misc_feature (532)..(533): n is a, c, g, or t
  misc_feature (547)..(547): n is a, c, g, or t
gcaggtccctggccacgtcgcgggcgatctcgccatcttgcgccgcttcctctcaggggccgccgcctcgctgagccgtccagtgcccggggccagccgcgcgtgcgccgagtcgccatccgaccgcctgcctggaattgaacacttttccaggcgtgagctgtggtgactctgtcccatgctggcggccagtcggtcatccgtgactggctgaaggatcttggaacgaacgcgctccttgcgcccgggtagttccttggtgacaacagccagtgtatctgtattgcgacctggatctggcagcaagatccgttaccgtggaatctcttattaccttcactgtatactttccatgtgtaaataaacaacattcgtactgacacggtatattcttacctttggcgctgcttcgactatgccacgacagggtgatagccttggaattctacctcgtgacacatttctacatagcgacagacaccctacacagacgtgcgaccgacctccatctgagaacttaccacttgtgccnngacgcgttggcacngtttcgacattgggactcgcgatcccccttgtttgaggcgaacgaggcccattcttccaatactgtcttcacgctgatacattccacccagagattttacatccc

SEQ ID NO: 634788 - DNA, 327 bp, Homo sapiens
ttcatttctattcctacccagtatgcttctttctttctttttttgagacagcatcttgtctaatcaaccaggctggagtgtagtggtgtgatcatagctcattgcagcctcagactcctaggctcaagcaatcctcccacctcaacctcccaaagcaggtggatcacttgaggtcgggagttcaagaccagcctgggcaacatggtgagaccccgtctctaccaaaaatacaaaaatcagccgggcatggtggcattgtgcccgtagtcccagctactcaggaggcggaggcaggagaatcacttcaacccgggaggtggaggctgc

SEQ ID NO: 634789 - DNA, 199 bp, Homo sapiens
taaatttgttaggaagcatttgaaggcgaaacttgctagctgttttgaaaggcacacataacttaccctagttaagagctacatggttttgttcactctcttaggggggcacagagtttctcagattcctgcatatctcacttgtaaatgtgtttaaacacctctgtgatatgtgacccatctatactctgcagcatat

SEQ ID NO: 634790 - DNA, 527 bp, Homo sapiens
cacacgcactccacacgtaagctcattctatacccgaagagcagtctcagaaagcaagattacttttgtgtattttaaaaaatgattctttcagtgtatttatataagacattctgtattggaacgtagtggacttcctaacatgattccaaacgtcaccgtgtaattcttcgtgtttttgtttatgtctctgtactttatcttcattattggactttgggctggggggcaggggcatggtgacacaagaggattttttttttttattttaattcttggaaattctttcccaattaaccagactaaaagttttgcacgtgaaatacaacgttgtatgcctttttgcatttattaaaggccgtgctccctggaattataagcagagtagatcgtgttcaagagagccagcttcagccgtgtaacattatttgaaaacagatatgtctgcacttagaggtcccttttgaatgccatacactagacctctcaagcattatgtatcatggctacatccaagcgcctcacaa

SEQ ID NO: 634791 - DNA, 223 bp, Homo sapiens
acctctccactggtgcatgctgctagccgtctcgcccggagctcaatgcacccggctacagcttgtggcactggcctccacccatttcacgttatacctgtcaaaactctatagagcacctaagtgagcttcaaaagcaccagttctagcttagattcttcagcagcctctgaatgctcttgagatgaaatctaaatcttcagcatgggttatactccctgca

SEQ ID NO: 634792 - DNA, 944 bp, Homo sapiens
catcgccgcgtgcgtgtgtgtctccgctcgaccctttgggaccgtcccccttcgggtgtaccccgccgagtttttttcaccctatatcgcggtttctcccctctgtataccggccctccatatcttgtggggagaccgcccgcatttcttttgttgcggacccctaaactatgtgttccgtggccggccccgaatattccccggttttgccctatctctccgggctcatcttccgcgtttcaatgcctcatagctctccctttgcgggtccccagccgtctgtagtaaatagatcattggcaccacgccttgcttcctcaacacgaggcagaaataagggggcgtttcctcctccttcaggtgaccacttttcctctgggggcccccctcctcatgaggccccccttctttggagtccctccctggagagtgttcctcttctcccctgccctgcccctccgtgggctgatcatctgtgtattcccgacggctttgttacggcgtctcaggcccccatttttgtaggcgcgaccaacccctggggcctccccaggtgttgttcctcaggggggaagcctccccgcgcgcgcttgctttctcccctcggtgaccgcccgggtgtcgcacccagagggtcccgtgcgccctcgcctcttgtgccccgtgtgggcacgcacatcactgggacaacttcaagcattacttcggcgccctgggggcccggcagagtaggacacctcttttctaggcccttctttcacttaccctcgcctcttccgcgccctcccccagtgatgatcgccccccagtagcgccccgccgccctttcttcccgccgtggaagaaccttcttgcgtgtcccccggtgctttatttttctttcgcccctcgcgccggcgcgttcgactttgtgcccgaaaaggggccccaacccccacaaaaca

SEQ ID NO: 634793 - DNA, 976 bp, Homo sapiens
cgaactactgaggacacgggcctttgccgagtgctgtactcctgcgtcttcggtgctgagaagtcacctgatgacccacggccgcatggtgccgagagggacatggcttctcctgtgcaaggaaaagattttagtctagtggccacgtgcaggtagagtcaatagtgtcagggctgcatgcatgctagtgacatctgagttctggcccactcgcatggagcgctgcagtgctgctaatctctcagatgaggcaagtgccgctgcacgaggccccacgtggggctttccgcctggcagcagagaaccctttccaggagccacggacggtggatgtggcatgagggcgtgctactcgataacggcgtattgcccatggtgctggatgcccagtgagaacctgctacttggcttagagggcatcgcttccggttgctgacacgcctccgtccgttgaccaccgtccggtctgcgtggcagcccaggcgaccagctcttctgctgcgtggctgacctgcagttgagggcatcctcatccgctatccatgccacattggtcagtctgctcttgtcctcaacgaccagtttgtccagggcctggcaggaaggagttcagatgccgcattggccccgtgtgattcctcgttgggatggtgcttctgatggcacggcagagggtacgacactacaggcatgactgaacgctttggcatctcctctcctatcgcaggaggctctgatgtgctgctataccaggacaagtgggtgacgagaagccttgcccaaagggggctggcagcatggtggaggaggtcctgctgtcctcaggttagtggaaccacagaacttcctgagcctaaaagctgctgtgttctctagaccgctgccgtgcggcagcaccgcttggtccttgaaacccacttctccaatccctgccagccgatagtgctagagttggaggagttgcttgagctcaccc

SEQ ID NO: 634794 - DNA, 1510 bp, Homo sapiens
  misc_feature (1138)..(1138): n is a, c, g, or t
gagaattctacaagagcctcactaatggactgggaagaccactatggcagtcaagcactatattctgtagaaggtcagttggaattcagggcatatgctatattattcctacgtcgggctccctattgcacctatatttgagaacaagaagaacaaagaacaacatcacaactctatagtcctgccgctgctagtacatacatggcacagctagtagatagcagtatgcataacccaccagtcatctcgaatatttcatctcgtggctagtaggttgccacctcttagcaggatcctagccccccctaccaaacccactacctccccgcaaccaaccacttagccttcccccaccccagccacccccaccccctcccctcctgcccccccgctctcccatcctcccgccaccccaccccccctctgccctcctccccccacagcctccccctcctccacccccccctcctcccatcaccaccccctcccccccccccccccacccccacccgccacccaccctcccccccccccaccccctcccctcccctcccacccccccctccccctccctacccccccctctccccccccctctccccacactcccccaccccaccccaaccctccccacctaacacccccctccccccgccctccccccctcgctccctagcaacccctgcccttaccccccctccccccccacacaccccctcccccccaccctccctctgcccacccactccgcacccactccgccccccacatcaccctcccctcgcctcccaccccacgctcacctcgttcccccccctccccgccccccttctccacaccctgccaacccaccccccccaccgccacacacctccccccactctccctcaattctcaaccacatctacccaaccctccggcctcacacccacacccccacacacccacgccccacgctctctgcccccacaaccttacccaccccctcctccctcgctaccgccccccccgcacgctccctggcaccaccacacccccctgcctcccccacccgcccgccctcctccctcctcccccccgccactcccccactccgccccgcacgccaccctcgcctgctccccgccccccccctccngcccgcccgctccctgcctcgccccccccacccccctcggctctcccacccccccccccgggccccgccccctgcccccccccccctcccgcccctccccgccccccccccccccccccccctccccccccccccccgcccccctcccgccccctctcccccctcctccccgaccccctcccctccccacccctccccccgcccacctcccctccctcccattaccctcccccccctctccccccgccccacccccacacccccaccagccgcccctaccaccccctccaccactcacctccccccgccccccccccccccccccccccactccctcctcacacacaccccccccccccccccccccccccc

SEQ ID NO: 634795 - DNA, 436 bp, Homo sapiens
  misc_feature (300)..(300): n is a, c, g, or t
  misc_feature (353)..(353): n is a, c, g, or t
  misc_feature (371)..(371): n is a, c, g, or t
  misc_feature (428)..(428): n is a, c, g, or t
ggcgacctgccccatccttggctctcagcttgccatgtgacgtgctttggtgtagggaataaggtggaagggatgatgtcctggttttaggccggagtgggctgggctcctgtgtttctgtatcattatgagagcatggctgggttcacctgcttttccagggggaggagccagtgggaacactgagatagccatggacttcttctctattacactatacccttttctaatctgtattttgactttgttgacaggtcctcaggtcaataaatatcttccataatatattttttggagatnttgccactacacttctgggaaacaaatgaacaaattacatttctatgtatatnttctgcttattacattanattaaaaaatcacaaacaaggatcgctatgcagagtggtagcaatgaatcctttccnaaatcatg

SEQ ID NO: 634796 - DNA, 443 bp, Homo sapiens
caggatcccttttgagagcccctctccttggaatacctgaatgaagacgtatgttgagttgtcttcattctggtttcaaatctcacctacagtgctctctcaccatcctgttcctcgctctaggaccatttcatttctggtcacagttcttgcattccgctattcctgggctatcatctatcttggcttcagggcaggaggactggatttctccttctctaatcctcctacgaggactgaacgatctggtaccctatagaaggctaggaaatgctgagatcgctaaaggaagccaggctaatgggccttgaccccctttttcctggggctcctgacatggttatcgccggagaatggcggggttttgaataggcttgcgaatgtagatttatgtctggtcgtttacacgaacgattagttacgttccattctgtttcttttac

SEQ ID NO: 634797 - DNA, 698 bp, Homo sapiens
  misc_feature (485)..(485): n is a, c, g, or t
tcaaaattaaacccgttttttttttaaaaaacaacttctaaaaaaaaaaaccacccccccccccccaaagcggggggacccccccctgtcccaccggggggaccgctcccccgccccttcgcaaaaacgcttgcaggcgctgttggggaggacgcgcagaggcaagagaggtgcgcctcggtggggagcggtcgccccgtcggcggtgtccagcgcaagacgcctgtgggcgagcgcccgtggtgtggagaaggcgccacgcgctattagcgcgccagaaatctggcggggccgagggtccccggcgggtggggcgacaagaagcgcaatctactagggggagagcgtctccccgcggtctgctgtggcccacggcggggacaagtgcgcgccgtgtgttaggaacgctatctccactctacagagagcgccgaggagaggaagcccacaaaagagaggtctcccgagaaacacccctctcttgnggaaagcgcgctccggcacccccagaaaaagtgtgatagacacgcctggcgaaaaaattccccaccccgccacaccgaacagacgggcggcgcatacacaaaggcgcctgtggcgcggcgaccccaacaataaaaaaaggaccacgagggcaaagaccactgaatatacacacccaggaacaacaaaagaaaagaacacccacaccgccaaca

SEQ ID NO: 634798 - DNA, 401 bp, Homo sapiens
ctctgcctttggatgtaaagtgctctgttgtaccctggtggggttgtgttaattctgccatcacattctcacatggcagaaacagcatctcccacaccacttaatgaggtttgaggccaccaaaagatcaacagacaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctcatttttttccctggaactcaataactcatttcactggctctttatcgagagtactagaagttaaattaataaataatgcatttaatgaggcaaaaaaaaaaa

SEQ ID NO: 634799 - DNA, 418 bp, Homo sapiens
atcgagccgataacatttgccctgagataggaacacattgctaagaagagctgtaaaagcagttgtacagcaaactagggataaatttatcatcccacaattagtgtctacttagtttcaatgtccagggtaggcaaacaagcctgtgggccaaatgctatcctgttgtcaactcttgtaaatgaagtatgatacgaaatagagccctgcgtattcctttacatacacaggggcttgttcctataaatatttcgagaattgctacagaaaccatacatctacctatttaccatctagccctgcacagaacagatttgccaatctctctcttaagctgtgcaaaattatgctgccttccatagcagtatcacatctgtcttcacctttaggaaataagcatacaagggcaatcaagctt

SEQ ID NO: 634800 - DNA, 292 bp, Homo sapiens
gctcgacgtggtggcgcatgctgtaatcccagctactcaggaggctgaggtaggaggattgcttaaacctgggaagcggaggtgacagtgagctgagatcacgccactgcactccagactgggcgacagactgggcgagactccgtctcaaaaaaggagaaagagaaaaaaggtggccgggagtggtggttcacgcctgtaatcctagctggttcacacctgtagtcctagctttctttgggaggctggggcgggtggatcacctgaggtcagagtttgagaccagcctggc

SEQ ID NO: 634801 - DNA, 750 bp, Homo sapiens
gagagagagagagagagagacaccgacggcgtggtggtgaaagactaatgatcatcatagtgatccctgaaagaagttccagctatattttgcgatgtactcaacaccaacatcgatgggcggcggaaaatagcctttgccatcagctgccattataaggggtgtgggccgaagtatatgctcagtgtggtgtatgaggaagaagcagactattgactctcaccaagagggcgagagaatctcatctgaggagtgaggtggaagctgtgtgatcaccatttatgcaagaatccagcgccatgtacaagatcccagacgtgtgttcttgaacacgacatgaagagtgatagtaaaggtgagtggaaatatacagccagggtcctagccaagttgtcgtaggacacacaactctccgtgaaggaccttggatgctgacgttgaaagaatattcgggccctataagaggggcgtgccgtcacttcgtggggcctgcgtgtccgaggccagcacaccaagaccacgtggcgcggctgtggatcgcagcgtgtgtgtgtccaagaagaataatagtgctctgatagggagttggtgctgttgaataatcatagtagtatattaccctacaaaacaaaacaaaaaaaatcccccgggggcattatactcgggggcgcgaacaacacgggtcaagaacgggccctggtcacaacgtgtcttctacccgtttttgtgaaccggggaaaatccgcggcc

SEQ ID NO: 634802 - DNA, 874 bp, Homo sapiens
catgtattcagcctcccgagtagcagtgattacctggtgtgcaccaccatgcctggataactttttatttatttctattagacaaatggggttcaccatgctggccaggcttgtatagaactgacctcaagtgatctgcctgcctacagcttctcagtgtgtgacctactgtgcttgtgcctaatgtacaactttttaagcaatgccacactatgacttaagaatgaaattattgctcattatgtatatctatctaccatcagtgtccaaagaatttcttgttgtatcttaccaagagggagtatggttagtattatgaaatttagttaattattataataagttggttaataacattattgagatcaacgatgtgtcttatgtttttggcatttattatgtattatgaggacaacagttctcgctctgtatcccagtgctagagtacctgtggcaacaatctcagcatcattgcaaacctctgcatacctggagctacaagcactacagggcccacacatcagaacatccccgaagataaggcttggaaattccatcggtagtggaacgcaaaccacaacctagaagataactatgaaatttcttgacaagaagggtcaaacctatcaatgccagaactggatcgccaacctacctgtgcaccagggcaaaccaagaccaaggccaacagatctcgtgaaacagggttgagacacccggcaggtgcgcccagaaggctgaaaaaaacgactaaacaagtaaccaacaaaactaaacaaatgaaaccacactatgggccaaacacacaaaagagcgacaagacaggaaaagaaaaaaagagagaggaaaaaccgcgacaggtcacgacgcgcac

SEQ ID NO: 634803 - DNA, 603 bp, Homo sapiens
  misc_feature (43)..(43): n is a, c, g, or t
  misc_feature (73)..(73): n is a, c, g, or t
  misc_feature (481)..(482): n is a, c, g, or t
atttcttttttctccggagcgcgccattgtgtggtacaggggnattcggccattatgggcgggccccattaanccctgggggaaggggggcccctttttaaccttttttttggggctaagggcttttttcgggtgggggaaacccccacaccgggggggcctttcccctctaaaggacactttgggggaggggaaccccttcggggggggggggggcccccccggggaaaaaaaaggggccccctttcccccgggggggggcgcccggggaaaaaaaaaaacccccccggggggggtctcttcccgggaaaaaaaaactttcttcttcccaaaaaaaacgggggaggggggggctttttttttgtgggggggggttttttaaaaattattttttcccccccggggggaaaacaaaacccccccccccccttggggggggggtgttttttttttttcccggaggaggaaaaaaaaaaaaaanntttgtggggggtttaactctcaccctttttttttggggggggggggagaaattttttttttttcaaaaaaatattttggggggggagagaaaaaaaaaaatttggggcgcccccccccccc

SEQ ID NO: 634804 - DNA, 173 bp, Homo sapiens
tcatgctcggtaccagcaatgggtggccgcagtggacgcagtcaaggctgtgcactcagtgagggctgagctgcccacgagtggagggctgctgaccagtgtctgagtgagtagattggtgacctgccagctgaacagggccctgcagggtgctgtgcttgggggttcctggg

SEQ ID NO: 634805 - DNA, 472 bp, Homo sapiens
tggctgcgccttcagccccgtgctagaatgagaacatatgagccaacttgagttcggaagggctgtggccacctcgtttcgcccatctacttttcaccttgccgtatctgattcttcaccaccgtattctcagtcacttccactaaacagtgccagtgttttaaggttctgtcacactcagtaacccacttctggttcctcattccgtgtcagtgatcagcagtagactgaagaatctaccttagatttgctccatactattaattagcttacaaaatgtctaagaggagctaagctgggatgccacataggcagaagccaggaaaaatgaccaaccacagaaccaagtggttccagtggaaactcagcagctgctggtgcctgctactggactgccaccccccattgaagagactggaccaccaggaaggtcgtttcacattctgtagtaaaaatacccctacaataaaaa

SEQ ID NO: 634806 - DNA, 221 bp, Homo sapiens
ccccccccccggggggggtttggttttttgccctttccaaccgggccttattacccaaaagggggggggggggttcttttccaccccgagcccattttccttttggggggggggggttttttccccccttttgggggggttttttttttccaataatggtgttttggcctttttttaaaaggccccccccttccccttttaaaaaagggttttttgggtta

SEQ ID NO: 634807 - DNA, 480 bp, Homo sapiens
cttttatccgtatgatctatttatgtgtgtacttgaaaatacctcggccaggcactgtggctcacgcctgtaatcccagcacttcgggaggctgagccgaaagctccagccagccagccagccaaggaagtgcttacatcacccctcctccaatcccaggcagtgcagcttacagctccaggggaaactcctttccgcttgaggaggggagaaaggagagtaaaggggactttgtcttgcaacttggataccagctcagccacagtaggataggggacaaggtagagtcccaaggccctcattccaagccctagctcccagatcacatttttagacatacccagggccagaagggaatgcgctgcccttaaagggaaggacccagtcctggaagaatttatcaaatccttccgaaggcggattgctttgagcccaggagtttgagatcagcctgggcaatatggcgaaacccagtctcca

SEQ ID NO: 634808 - DNA, 243 bp, Homo sapiens
ctaccggatgcttatgctcagtgatcctcgatagccagccatgtacgacatggcatgctaggctcttaagaaaactggatcaatgaaaatccaaacttaaataagataaatatttggacgcacaagttctcacggttcattatgagaactgtagtcatttcacataaaagctttgttttgcacatttctccaatcaacgtcacatttgtcatgtcaacagcacagcccagtctggcagttggg

SEQ ID NO: 634809 - DNA, 288 bp, Homo sapiens
  misc_feature (11)..(12): n is a, c, g, or t
  misc_feature (14)..(14): n is a, c, g, or t
  misc_feature (17)..(18): n is a, c, g, or t
ataggcagtgnncncgnntattgtatgtgtcccgaatgtaagcatcccaccccctgctgatatgatcgacggagcggggactcgatatggagacctggaactgctgctgcccgggaatctgaagtgctggtgcgtgggtctgcgcagcttcccgctacgcgagatgggctccgaaggtggaaccagcagcatgagaacctggagaagctgaacatgcgagccatcctcgatgccacagtcagcaggacgagcccattcagagctgctggtcacccatgggaaggtcct

SEQ ID NO: 634810 - DNA, 350 bp, Homo sapiens
caattttaaaattgtctttttatataaaattaaggctccggggtcatgatttttccaagctgttatattagttgtacccagtagtattcccattaaatctggcttttttcccccttaaaaaaagaaaaaaattcccaaccaataaacttggctagcccttgttttgaggattttccaagcccttggaagcgataaaattttttttctccattgaaaatagaaacggctcccttttttctttccagtcagctattggtctttccagctgttataatctaaagtattcttatgatctgggtaagctctgaatgaacttctttacccaataaaattaattttttggcttctta

SEQ ID NO: 634811 - DNA, 123 bp, Homo sapiens
accggtcccatgcgcagtgtatcaaaacttcaggcagctcaggagaccccatttcattcctgtacagctgggcaaaccaacctagggaggccactgtctcctaagccgtcatccccgggatca

SEQ ID NO: 634812 - DNA, 292 bp, Homo sapiens
  misc_feature (25)..(25): n is a, c, g, or t
  misc_feature (128)..(128): n is a, c, g, or t
  misc_feature (155)..(155): n is a, c, g, or t
  misc_feature (175)..(175): n is a, c, g, or t
  misc_feature (209)..(209): n is a, c, g, or t
  misc_feature (232)..(232): n is a, c, g, or t
  misc_feature (238)..(238): n is a, c, g, or t
  misc_feature (263)..(263): n is a, c, g, or t
gcaatgaatgactggcaccctgaanccgaaaccctggaatgggcctgcgcagaaaccacccaacccgatactatacacgacccgattctatgcccatcgacagcttcaccataagcagcaacggtaanacctgcaatggccagcgtgggaaggangcatggataaggcctgtggntctttcacccatgcattgttgtatttgctgtatnacagttagtgaggggtggggganactggnaaggtctgccttccattctccacgnaattattcaagtaaacttactttcctgtt

SEQ ID NO: 634813 - DNA, 236 bp, Homo sapiens
gggggagcaggggttgccccggggcttgggcccagggggccgggggggcgggcccaaaattggggtttcgagtgggggggcccaaggccttgtggcttcctatgggggattgatgcctgggggccccctattgctttttgggcccctccccccaggggggggtggccccccggggcccttggggctttcccctttggggtttggggtttcccaataacctttttggccccccctta

SEQ ID NO: 634814 - DNA, 248 bp, Homo sapiens
gatggagaagatcagccgaagcaagtttatgtaagatgaggtgggtgaataacgagtaagtgactcttgagagcagaggtatccagaacccttgttgaagcttcctctgaggagctcaaatctgggaggaattctcaagtacagacagactgaaaatgatgtgtgatgaactaaaataaaccctttatgacttaggctcattatcattctcacttttagaaccttgtaataacaaaatgatttttctg

SEQ ID NO: 634815 - DNA, 657 bp, Homo sapiens
gtagaatcgagctcggtaccggctcgcgagcagatccaagaataattggtgtcctgaggaagaagataaatctaaaagttgggaaacataattgaggaaaccttgcctggctcaccagagaactaaacatccaaatacaagaagctcaaaaaacacctggtaaattcatcacaaaaaaatcattacccagtcacatagttgtcatcaggttatataaagtcaagaacaaaggaaagaatctcaagagctgtgaggcgaaagcatcaggtgacctataaaggaaaacctatcagattaacagcagatttctcagcagaaaccctataagccagaagtgaatgggggtctatccttagcctcctcaaacacagtatatttcagccaagaatttggtatccagcaaaactgagcttcataaatgaaggagagataaggtcatctttcagacaaacaaatgttgagtgaattcatcactaccaagtcagcaccacaagaaatgctaaaacgagatctaaatcctgtaacaaaacctcgaaatacaccacaatagaacctcgttaaagtgtaaatctcacaggggctactaaacactaacaaaaagaaaaaacccagatgttctggcacagctagcacggggataaaacagtactcacatct

SEQ ID NO: 634816 - DNA, 1736 bp, Homo sapiens
tgacggtggtgtgtgatcacctgaggtcaggagttcaagaccagactgactaacatggtaaacaccccatctctagctaaaacatacaaacaacaattagctcaggcggggtgtgctgtggcatctcaattccagcatagcttcatgaggctgcagcacaggagaatcatatgaactctgggcaggcagaggttgcagtgagcctgagatctacaccattatgcacatccgagccttgtggctgatgagcagaagactgtctcaaaagcaaacacaaaaaaagtcgggagtgtcatcgaatgagtagattggaccatgtgcttgggtctcgaaaactcctttgagcctcatctgtgcatcacttcccaatactgtgagcacatcaacaaagaagatggtagggagaatataccagtgagcagattgaggaccaagccaagcaacacacgtgaactgtgtgattgtgattgatagctacatattatacgaacatacataagacgagtattatacatgggtttaagagagatggaaatggagttgttataagagagttaaccaaagcgttgattagaagaaaaagtaaagcaagcgcataaatacgaatctaggactgctgtgtaagtaaaacgatataaaagacaacaagacttatggcagagctttatggtagagccaaaagagaacgactattagataagaaataagcataagacgaggcacaagataacattatcgcagaggagagttttcaaagaatatagatagggggaaatagcattaaagatagatgagattcgagatgtatctttatagcaagttagtaaaaagtaacaacatcaattggtagaagaaagtgggaaaagcagaggatataacgtttattaccaagatatatagtacacagtatgaaaggtggattggatgaacataaagatggtttgcatcatattaggagaatgagaagagggaataaaataatggtgccaccaaagaagaagacaggtattggatgcaactattgtagaacgagtatcagtagaaaatagtaaaggtccaatatatttggagaagataaaaaagagggtatagggttaggaaaagggaaaaaaaagcaggagaatatatagataagaagtatggtggccagaaagagtagttgggtaacatcaaaggatgtgattagacaatgagagctatatagaaactatagcagagagagtaaaaacagaaataataagagagtataagaatagacgatagcgaattataatagaaaatctatcaaaaatatgggaattatatgaaagagatatattagtcaccctatgtaagaaagaagaagggaataatatgataaaagataggagacatagtgaatggtgaagaaagaaaaggagggaggagataatgtggcatatggaacaaatgtagatagtaagaagaatgattaagggactgaaatagatagtggagatagagaaggtaacgaagcaagcaaggtagaagaggctaagatgatgaagcagacaatagagtcaggaggataggataaataaggaagaaataagagatgagaataacagaatgaagacgaaagaagaagagagtatagagagaagaataaaaagaataagtaagtataagaagtaaagaaggactgagaagagaagcgagaaataacaaatgagtaagaagagagaaaaatgtgagtaagcttttagggaagaagaaag

SEQ ID NO: 634817 - DNA, 129 bp, Homo sapiens
cattgtctccctggtttattgtacagcagaacttttctgtttgtcatctgagcataatcctatcaggtgtctgtggttattcatggggcagataaacaaaccctgaaaagtagggtatcgaggctcgaa

SEQ ID NO: 634818 - DNA, 197 bp, Homo sapiens
ggctggtctcaaactgctgacctcaagtgacctgcctgcctcagcctcccagaatgctgggattagaggtgtgagccaccatgctgggccctgtgtttctcttgtgtgtgtgtgcactcgtgcacacgcgcgtgcctatgcacacacctgcttgggagtcaaattaatcaggaatgctctcctttgagggagaaagg

SEQ ID NO: 634819 - DNA, 236 bp, Homo sapiens
ggaagatcatcaaatagcagtagggcaaaaggcagaatttctctctttctcatagtatttgctgtagtaccacacatgggtagactagaacacctggagcagaggccccgtaagcacactagaataaggcctcatatatatacatggaagcaatgatacttctaatacactagtataactacctatatatagttggtagaatgactatacttataaatagtactagagaaaggaca

SEQ ID NO: 634820 - DNA, 103 bp, Homo sapiens
tcatcagttaacatgacaacgtcttgataaagatgcacctaactccaagatttagattaaaatatctaatccatataactagttacaggctcatgtctcacta

SEQ ID NO: 634821 - DNA, 338 bp, Homo sapiens
ttcgagctggtacccttatgttctgacccaccctagtacatagggagacctccatctccacaaaaatattttccaaattaggcaagtgtggtggcatgcacctgtagtcccagccacttaggaagctgaggtgggaggattgctagaacccaggaggttgaggctgcagtgagccatgattgcaccactgcactccagcctctgtaacaaagcaagaccctatgtcaaaaaaaaaaaacccaaaaaacaagaaaaggaaacactcatatttccccaattttctttagtgtgccgggttatgtggcaagtttctcttcatgtgctcaacttccagttcc

SEQ ID NO: 634822 - DNA, 471 bp, Homo sapiens
tgtgctgtgctgtgtgtgctgtctgtgctgtgatgtgctgtctgtgctgtgctgtctgtgctgtgctgtctctgatgtgctgtgtcgtctgtgctgtgctgtgctgtgctgtctgtgctgtgctgtctgtgctgtctgtgctgtctgtgctgtgatttgctgtgctgtctgtgctgtgctgtgctgtgctttatgtgttgtgctgtgctgtgctgtctgtggtatgctgtctgtgctgtctgtgctgtgctgtctgtattggttgactgtgtgaattctgctgcttgttttcatccctccacatctgaacatttgtttgcagcttaaatggactattgttatttctactgttttccccaggcatccaagcatctggcttccctgtgtgtagactgatacatcaccctgtgtctccttgtctcagtgttgtactgtaaatttttagtcgacccggccgcgaatttagtagta

SEQ ID NO: 634823 - DNA, 230 bp, Homo sapiens
gcacgaggagagagagagagagagagagagagagagagagacacaagaacatattatatagtttcaaatagctggaaggaggatattgaatgttcccagcataaagaaatgataaacgtttgagatgatgaatgtgttaattaccctgatctgatcaccacacatcatatgtattgaaaccccctaaacgtgttgataattatgtgctaataaagaaattagaataaata

SEQ ID NO: 634824 - DNA, 384 bp, Homo sapiens
ggctgtaaattacagacccactcttgtgctaactagtccccgtatctctgaataacccatgaatctgagaatggactcaagcactgtcctaaaggtctcgcctacttatcacgccctgtcattgggcaccaagtgatccaacagatgaacgtctgggggacacattcaaatcgttgcggggtattaacgcgaagtacaaagaagagagattagctgtcaggtagtttgcattatacttggaaatgatatatgaattggtatggttacctattaaacaagtgtgttagagtagcctagcagttttcaaagtgtagtctgtggaatcctagagaatagactcctttcatggagtctgtgagatcggcatagtgtcatactaatact

SEQ ID NO: 634825 - DNA, 320 bp, Homo sapiens
gcaactagtacggaagggtccccgaggttggggagagccccaagttgagaactatgtataaccacttattgtctgaaccacttgtttcgatactcgttgatcatgaacgacctgtgtgtaatatttcttccctacaaacgtagcacccttcagcaggaacctataaaactttcctccagcccttggctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 634826 - DNA, 152 bp, Homo sapiens
gggtccagcccggtgttgccctgttgcccccctttgccaggggctaaacaagtacaaaggtttttttggggttgtaaatggtcctatttccccccctttttcctgtcccatgccccccccccctgtttttttaaagggggggctggtggtga

SEQ ID NO: 634827 - DNA, 1303 bp, Homo sapiens
cacagcagtcaggaagagaaagaggaggaagaagaagaggaggaggtgcgaggatgagtctctgtgggcatggccagcgagctcagtagcgcgggtccttgaggcctcatctccccactgaggcaacagcccaggagaagtcactctcccaggcgcctagtaagggcagtccgtgctaagcctggttgcaatcaatcgccgacgttcctgatggatgacgtcggaagcttcgagtgcctccaagggtccatggaacaccttactgagactctgcccacgtcccagtggagaggaaccttagcatccccattagcttgcccactctggtatgaggcaagaagcaggtggggtgagtgccaagattggtaggtcgctgagcttatcgtagggagtacccgtcgaaggcagaaggagcagaggcagaagaggaagctcctgtaggtgttgtctccctatcccatgacttgcaagcccgactacgggtgccccctggaagggtgtaccagggggagcctgagaagggcactccacttcctgagagataacttgctggaagaacgtgccactcagctagggggagcctcagatgcatggctcgcagcacagatgctgcgccaacgtgacaaagctgcacaggtcgcggcatgggtggacggtggccagtgcgtctccacgtcgattcacgggctgaactcgtgtgtcccactagatgcgctgtgggcaacaatagtgggtgcggacattgcattagtgaggggaagcgaggaacagggagttcccgggtgccgtaattgttcgtggcgcgtggaccctattgggcggagggagacagtggtgcacgagatgttagtgcatcccggcattcaatgggaacccccgggcctgggggaaccggccctttcctaaggggacgccaccttgtaattccaaaaagacgacatttgggacccaaagagggaaaaggaggacagccttgggaaaacacggaaaagggggaacgaaggacaccggcatcagatgggccggggacatgttataacgggggcgaccggcaaattttatgtgggccaccgacataatcaagggacacacacgacacgaatggggaaacaacggggaaaccgtgtagtcacttcacaagacgaaacgcctagcgagatagcccgggagggaatcgtagccaccaacggaggaaactgcgggacataccaacagaaacaaggggagcacacaaattggaaaagagggagaaacgatacatggtgaggtggaccacaggaatgtgaagataaccacgcaagtt

SEQ ID NO: 634828 - DNA, 839 bp, Homo sapiens
taaagatctgtgaccggcagccccagacctgcctgcttcctgacttctgttccagatggcaaaggtcattcatccgctctgaagtcagccttttccccccacccggtccccaacttgtgttttacccgataacggaaggtcagcattcaaagtctagagaagtcgccatttatcttcccgtgcgctctacaaatagtgccgtgagaatagatggccgggaagctcgatcctgctggtctgctgtctctattcctcttcgggctctgtcagaccagagttatattgctttgcaaagttggaaaggcatatgattacaacttatcacacatgttactgcccccagcagatcactgggtcaccagagtttgacagagtatcccgggcacaacaaaactgtgtggagtttgactcctatacttcagtaattacacttgtggatggctgggtggtatttcaccctggttttggctacttgtctgggtctggtgtacatattggccgtcacctatagcttctggggggatattcacgcacatgctgctacgaatgacggctcatcggtttccgactgagtctgcggattttggccttgttgaccctcctagcgtgccctgtagaattgcaaacagctttctgggatgaatatctgggacctcgaatatttgccaacgaaacttgagcgtcgggcaattctagcttttatctctttcccctttaatgcttgcagaaagcttgttccccacccattgaatcgtacctattggtcatgcttctcgttcaactcccaaccgtaccgttctttattcctgtctcctcttggaccactatacacaaccccg

SEQ ID NO: 634829 - DNA, 803 bp, Homo sapiens
  misc_feature (162)..(162): n is a, c, g, or t
agacaaaaaggagtgaaaataccttctagtagtattgacctcgtctttcattatttcactagagccggcaaaaaagttaatgtcccaattgctaaagcacatgtttggttaatagtcaaagtcattagtcaaagtagaaacaaaacattacctcaagcaaantggtggctcatactcctagaatcttttcgctccgacagacttgtctatactatgcatatgtcatacttgtgaccaacgtggcagtaagcaaataaacatttagagtgaacacaactttagaagggaggtttatgacgaagatactatatgtgtattatctgataacacctgagttcatgttaacatcatattgtcggtactcacggtcaagtaatgtagaatttcgcatagaatatccttgttctatagtgtgcacaacactgtcgaatgcgaaaggaagtgaacaaatctcatactgcctctttagtgcaatcgtgtataagagtgccagacgaggaagattgttgcagtgcataatctaatgtgggccattagtcacatttttttaggctggtggcagttcttagcacttgcaaggtaacaattcgtgtcagtgtcctcctttctgtaggagcatcatttgagtataacaagaatagcaagtgggatcatgtcagaaattttagcctaaagtcccaagctcccagatttgactgtgagtggtaaagaggaggcaaatggcaaccttgaggacctggcagtttccctgctgatttgtgttggcagtttaataattccatcaaaggagcttgcatcatcag

SEQ ID NO: 634830 - DNA, 410 bp, Homo sapiens
cgagggtgacgacgaggggatcagcgtcattcatgctgtcttggtccactgtagccactatgagggcttcctagtgctcacgtgggcactatctggacaggctttaggttgcagatatgtgtaagtgaaaacattcctccttggttctccttccctctgggtgcaggggagtgctttctctttgtctacttgggcgagagctgagtagtggaaaccaggcctctccatgcttgtggggctagctctgcagttgggagactgcggagggtatgctcagcagttcccagactctggttgtctgcgttggtagaacgaaaggtccatcatgacgatatcttgcttcgtcctctttggtcctgtcgccgtggatcttgatgccgtagtgcttagcagtggatccactactctgg

SEQ ID NO: 634831 - DNA, 1234 bp, Homo sapiens
  misc_feature (433)..(433): n is a, c, g, or t
  misc_feature (447)..(447): n is a, c, g, or t
  misc_feature (467)..(467): n is a, c, g, or t
  misc_feature (491)..(491): n is a, c, g, or t
  misc_feature (567)..(567): n is a, c, g, or t
  misc_feature (1180)..(1180): n is a, c, g, or t
cgcggtggctcacgcctgtaatcccagcactttggggggccaaggtgggcagatcacgaggtcaggagatcaagaccatcctgactaacgtggtgaaaccccgtctctactaaaaatactaaaaattagctgggcatggtggcaggcgcctgtagtcccagctactcgggaggctgaggcaggagaatcacttgaacctagcaggcaccccactgcactccaactggggcgacaagcaagactgtgcctcaaaacgcgcgcgcgcgcgcacacacacacacacacacacacacacacacacagcctgaggaaagtgaagaatggtatcttagagaagggagagtttggttgctgtgcaggatgaaaaatcaagtttgaatagatagactggaggtcatggaggatctcttgtcatgctgaaaacattaaattntattgtcttaacanatgggcaacaatagcagttntaagcaggggagaatcattatcanatgtgtatgtgtttcaatctagaggcacctgcgtagtgtgtatgtgggtttagagtctgaggagaagactggttgncacgatgttataataaccctgaataggcccggcgcggtggctcaagccctgtaatcccagaactcgggaaggcgagggggatgatcatctgaggccggaggtcgggaccacctggcaacatgggaaacccgttctaatttaaaacaaagttacaaaaaaacaagcccaagaaaaaacatgtggccgctttggcccaggactttgaatcggcaagttatgatggggcccgaattgagtcatttggcaaatccgctaaggggggggaccaaattaagggccgctgttaaaacgtgggactggaaaaacctggggtacccacttaaagcttgggaaaaacccttttccgtgtgggataccgaaaggcccccctagcgctttccaaattggcccctctatggcatggaaattgggcggtaatttgtaaatccgggaaaattggtaacagcttttttaacaagggccaagcggaaactcttatactgaggggaaaccctttaagcggggctctcgggaacaccctgattttttcgcgggcgcaagactaggccctatggacctctcttatattgcgggagcgcacctgcgcacagggtatctagtcctcatccggctncttatattctgaccgcgttatcaccccctcttctctcctcgctgcgtgcgctcg

SEQ ID NO: 634832 - DNA, 154 bp, Homo sapiens
cagtattatatctaatatgacggtctcccagtatggtgatcatagtatttaataactccattaactattggccagctaaatagtagtattgaaactatagtccttactatggctaagggaggcaatgaattttttttaacatggtatgtttact

SEQ ID NO: 634833 - DNA, 590 bp, Homo sapiens
  misc_feature (46)..(46): n is a, c, g, or t
  misc_feature (53)..(53): n is a, c, g, or t
  misc_feature (117)..(117): n is a, c, g, or t
  misc_feature (120)..(120): n is a, c, g, or t
  misc_feature (155)..(155): n is a, c, g, or t
  misc_feature (176)..(176): n is a, c, g, or t
  misc_feature (190)..(190): n is a, c, g, or t
  misc_feature (195)..(195): n is a, c, g, or t
  misc_feature (198)..(198): n is a, c, g, or t
  misc_feature (217)..(217): n is a, c, g, or t
  misc_feature (223)..(223): n is a, c, g, or t
  misc_feature (228)..(228): n is a, c, g, or t
  misc_feature (251)..(251): n is a, c, g, or t
  misc_feature (260)..(260): n is a, c, g, or t
  misc_feature (287)..(287): n is a, c, g, or t
  misc_feature (289)..(289): n is a, c, g, or t
  misc_feature (293)..(293): n is a, c, g, or t
  misc_feature (314)..(314): n is a, c, g, or t
  misc_feature (324)..(324): n is a, c, g, or t
  misc_feature (343)..(343): n is a, c, g, or t
  misc_feature (351)..(351): n is a, c, g, or t
  misc_feature (363)..(363): n is a, c, g, or t
  misc_feature (367)..(367): n is a, c, g, or t
  misc_feature (376)..(376): n is a, c, g, or t
  misc_feature (383)..(383): n is a, c, g, or t
  misc_feature (403)..(403): n is a, c, g, or t
  misc_feature (451)..(451): n is a, c, g, or t
  misc_feature (475)..(475): n is a, c, g, or t
  misc_feature (480)..(481): n is a, c, g, or t
  misc_feature (483)..(483): n is a, c, g, or t
  misc_feature (485)..(485): n is a, c, g, or t
  misc_feature (495)..(495): n is a, c, g, or t
  misc_feature (498)..(498): n is a, c, g, or t
  misc_feature (503)..(503): n is a, c, g, or t
  misc_feature (506)..(506): n is a, c, g, or t
  misc_feature (510)..(511): n is a, c, g, or t
  misc_feature (514)..(514): n is a, c, g, or t
  misc_feature (524)..(524): n is a, c, g, or t
  misc_feature (527)..(527): n is a, c, g, or t
  misc_feature (560)..(560): n is a, c, g, or t
tccccggcgccgcccggggccctgagggctgactaaggtccagacnggggggnacgggacagacgaaccagcacccgtgtaggaagcgcgcacaatgccccgctacagaacatcacnccncaaaatctgccccaggtccggccgggagcaagganaaaacgggaccgccggagccnccggactcctttgnatagnccnggcgctggcgctggcgctngcgctngcacnggcgctggctctatctgactctngggttctcnaggctccggcaaaggctcaccctcttncncccnaaagccaacctgacaagttanatcacaaaangccccagctccgaaaaatntttgggtnggggaacctcanctanccaatctanaaaagtntattcaccgccatcaacctngggctgaagaaggaacccaaatgtggctcgcgtgggctccgtggccancaacctgtgcaatctactaaaaanaacannancnaccgtatgcnaanccatnatncaannctntgaggataanatngtagaggtgtgaagacgctcaatgctgacccanctaaagcctgtggctagctcctgggctcca

SEQ ID NO: 634834 - DNA, 349 bp, Homo sapiens
atttaatctttttgtcggaaaacctcccatctatctgtctagctaatagattctcagtctcataccggtgtaaaacgttccatgggaatatgagcatagttttattcactgctgtatacctggtgctttgaatagggcctgccacaccatagcatgtgctttataaatatattattgaatttcaggggaatacatttagaactccagactgttagatcagcctagaaacacctcagataatcttacttagtagtatcagtgaggctctacgagctcctctgataaggaaactggcactgaaggtgggcgtagcggccttcagatgtaccaggcagctcttgccgtaacc

SEQ ID NO: 634835 - DNA, 847 bp, Homo sapiens
ggggctttcaggaatttagtaaaaggtggagtatggcctttccagtatcttccatcttcctttgtatacttgtccttcctcccatttcctccctttgggtccgaggtaggagtgatggagggagagctgctactctaccacttcctgtgtgcctctactgtgggctcaaccctgagcagattatagctactcccatcccttacctgggcatgtgtgagcccttctcactgcattttatacccttgtgtctgtgtacttgcataatatatatacatataatatatacaactatacaaactttgtacaaggaaggcaacgcctcctccttgatggcagactgttgcccattgtgttagtgtagggatcttgtgtcgttgtgtctgacaacttctcattagcccagcttatgatgttctagggatataagacattagtaacatcgcaaaaatacaataagtcattccaccagaaacgaatgaagtcgtgccggcgctacggacattcctcgccaggggtacctactatcttctgatcaccgccctttctctggctatggctggggcaccgcctacattggaggacccttatactagcgcaatccgcgcttgccctggcctgctcatcgcccccaccaggaggctagacatggacccaggcgttgtcctgccgacaggaatgacccaccgacctctaggagggttggcccatactcggctggcctctccccacggaggattgatagacttgtggggcctgatctcacctccccgcgctcgtcacgctcgctccccaggccactgttcctggtccgttcaaccgattcgctcgcgctcctcttacgaatctc

SEQ ID NO: 634836 - DNA, 80 bp, Homo sapiens
gcgtggtcgcggccgaggtacgcgggattacaaataagattgttatgtcagtattgttattggcttttcgtattcctctt

SEQ ID NO: 634837 - DNA, 111 bp, Homo sapiens
gattcccccgcacatcatgcacaagtcagcgccataccggcgcctgctcctcgggagcctgctgtttatcgccgtcatcgcgctgctcggttgggacaccctcaagtcgcg

SEQ ID NO: 634838 - DNA, 364 bp, Homo sapiens
  misc_feature (242)..(242): n is a, c, g, or t
gaaagaagggggttcctcggtcatacaccagtactaccaaggccagctttttttcctgcaaagatactgttaacctaaggcggtaaaaaattggccagaggatcagtgtccgatgaggaattgttggagctcagagaggcttttgccaaagttgtatattgatggcattggtatacatcagcttccattgagttgagtgactcgttcagggctgctcgctcgcctttgcctggatatagagngcgagatatcacagagaccctgatggctacaggtgatctggcccacgatggagggctcagctttgatgagtttatcaagatttcccatggcctaaaaagcacagatgtcgccaagcccttta

SEQ ID NO: 634839 - DNA, 225 bp, Homo sapiens
  misc_feature (61)..(61): n is a, c, g, or t
  misc_feature (71)..(71): n is a, c, g, or t
  misc_feature (73)..(73): n is a, c, g, or t
  misc_feature (83)..(83): n is a, c, g, or t
  misc_feature (100)..(100): n is a, c, g, or t
  misc_feature (102)..(102): n is a, c, g, or t
ccgggttcacacctggcaaagaaaaggaacaggaacaggaaaaagggatggaacaagttanaacagggcananccgggtgtcnggggacatgggttggtnanaccacctgccacttactagttctatgaccttgatcaacaaattcaccctcctaggcctaggttccacatccatgaaacaggattgtaatggatcgtacctcacagtcttggaaggaccaaatg

SEQ ID NO: 634840 - DNA, 359 bp, Homo sapiens
aacatagacaaattaaagtaagaccttgattaggtgtatatccgctatgcttccgccttgagtaagtatacacagaattgatcgaacttgcctgaacgcacttcacaactcatgaaagattaagtatccagcctaggcatggtgggtggtgaggcatgagcaacctgctgatttatgcctgtgaatgatggagaagtctgcaacactgtatccgtgtgcaatggggatacatgaagaagtagctagaaagttagacaagtgagattgtaccatgttcatcttgaatgcattggagatccatgtctttgagcaaatcgctcaggtccgtggaacaataaatctatgtattatccaaagag

SEQ ID NO: 634841 - DNA, 296 bp, Homo sapiens
gatcccccatttgggcatcactggattctgtgggggggctttgctatgggacggagggtgcacagaggtaggctggggttggagtaggcggcttcctcgcagatccgctggcggagcgcttgatgtggcggagcggggcaatccacttggaggggtagatgtcggtggggttggagcggctatgatgcacctgtgaggccatatttccgtgcagcgccattctggggggccacggaaggggcagggttgcgggcagacactgatcttggccacgcttggtgtccacaatggccctt

SEQ ID NO: 634842 - DNA, 814 bp, Homo sapiens
  misc_feature (35)..(35): n is a, c, g, or t
  misc_feature (247)..(247): n is a, c, g, or t
  misc_feature (249)..(249): n is a, c, g, or t
  misc_feature (263)..(263): n is a, c, g, or t
ctaaacgcccccttctcaaacatttgggtaggtgntaagcggtcataaaacctcagctggggggacttccaggtaaagatgacagattaaactatgcatttacttctgttctttcccgaaaccctactaaaacatcagtgaatggactgaaattttttaaaaggcataaacccacaaagagaaagagatgttgtctctgtgttgtccaggctgctcttgaactcctgggctcaagggatcctcctancntagcctcccaaagngctgggattacatgcatgagctaacacacctagcctctgtgagtaattttaagactttccttgactctgccctggcagaagggtaaatagaggatctgtggactagggagcatcaggtatagttgataataaggctacccttcagaaaacacagggttctttataggccaaatactgacacctccctcccccagaccttttttcccactggttcctaaaaaactggccgccagactagtaccctgcaagaagatggtaagatgatccttctctggagaatctgaccagcccaaggagaaggagctaaagacactgacatcagagtcccccaatggtccacccaattcactccatagtgaaccccatactagcaagcatagccacaagtttgtaatcagctagttaaggctttgcttttagctatgatcagacactcagggatcaccaaacacctgaagaatgcccctaacataaaagatggagaccaaaacaagcaagaacaaggcaattcagaggacataagagaatccacagggagaagaaaacttaaa

SEQ ID NO: 634843 - DNA, 235 bp, Homo sapiens
atgtgatctggaggatcctccagaggcacaagaggttgggcggggcgttgctgggggaaaacgagaatgggtacttgagtctgaagcttaagtggccagtgccacagggggcggggagggggtgtcaggccctggacccatgcccaggacagaaaagcaggagcagaacactatcccaagaaagaccctacggaggagctctggaggcgcaggttgcaggcaggaacgttacacc

SEQ ID NO: 634844 - DNA, 496 bp, Homo sapiens
ttgcctgtgaaaggcatgattgttcttcttgaagtcacatgcttttgatttctaaaccatttccattttcatttgttcaacctgttctccctgtttcattcctcttgcttcacgatgttacaataagaatgcattcctagttgtagacctaaggagcagtgtaaggcagggaggcattcccacaacttccttgagcctatcttaggcttaattaagcctatcataggcttaattggtcacagggacagaggttagtcccaaatgataagaaggaatctgtttctacaaatggagtggcccttggggagagcttctgtctcatctttccaccagcatcactgtgtgaaccaggcatgtctgttctctgcaagttaaatttgtttgtctgagtagtagggaggagtattatctcctagccgtctagaggtgccgatgaagctgttcgataaaagcagagttacacgtttaaaaaaataactcaacatcgctgatcact

SEQ ID NO: 634845 - DNA, 142 bp, Homo sapiens
ttttttcaccctcttaagcggacccatctctactacaggtaaattaatgagcagggcttgtgcgcgcgttgtactcccagctactcgggaggctgaggtgggaggatcgcttgacgccaggagttctgggctgtagtgcgct

SEQ ID NO: 634846 - DNA, 382 bp, Homo sapiens
  misc_feature (168)..(168): n is a, c, g, or t
gggaaggtgatcagaaacaatgcctcccctgattttgccttttttccaaaggcacacccctttggggggctttggcctatagggaaaatgccacaaacttttttcattctgaaaggctgtgtggtgggaaccaaaaaacggggtggtccccctcccccaagtcctttntggggcaaaaaaaacggcggggtttggaaaaaattgaccttaagttcatttccccccctccaaggttgggcatggccgctttccgaccatggaggaaaaaaaagcatttttggggccccttaaaaaaaacccaatttcaaaggaaaaagggggtttatgcccgggacaaattttgcaggtggggggggttcaataaaaggtttttttccctgga

SEQ ID NO: 634847 - DNA, 1483 bp, Homo sapiens
  misc_feature (1)..(1): n is a, c, g, or t
ncctctatgatgctttgttgagacgacaaaagcaaaaaacaaaaggaagggttttttatattcgctgtatccaggtccgccagccaagaagacaatctcctgtgttggctgtagaccagccaaagaaagactcctggggttgtttcttgtaaatacaccccgccctggcgccgcccctctgtgtgtgtgttcatcaatacggggagagtgttttcggtggttatgttcaagaggtgggaggtaccaacatttttcggaggaacacccccgtgcttttgttgacgtagtatatccacctgcggccccccacattttttccctatctaccagaaatttgttgtgtgctccaaccacaccccaccaccccctactatataagcctccccctccacccgggtacaaccccttttttcttatcccaactaggagttttttggaaaattactttgttggggtttaacacccctaaaagaccccaatttccataaggactttcctagccccctttttatttccgtctcccacaacggtattttcccccaccaagaagataccttctgtaaagcagtaaaaatacgttgcatcggcaatagtccaaaggacccccctttctttataggagaagggaaaaagaggggggtcaatatcaacattcacagcgttgggttctcggggaaatagggccgccttttataaggaaaaaataaatgtttcgctcccccacagaggaactcttttgcccccaaaagagagaattttctcgtggtttcccaaaaagcccagggtgaccgccctcgtttataacaaataggggtgttgaaaagagagaggccacagagaggagagagaaattctctttctcgggtgtgcgcgcaaaaagaatatagatgaagatactgagacagataggagagagaccacttctctgagaggtgtgtgtggttatattatccgagaaggcctgccccacactggtataccccacaaagctttgagagagactgtgttaaaagctcacagagcacacactcgaggagatgacccgagcacatcgagatattttgaatcgcccacatgttaaaaaggagagatgagaatgcacacaccttatggccttataccacgtaataaattctccgcacaaattttcctcccacttatatcaccgccacagagaagtgcacaacacacgtaatgtgcgccacaaagctataaaatggcgttaaacactcacatgcgtacacctttaccacctataaaatcttacattatcccgtgagagtggttctgttatattatagcccacactgaggacacttctatagggaggtccacataacacacactcacgtgagcacagaatgtatgtttgcttaatttaatagcacacgtttttttttgaaaaactagtggtggaccacatttggatcaccaatttataccagttattaaaataaaggtttgattttggtcgtttcttcca

SEQ ID NO: 634848 - DNA, 1231 bp, Homo sapiens
  misc_feature (870)..(870): n is a, c, g, or t
  misc_feature (877)..(877): n is a, c, g, or t
gatgaccagaactgtgacgagcggcgtgtggggtgagttggtctgtgggcagtagggcctaattgtggtggctaggtagagtcttgagttgatgcattgatgtggtggctgtaacgtggaccagtcactggagatcctagcgggaggagagttcgcctggatgtgtgtgagaacactggccattactggcaggttctgaggctcatctacatggtactcttactacgagaagggagctcctatacgctggtctcgcagtatccaaatcatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccacgttacacatagtacaggtggtgtgtacagaagtacaccggggattcaccatcccngaggccnttccggggagtgcatacgggacttgagcaatgccagcgctcgggaagaatctcgactgtccacctgtccagatgatgaggagatcagagctagcctatgagcaaggggcaaaggccctcaaataagccgccatgcctagggactgcccgtcaaccccgctcacatgtgtctcatccacaaaggcccctggctggttatccacacttgctacacgctatggacacactgccaaaagtggccagtgggccagggaatcacgtaggagcacttgttccgggatggtgatggtggaagaggggatgagggaaagaaatgggggcctgagtcagattataactgtggggtgggatgact

SEQ ID NO: 634849 - DNA, 447 bp, Homo sapiens
ttaaagaggaggagacctccccaggccatttagcaaccccagggtcaaggggcccgagagagttatcaaatgggacacattaaacgctaactgcagcttttgccttggtttttcctagggcccacaatgggaaaacttccctccaaaaagaaacctatttagttattatttcccaactaaaccctccccaggtacaggtgaagaaaaaatggccagaggtcatatcctcagccccggtgggatttctttaattttaaagcccgaaaattcccatttgggggggggagggggaaaaggaaccccatttttttatgaacaaaaattttttacttaaaggcccaaagttttaaaaaattattatgggccccgggttccctgttttttggtggggcatttttttcacctgcaggcaaaattgggtttcaataaactttttcccccaattga

SEQ ID NO: 634850 - DNA, 114 bp, Homo sapiens
gcaaaacttaaccatgaactttctgatattggctaggagagcacgttggagagatcctgatgttgctatcagcaatctgtctgaaacggagagaagttggtcatgcaggaggag

SEQ ID NO: 634851 - DNA, 224 bp, Homo sapiens
tatgtcgatggggtaggggtggtgtgcaaatggaaacctcaggtaacctggacctccaactttagaagcccagagtacaggagaggtggggccttgactgccaataaatacaaagcttcgtctgccttgtaacaaaggcaggtgggcttagggcccgggagcctgacggcccaggcccacttggggatggggagcagttatcactcctctgccaatcaacaggg

SEQ ID NO: 634852 - DNA, 996 bp, Homo sapiens
  misc_feature (6)..(6): n is a, c, g, or t
  misc_feature (9)..(9): n is a, c, g, or t
  misc_feature (11)..(11): n is a, c, g, or t
  misc_feature (13)..(13): n is a, c, g, or t
  misc_feature (18)..(19): n is a, c, g, or t
  misc_feature (23)..(23): n is a, c, g, or t
  misc_feature (25)..(26): n is a, c, g, or t
  misc_feature (635)..(635): n is a, c, g, or t
  misc_feature (642)..(642): n is a, c, g, or t
gagggncgncnanttccnntccncnncgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccacgttacacatagtacaggtggtgtgtacagaagtacaccggggattcaccatcccngaggccnttccggggagtgcatacgggacttgagcaatgccagcgctcgggaagaatctcgactgtccacctgtccagatgatgaggagatcagagctagcctatgagcaaggggcaaaggccctcaaataagccgccatgcctagggactgcccgtcaaccccgctcacatgtgtctcatccacaaaggcccctggctggttatccacacttgctacacgctatggacacactgccaaaagtggccagtgggccagggaatcacgtaggagcacttgttccgggatggtgatggtggaagaggggatgagggaaagaaatgggggcctgagtcagattataactgtggggtgggatgact

SEQ ID NO: 634853 - DNA, 986 bp, Homo sapiens
  misc_feature (12)..(12): n is a, c, g, or t
  misc_feature (625)..(625): n is a, c, g, or t
  misc_feature (632)..(632): n is a, c, g, or t
ggtcttgccatntactccatggcatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccacgttacacatagtacaggtggtgtgtacagaagtacaccggggattcaccatcccngaggccnttccggggagtgcatacgggacttgagcaatgccagcgctcgggaagaatctcgactgtccacctgtccagatgatgaggagatcagagctagcctatgagcaaggggcaaaggccctcaaataagccgccatgcctagggactgcccgtcaaccccgctcacatgtgtctcatccacaaaggcccctggctggttatccacacttgctacacgctatggacacactgccaaaagtggccagtgggccagggaatcacgtaggagcacttgttccgggatggtgatggtggaagaggggatgagggaaagaaatgggggcctgagtcagattataactgtggggtgggatgact

SEQ ID NO: 634854 - DNA, 991 bp, Homo sapiens
ggatgctgtggcgcccgttgtgcgggctgggctgcggcagccctgggcccgtgccccacctggactggtgtgtcgggccccaggtgctgtggtgttgagtggtgggcttcgtgacacctgggagagagcaccctggtgaaaagggttgctccaggagcgagcagcggctaatctatgggcttcagcgtgtcccataccacgaggaagccgaggcccggcgatcgagaacggcataacgattactactttgtcacaccacgggtagtgtggatgcttagttcgtgaccatagcagtctggcgactatcatctgagtcatgcctgagttgctcggggagaactgtatggcacgagcaaggatgtgcggtgctagagcctgtgtaggacatgaaccggatctgtgtgctaggacgtggacctgcagggtgtgcggaacatcagaggccaccgatctgcggtccatctacatctctggtgcagccgccttcactgcacgtgctggagtccagcggctgcgggagtgcaacactgaaaccgaggagagcctggtgaagcggctggtgtgctgcccaggccgacatgggagagcagaaggagcccggctgtgtgatgtggtcatcattaacgacagctggaccaggctacgcagagctgaaggaggcgctctctgaggaaatcaagacaaggtcaaaggaccgggcctgagcttgctgtctgttctcggacccgggccaatacatgagcaaggaggagcattgagcagcccttggagcgaacgcagtctgtgccttggcagatttgatgggggggaatcttccgcgtggtggaacctggtggcccaacagagtctgggggcccgggcaatttagggacccgccgcagccccacaaacgtggttcactcaaaaagaaaccggtttggcgagaacacagcgcgatatcactttcagaaagcctatttaccaaaaacaaagtcatctcggaaggatacta

SEQ ID NO: 634855 - DNA, 917 bp, Homo sapiens
  misc_feature (73)..(73): n is a, c, g, or t
  misc_feature (146)..(146): n is a, c, g, or t
  misc_feature (262)..(262): n is a, c, g, or t
  misc_feature (281)..(281): n is a, c, g, or t
  misc_feature (317)..(318): n is a, c, g, or t
  misc_feature (362)..(362): n is a, c, g, or t
  misc_feature (375)..(376): n is a, c, g, or t
  misc_feature (383)..(383): n is a, c, g, or t
  misc_feature (391)..(391): n is a, c, g, or t
  misc_feature (393)..(393): n is a, c, g, or t
  misc_feature (398)..(398): n is a, c, g, or t
  misc_feature (404)..(404): n is a, c, g, or t
  misc_feature (416)..(416): n is a, c, g, or t
  misc_feature (425)..(425): n is a, c, g, or t
  misc_feature (427)..(427): n is a, c, g, or t
  misc_feature (448)..(448): n is a, c, g, or t
  misc_feature (462)..(462): n is a, c, g, or t
  misc_feature (473)..(473): n is a, c, g, or t
  misc_feature (478)..(478): n is a, c, g, or t
  misc_feature (481)..(483): n is a, c, g, or t
  misc_feature (491)..(491): n is a, c, g, or t
  misc_feature (502)..(502): n is a, c, g, or t
  misc_feature (507)..(507): n is a, c, g, or t
  misc_feature (524)..(524): n is a, c, g, or t
  misc_feature (529)..(529): n is a, c, g, or t
  misc_feature (545)..(545): n is a, c, g, or t
  misc_feature (547)..(547): n is a, c, g, or t
  misc_feature (586)..(586): n is a, c, g, or t
  misc_feature (613)..(613): n is a, c, g, or t
  misc_feature (735)..(735): n is a, c, g, or t
  misc_feature (756)..(756): n is a, c, g, or t
  misc_feature (759)..(759): n is a, c, g, or t
  misc_feature (784)..(784): n is a, c, g, or t
  misc_feature (813)..(813): n is a, c, g, or t
  misc_feature (834)..(834): n is a, c, g, or t
  misc_feature (836)..(836): n is a, c, g, or t
  misc_feature (857)..(857): n is a, c, g, or t
  misc_feature (873)..(873): n is a, c, g, or t
tatatgtaaatagcttcccacttctggacccatctgatgcaccttttccctaactcgattccccgggaaaagnaatccgaggaccacagcagcccatttggaagccctttccaaatcaagacagtgactcggtggtactaagtggnacagactcagaactgcatatacctcgagtatgtgaattttatcaagcagttttcccaccatccattacatccaggggggatccctccggcatcctaatccacacctcaatggaganacttaagacacatctgaanacagacatatcaagttctatgtgaagattttgggtnnctaatactataaatacttgattgtaaactaaatccaagaccatntatagaaaaatcnngcccacngctatccnanccccnccccgnattcactatatnactcttatntnttaaaagatcatcctggcctntcaaggagaaatangcctaaaagangaaanagnnnaaaaaatnggtagaaaacngtaancctttgtattcatgttnacagngctatgactataaggnanaattatgtatgtgacttagagttatataatcataatttntgtttatgtcaaatatctaagtttatngcttggatgtctagtgagagctgttgaatttggtgatgtcaaatgtatctagggtttttttagtttgtttttattgaaaaatttaattatttatgctataggtgatattctctttgaataancctataatagaaaatagcagncancataaacatctttgtaaatatcaancctaatacatttcttgtccagtgataaancaactggtagaattatttaancnctttagatttttaaataatanacatgctttaattttncttgtgatagctccatgatgaaattaattaaatattaaggggta

SEQ ID NO: 634856 - DNA, 110 bp, Homo sapiens
taacacagaaactcatcatttggtctgtatgcagtagctcatgcctataatcccagcactttgggaggctgaaaataacctttgaatctcgggctgtgttacgtctaggt

SEQ ID NO: 634857 - DNA, 430 bp, Homo sapiens
tagacagctagcctttgtaggattaaaaaattagccgaaagaatagaaattatggtttaggagtcacgcagctggagatgacaagattctgacactcctccaattgctcctggggataacattactattctaaggcctaacatcagtgcttgagatgttttgtagaccctgcccttgatggatcagctggtactacccagaccgataaactggctcgtcttatcttgtggcccccacccaggagctgactcaatgcaagaagactgttctgactccctatgatttcatctccaacccaaccaagcggcactgtcagctcactggcctccccctacccaccaaattatccttagaaactcagatccccaaatgctcagggaaactgattatgtttacccaatagcttggagtaataataaaactggcctgt

SEQ ID NO: 634858 - DNA, 1078 bp, Homo sapiens
gtatcgagccggcgtcggggagcggcggataccgggcggctgcgagggctggctcgacccagcattgaggtctcggcgtccgagtcctgcggtgcccatggggatctcccgaggaccttgtacccgcgcggattccttgggctggctttggacgacgctttcgccttcctgctgcctaggatccgccgacatgcacatcccatcgtagtggtccacggcggcggcagccggtcccatctccaaggcatctggaaggagcgagtgcaccagggcatggtcaagagccgcacaccgatgggcatacggcaatcctaccgggcagggcgggagcgccgatggatgccgtagagggagctgtacgatcgccctggaagacgatcccgacgttcaacgcaggttgtgggtctgtcttgaacgaaaattggtgaggttgaaatggatgctagtatcatggatggcaaaagactgtctgcaggagcagtgtccgaagtccagtgtatagcaaatcccattaaaccttgactcggatagtcatggaaaagacacctcatagctttctgactggccaaggcgccaggacagatatggaagcagctatgggggtacagaagatcctggagacaaaactggtgaccgcagcgcacccacaagcgcctggcccacgagccgcctgcacacaggtgctcccacacagactggtcacaaacccttgggacacgcgggatgatgatgcctagtgactggcacgggcatgacggcctacgaaaacactcaccacggggaacacgacaacaacagtgccggacgcgaaggggcccccacgagacatacgaaaccggcagagaactgccgccacaaggcacatccgtgaacacggaccacaccacacgggaatgtggaacagcacccaaacgagcgaacccgtgcaccaacgccccgtgggccacgaaacagcgcaccgtgcagcacaggcgccacacccgcgacacgtcacaacggcacacaaaggagacacacagagagcagacgccgcgagaagagtaaccgccacgagcgaccacgacaacaaacgcccacc

SEQ ID NO: 634859 - DNA, 897 bp, Homo sapiens
ggacgggaatgacaataactttgttacgcagggacggattgcaaaccgtgcactgtgcaaaacgctttgaccaaagaacaacgacgatgccaacagcttcgctttgccagctagaactccggaaacattcggacagaagcaactttcaaaccacttcttaactactgtcctcttgcttatcgtacttactggcctaactcctgccatatactgggtagtactctgacacgaactaactactgaccacgcacttgagcgacaacacaactcacttgcgctgacttctagtttcacccgagatctgcgtcacttacactaccaacgctcgacctatctcatcacacacaatccctgcgccataaccccctcctcaatcactcattcacacctccagctctggcctcatctccgccacattgctgccagctcttcaccccactccgccctgcaaactgtctccaatgcgggatctcgacaccctcgctacactcggtgccagcaaacctggcaccaatgtacctatggccccaacctggcccattgacagcgcattcattcacccacaggccacaaacacctacctggaacccatccaacgcatcgaattcgtctccctcatggcgccgcggcttccgggcagagctatccccattggcacattctcgtacaagcgcaacaccgaacggcggacttccaacttacacacccattcggaaaccatcaccccaaaccaatccaacgttaacacccgcaaccctaacacggtcacacattactcaccttcccaccatttgtactacgccccactactccctcctacaccgaccccaacctttacgcattactcatcagtcaacagtaacaaccctttaacacacacaccaccacccgctgagc

SEQ ID NO: 634860 - DNA, 197 bp, Homo sapiens
tcgtcgaccctcacggatccccgggacgttgagtctccacgtgggtttctgcgctaacccgcacttggtctgagaagattttgtgatctccatgattgtttgcgcacctgggatcacgacgtagctgaatcttccgattctcgccctcctccgcccctatgcctgctgctctcccccagtgaccaagcggggcatcg

SEQ ID NO: 634861 - DNA, 98 bp, Homo sapiens
ttttttttttttaaaacgggaagaaaaaaaattttgttgggtttccaccaggggttggggggtttttcccaggggtttttaaaaagatggaccctgga

SEQ ID NO: 634862 - DNA, 165 bp, Homo sapiens
ctcactgggtcagacccgagactccatgcaggagaattcaagtctcagcccagaacactggcggcggtggctggaggccccgggtgggaggtccctcactgggcgggaccccagactgccatgccagggaagaactcaaacctcttgtcagccccaagaacacca

SEQ ID NO: 634863 - DNA, 254 bp, Homo sapiens
ccgagctcggtacctggtacgggagtgggatctaaggcaatgaaacgtcccctgagatcatcacatctcactcgataaaaaagggcttcttggctcactcagtgaagtttgtagcatccgtctgggatttcaaaggtcttccctcaagcaaggtctgagaaggagaatgggaaagaaaagcagggcggtggctggttgacaacacactcataataaaaacaatgggtggaggccaactgccactcccgtaccag

SEQ ID NO: 634864 - DNA, 381 bp, Homo sapiens
ggggggggggaaaacttttttttggaaaaatcaacacctttgtttttttttaaaaaaaaacccaaagggggcaaaatttactttaactttaaaggggggctttttttaaaactttaaacacttttttttttttaggaaggaaaggtttttttttttttttttaaaaaaaacccttttttggccccaaggggttttttttttcattccaggccccattttttttgggaggggggaacaaacggggttatcccccttatttttaggggtttttattgcaaccaacccccttgcaagtttttttttaggtgggggtaaattttgttaaaaaagggcttctagggtttttgggccaagtgttaacccgttaaccaaaaggacctt

SEQ ID NO: 634865 - DNA, 756 bp, Homo sapiens
ggcggtggcggctgttgccggtactggacccggcgggatgagcgatggtggatggcggcagctggtgggctacagcggtccccgcggcgacggtgcccgcgacggcgtgcagggtggtagcggtggtggtaccggtgcccgcagtgggatgccgtcagaaagtgcgtgctggaggcgtgtgctgtgctgtggtgtgctggagcctgcctctgggcccctgctgctgtgtgaccccctcgtgcgcctgggctcccgtcacccctgggcaatcctggcgactggcggtctcgtgggaaccccctggcccccctggcccgggagtcagggcggacaagccggtgctggcaatccaagtcctgggcactgtcaaatggttcaacgtccggaatggttacggattcatcaacaggaatgacaccaaggacagatgtctttgttcaccagacagctattaaaagaaacaagcccaggaagtttctgcgcagcgttggagatggggagactgtggaatttgatgtcgtggaaggagagaagggctgcagaagccactaatgtaactgggcctgggggagtacccgtgaagggcagccggttatgcccccaaacgactgtaagttccgccgattcatcccccgtgctccctcagttgaccgagcaaccattgtggcagagatcccctcggcgtggacaggacatgacagtaaaggggagcagggctgaagaactctggcaaggggccgacgatggtgccccaca

SEQ ID NO: 634866 - DNA, 290 bp, Homo sapiens
gcggccgcgactactactactaaattctcggccgtgcgacttgattattttttttttccgttagaatgcgatctcactctgttgccaaggatggagggcagtggtgcactcgtagctcactgcagcctcgaaccttgggctcaagtaatcctcctgcctcaggtcctgagtggctgggaccaccggcacacatcacccatgcccagctaattttttttagagatgaggtcttgctgctttgcccaagctggttttgaactccggggctcaagcaagcgatccagtcgacg

SEQ ID NO: 634867 - DNA, 314 bp, Homo sapiens
gggcaggggggcccccccccctacttgggggccccggggagcctttacaagtgaaggtaaaagccgggctccccaagatttcccccccaaggggggggggtttccttcaaagggccaaaaccctggggggcccttttgggctgcccgggggcaacggccgggttaagcccccccgctttgcccctcggggggggggccctttgccaaagggttttttccccttttaaaacccggaggggggaaaaaaccttctggcctgaattttttaagcccccgccaggtccctttggggaatttaactgttggggttttta

SEQ ID NO: 634868 - DNA, 357 bp, Homo sapiens
gggtcttcaatagtgctttcagcagcaatgtatcctcgatctgtattcggctgtcattggactgtttctccattcaatagtagtcgaacattgcgtcagtgatagcatgtggatgtcatccagataggtgcacacttattactgatagggctgcctgtgtgagcatgccattcgtcaggtcacctctgccgtgaaatcgtcgttgtagtacataatcgcttccttcagttccgtgtaatcatgcatctgcatcatgcacttcgagcccatgtatagcgttgtcaccggcccaaatctgtgggcctaccgcgtgaaggcctcctggatactcttccattcatactgatgtaggttccc

SEQ ID NO: 634869 - DNA, 193 bp, Homo sapiens
ttggagacgaccgggcgcggagccgagcgaggagcatgacatcttcgtagatggcgatcgcgtcggcagtcgatgagaggtagccgttgcgtcgggcgagctgaacgatgccggtgcaccatctgagcagctgcgaatggtcctgttcggcgatcggatgcggcttggcgatgagttcggaagtggtggtctc

SEQ ID NO: 634870 - DNA, 940 bp, Homo sapiens
  misc_feature (161)..(161): n is a, c, g, or t
  misc_feature (207)..(207): n is a, c, g, or t
  misc_feature (219)..(219): n is a, c, g, or t
  misc_feature (229)..(229): n is a, c, g, or t
  misc_feature (286)..(286): n is a, c, g, or t
cgcgcgctcctccgacccgctccgctccgctccgctcggccccgcgccgcccgtcaacatgatccgctgcggcctggcctgcgagcgctgccgctggatcctgcccctgctcctactcagcgccatcgccttcgacatcatcgcgctggccggccgcggcntggttgcagtctagcgaccacggccagacgtcctcgctgtgggtgngaaatgctcccnaagagggcgngcggcacgggtcctacgaggagggctgtcagagcctcatggagtacgcgtggggtanagcagcggctgccatgctcttctgtggcttcatcatcctggtgatctgtttcatcctctccttcttcgccctctgtggaccccagatgcttgtcttcctgagagtgattggaggtctccttgccttggctgctgtgtccagatcatctccctggtaatttaccccgtgaagtacacccagaccttcacccttcatgccaaccgtgcttttcacttacatctataactggggacctacaggctattgaggtggcgcagaccacgaataatcctgaatcggcttgtgcacttctactaacatgctggcatccccaaattaagaccgaatgacccttactggggcaatggacaaagaccaagggtacattcttacaaaatttgggcttaagttgggacatggacttgttgggagcaacatcggattgctggtatagactgtgatttcagaaagaagacaactgtgacatccaggtggaagatttgtaaggcgcaattgtatgggcagttgttaataatttaataacggttagttaagaaagttcttagaatagtttgggggacaaaaagtactttataacgatacggtaaataaggtactgggtgacacatagagagacaataggtacacatgatgcaaatcgaaattggcatataa

SEQ ID NO: 634871 - DNA, 248 bp, Homo sapiens
tggcgcgggcgtggccgtacggcatcgctcggtacactgcgcacctttgccgccgccgcggcgccgctttgcgaggtctgcccatgtcccggatctgggaatcggggctgtaggcggcccgggccaggaacttgccgtcgtcggccaatacctccaccgtgtcgccgggacgggccttgcccttcaggcggccgacagagccggcgaagatccagggatggcggcgcagcagggagcgttccttgccg

SEQ ID NO: 634872 - DNA, 650 bp, Homo sapiens
cggtcggtaccctatgtctcgatcgttagagacaagacaaccaaaatgagaatttctagagcaatatccctgatgaacatcgaggtgacagtcctcaattaaagtactggcaaagcgagtccagcagcaaatcaaaaagcttatccaccacgatcaagtcaggttcatccctgggatgcaaggctggttcaacatatgcaaatcaataagaggtaatcgcatcacataaccagaaccatcgataaaaaccacatgattatctcaatagatgcagaaaaggccttggagaaaattcaacagcccttcatgctaaagactctcaataaagtatgtatcgagggaaggtatctcaaaataatgagagctatttatgacaaacccacagccaatatcatactgaatgggcaaaaacgggaagcattcctttggaaaactggcacaagacagggatgccgtctctcaccactcctattcaacatagtgttggaagttctggccaggtcaatcaggcaagagaccgacctaacgggtattcacttaggaccagaggacgtcaaaatgtccctatttgcagatgacatgattgtatatttagaaaccccattgtctcagccaaaatctccttaggtgataagcaattcagcaagtct

SEQ ID NO: 634873 - DNA, 482 bp, Homo sapiens
cggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaatattctctcacagatttcattcctgtttttatatatatattttttgttgtcgttttaacatctccacgtccctagcataaaaagaaaaagaaaaaaatttaaactgctttttcggaagaacaacaacaaaaa

SEQ ID NO: 634874 - DNA, 484 bp, Homo sapiens
  misc_feature (11)..(11): n is a, c, g, or t
  misc_feature (17)..(17): n is a, c, g, or t
  misc_feature (90)..(90): n is a, c, g, or t
  misc_feature (252)..(252): n is a, c, g, or t
tactcaggagnctgagnttgaaatgattgcttgagcccctgagttcgaggctgcagtgagccatgatctcaccacttcttccagcctggntgacagagcaagaccctgtctcaaaaaacaaaacaaagtgtttagatattttaaatgtgattttttaagggaaagtttacaaacattaacagcaatgtttccattataaaaacataaaaatcgtccatgggttttgtttttttgtttgtttgtttgtttttntgagacagagtctcactctgttcctggtggcatgatctcggctcattgcaacctctgcctcccaggttcaagcgagttttgtgatcccagctactcttgcctcagccacccgagtagctgggatcacatgtgcatgccaccatgcctggttaatatttgtatttttagtacatacagacgggtttcaccatgttggccaggatggtctctaacttttttttttgaggcaggg

SEQ ID NO: 634875 - DNA, 255 bp, Homo sapiens
tgtacattttactctctctacagttttctatgtcaagagtgtctctatgctaccgtaattacagtgattagaggtctgtggcaacttaagttgactagattctatcttggacacagctatcaccagctcggaggttgtcgctctactataatcttccactatatgtacatagacgggtgtgctctttagctgttcttaggtagctcgtctggttcgggggtctataactttggctcccttgcaagtattctagtt

SEQ ID NO: 634876 - DNA, 1576 bp, Homo sapiens
  misc_feature (5)..(5): n is a, c, g, or t
  misc_feature (348)..(348): n is a, c, g, or t
tcctnccctcccgcaccatacagtagcgtatgagccggaggcagcgcgagaagcagtgcgacagagcagggagacagaagaagaaggaccatcgcctgtgtggtgtcccgtcgtattagcgatgcgggtggtcttatgacccctctattatgttgcacggcgtcctgttttatgatgatatacgcagggtttgtgttctccgccctccctcattctgcggggggactatttttctgcgcccccatactgagtggttttcctccctcttgtttgtagggtgatggtgtgtggtcccctctgttcgcgcgcgccgctctgtggtgtgattgtgcgtgtgcgtacgtgctncgtgtcgcctccgacgggtgtccgcaaggcaccaggcttgcttttggtggggggacacccttgttggacatcttatgtgcgggtgcctcccctgtttatgtgtgggatcgttgctgacaccccagagcttgtggtgtgggaactttatgcggtttgtgggacgtctgctttgccccccagcggggagatttctgccttgtgttccccccggagctccccatgaggtggtcttgacagggtcccttttcctgagtggccctagtgtcccccgtcgtgttgcccccggggtgcccttgggggagcccacaattgggggtcccatggcgttgcccctggcccaagaacccgtccttgtgatcccaggtttttggatgttccctcccccgggtggccacatgggaaattgggctccagtgtgcccttatcccacggaagatgctgggccctctttgggccggccccccccagcggagcacggccgggggtacaccaaggggtgttacacgaagttattttcccccggccgcctcttttggggtgttgtcccgccggtcacattgtgcctgtatatgtgagaggacaatcgccagcaaatggttgggggtccacatattgtgtcgagaatgcctcgtttgggccccccttgtgggccactctcaccacgcttcactgaatggggctttctctctccctggcgtggcccacccaccttgagggcccccctcgtggtgagaatatactgttctttcttccgcctgtggagttcccgcgcgctcttacaagagaaatatttcgccgcgtattgtggttttcttcttcgaatgtcccactggacccagcacacctcacgcacagccacgtactcacgaatattgtttcacagtgagaagtctgacaccacaagtcccacaagtggccccgcggagagtgttttggctggctgtgcacggacccaaagggtcacaatccacccaaatttgtcccttacctgattgctggcactcccacacctcactgccacggacacttggggcccaagaggcttgagccccagtccgaggccctgagtgtaacttctggggagcttatagctttgagaaagagaacgtcctcacgcccacggtggaaggtggcgtccctagacctcccttcgtatgagaagacggcttttctgaaaagggatcccgcccccctcctcggtttttttttccaataaaagttttgaaca

SEQ ID NO: 634877 - DNA, 389 bp, Homo sapiens
tcacatacatcatttaaagaggatttatgtaaattttctctgtactcataatttttcaagcattagtgcagtcataagtatagggcaccttggcttgatttaattattatcgtttctaattcagcacactttattttattttattttattttattttattttattttattttattttattttatttttgagccctgattgctagttcattctcaatcattagcatttagaagaactagtcattactggttttcaatagctgcttgggttcctataagcacttagagtcttaaaacacagaaatggaaaacagacatttcaaaggtagaacaaatcatgactcctagaggtagggtacaagaatccctgggtgcgtgggcactgaagcac

SEQ ID NO: 634878 - DNA, 133 bp, Homo sapiens
gcccctttttccccgggggccccccccccattggggccccccgggttttttttcccccccccccccccccccccccggggttttttttgggtaaggtggggggggaaggaaaaaaaaaagggattttttgcca

SEQ ID NO: 634879 - DNA, 578 bp, Homo sapiens
cactcctgcatcctctctcacctctctcctgcgtcctctctcagccatctcagcactctcacgtgatggacagagcagtgttcatgcacgtgggtaggggagaattcatgtgaaccaacgtatgagagacagtgccccattgacgatgactgcctgttatgctgttgtgagatccctcttaggaagctaaagataactcaattaacattaagcctatgtagccagtcatggtaccttgtcttgacccgcaagacaaagaggaatggatctatttcatcatattgtgtttaatcaagtggtggacatcatgctaaagtaagtttatatgcagtagctcatgtaatacttgaacaaaggtaggtactaattactgtactcattttataacatgaaacatacagagacttagtcaggtgaaataacttgcataatactataagtcatgaatgatagcagcgcatacattatcctaggtactacctaccttggccattctctggcttaatctcacaatcatggcggcacggcaaggaggcagcacagtcatgtcttaatctctatgccactatgatcctatc

SEQ ID NO: 634880 - DNA, 991 bp, Homo sapiens
gaaatacactgggtttttaaatttgggggggcccgcccccttgtagaggccttttcaaccacgttttataaccctggaccccgcccaatcctccccgtggattaagaaatttccctccggggaggccacacaccaatgtccacaaaacccccgaaaagttttctccacaagagggaaatttttcggcaatttctgggtagtcaacacaacccgaggagcaaagaaggaagctctttcccaggcaccaccaacaggcgtctctgagtccacgataaaattgtacaacacccgttgttttggggaaaaggggaccacactttcctttttttgtcccccaccaaccaacgggtttctcccgacagtatacacaaaaaaggggtgttctgagagagacaacactttgggtgttatttgtccgagtggtcttttaaaacatcacatcctcccccgaggtgacccccccgcgagaaactaggtgttgggcacacaacaagaccacacaaacatctcccgcagagagtgttctcctccaacaagaaaattcttgtggacccccatttctcaaaccgcccacatttttcccgcggtgactacttttaagagtgaaatcttgtttgaccaccaatccacccctccaggggttcatgagagggaatatattttttggggatattccaacaatgtggcagaaaggttatcaagggacccaggagggggctatataaagagtatctcatttgtcgagtgacacataaccaccacacaccccttggggtctccatttttttctccctaaacacacgttttgcgcgttgctgacatagacacccacaacatctctctgcgcgccaacatctcatttttggagaacaccaccacgacagtttttttaaaaagccacccccaaaatttttgtgccccaaaaaaccaattttttggggcctggggaaccaaggggggcccccaaaaaaaaccaactttttgaaaggga

SEQ ID NO: 634881 - DNA, 653 bp, Homo sapiens
tactgctgagtaatatgcaattatatggttgtactacagtgtgtttatccattcaccagctgaaggacatttgaattttccccagatttagtgattatgaatgaagctgctctatttgcctaaaatttacataagcgtaagtgttcatttctttttggtaaatacataggaatgaaattgcctgatcacgtgataagtatatctttaactttatgagaaactgcaaactgtattccaaattggctctaccattttgcacccccatcaacaaagtttgagtgttcttgttggtccatattgttaccagcactgagtattgttgctttgttgttggtacttcaaaattttagtcattcaaataggtgcatagtggtatctcttgtgattttaatatgcattttcctaatggctactgatattgaacatcttttgatgtgtatttttgccacttgtatctcttcttctgtgatgtatctgttcaaatcttttgttcttttttaactggtttgttttctattttttggtgtttgagcatttatatgtattattgatgtaagtccttaatcaggtaatgtgatttataaatatattcatctattctgtggaaagttttctcattctttcaataaattaaagttgtatattttgaaaaa

SEQ ID NO: 634882 - DNA, 163 bp, Homo sapiens
taactcactggcaagaatgcagtgttgggcctttcaaccactagaacaaacttttttcaattgacagttgcagaattgtggagtgtttttacattgatcttttgctaatgcagttagcagtatgttttgcatgtatgaattaataaatccttgaatcataaaa

SEQ ID NO: 634883 - DNA, 876 bp, Homo sapiens
gaaaagaagaagagcgagggacgttttacaagtgacgcgtctactcgttgatgcggattaaatctgctttctatgcgccctaatcttctttgggatcgtcttaaagcacgttgtcccgttaaaactttgccgctgggcatatctctggattcggcctattcccctagtttctacgttcggcgcaagatttggtcaggccattgtcaatgacatttttacggcggggattgcccccacattcgcacaggcgagctttccttttcccaatctggcgaggtctttttcgcctcctccgaaccgaagggagtttctggccccttgagcccaggggttccgttctgccgggaaacacttgtcaaatcacctgtaggaggcaccccagaagttacaccggaaccatcatctctcccgggtgtgaaacatcgaaaccatttacagggcctttaatgtgttccaagagcgcagctgaagagttccctgagcatccgcggggctctcttccgctcctcaacaaagaaacgagacatggtgttgcgagagtgcacccgcgagcaacaaggcggttgtttgtccctccgtggaggatgaaacctcccggggtgcaccccacaaattccggcgcgctagttcacgcacaaatgattctacaggcgcgctttgggagttgcaagggagtacggggattcactttggacttcaggacgtttgacgatcacgctttgtggtgtacagaggcgagactagcatagtctcttcttgaaagagaagaaaaaatatggagtcttgtctcatttggcagacaccctgtaattcactagtcctcgtgggagtctccccaaaaaatttgggacacctccgactaaaacccaacaatga

SEQ ID NO: 634884 - DNA, 319 bp, Homo sapiens
tgtatgacaggttcacgtgagtatagagaagcagttgattggtatgtgtaggtctgtatcctcactagtcctaggaggttgtaattattagttatttgcttgtattgtatgtcgtgcccatctagctgagagcaccatggggcaaggactgggtccgatccctgtcgcatccccagcactagcacagtgcctgaaacacaggaggcacccaataatcattccagaaaaatgagtaacagaaaggtgctatcacttttatttcgcttctgtatcatcaacactggctgtgaaagacttgggataaacctcatgtcataca

SEQ ID NO: 634885 - DNA, 478 bp, Homo sapiens
tataggcgcataagtcatgttgctgtccagatctactgtatcttcctccaggagcaaggcatctagctcctccagccgctgctgaagcaggtggccacatcagggctgggggccacattgtgaggaacagtcctgacccctgcagccctggaccccacgggacggacttcgtgatacgaggaaggctgctgtccctgaaattccacagcccgcctggagcttccttgagcttggctgaaaatcagagtcccattgctgctcccgggtttcctcaaagatggtctcaaaggtcctccatggtatgtgggtgattggtactacttgtaaggtgtcaatttcttccaagctgaactccttcttgtccaacctgattggacgaggcagtcccattgtgtaaggtttagctgagtgacgggctgatgttcttgcggtatactgaatcgagaaactttccccatggtcttggtctcagggtctg

SEQ ID NO: 634886 - DNA, 227 bp, Homo sapiens
agcgtgtgttggggtcgagctttctgataacgaggctgtggagcagcacaggaagctgcacagtgggatgaagacgtacgggttcgagcttttcgggaagcggttccctggataagttttcggcttagaattcaattacttgctattcaaccgggttccaaaaccttttttttttatcaatgccgggcacaatttttcagaggggttttccctagacacacacagga

SEQ ID NO: 634887 - DNA, 242 bp, Homo sapiens
caattctattagtcaaaaaagaaaagagggatacagaataatatctaagtaatcaaaagatttccatctccccatcaacttatacagcagaccttaggccaccatgccgtatttattcagtatcccctgcaaattatagaaattgaaaatgagtgtaaagcatattagttacttttccaaaatccttatgaagccaaaggagtaaagaaagaacaaaggaaggggtgaggaggtaacatgga

SEQ ID NO: 634888 - DNA, 955 bp, Homo sapiens
cattcgacccggctttcgtgaattggcccccacggttggaaacttttttcccgcccctgttctttgccagatatccctcggctattgagtgtgcccccctatccttggtccaaggaatctccggccccaaaaaatttccctcgcgcctccaaattgggtctccagaccaaggttccgcctcccagaccaggtcctcctcgatcagtttggaaccccccaactattgtgggccccgcgcgtatactgacgcaccgcagggggcgctggtctccacacaccacagtggaacaccccctgtctggctacggccgcccccctggtggtacgctgccccgcaatttcgcctcttttccgccggaaacaatggtgcaccccacacaacaacgcgggcgggggcccatagtctatcacaggagccaactcttctcccatagccggcatactccgaggctgccctcccgccctgcaccaccatgcgctgccaccaggttaaccccccagctctgtgcaacaaccgcgggcccgccccgccagagtggagcaacaccacctcccctgtggccccccttacaggggccctccactacaaatgtgcccccccccacccacggtgtgagaagcgcttcctggcggggagaatcttactctaagtccagaccgctcgaggtatcccccctcttcctctacacgcggtaatccttctgcccaacgagtacgcgccttgtcaccccagttctcttgcaccgggctgttaatcaagagacaaacgcacgaaatggtaggcggctcctaatgtcgaacacaccacaacaagaggtctctcccttgtccttgagtcgcaccaccagccggcagcgatgttatggggggcaaaaatgtggtgtgagagatgggccgccccagtttaccccccccctcttttttcccaataacccctgcccaccaaaaaaaaaac

SEQ ID NO: 634889 - DNA, 200 bp, Homo sapiens
gccttgccacatacaccaataacagttctaatggcagcaccagtacccttaccagtagatgtagcagttagatctctgaaagaaccaccaattataattgtaccagaatctttagaagcagatactaagcaggacactatatctaatagtttagaagaacacgtaactcaaatattgaatgagcaagcagatatttcctc

SEQ ID NO: 634890 - DNA, 379 bp, Homo sapiens
  misc_feature (94)..(94): n is a, c, g, or t
  misc_feature (96)..(96): n is a, c, g, or t
  misc_feature (103)..(103): n is a, c, g, or t
  misc_feature (106)..(106): n is a, c, g, or t
  misc_feature (110)..(113): n is a, c, g, or t
  misc_feature (129)..(129): n is a, c, g, or t
  misc_feature (141)..(142): n is a, c, g, or t
  misc_feature (152)..(153): n is a, c, g, or t
  misc_feature (157)..(158): n is a, c, g, or t
  misc_feature (164)..(165): n is a, c, g, or t
  misc_feature (168)..(169): n is a, c, g, or t
  misc_feature (173)..(173): n is a, c, g, or t
  misc_feature (304)..(304): n is a, c, g, or t
  misc_feature (320)..(320): n is a, c, g, or t
actctctgcctcccagaattcaagtatctcctgcctcagcctcctgagtaactgggattacaggcacatgccacaacgccgggctaagtatttntntttttanganagannnngtttcaccatgttggncaggctggtctnnaactcctganntcanntgatcnnccnncctnggcctcccaaagtgctgggattacaggtgtgagccaccacacctggccttgcttcttagatcttaagtctttatctcctttctttcaaactgaatagccaacttcccaacaacattaatcaaattactcanttgttttaatgccacnacatacacagtagcagtcttagaattacatcactggaatcgtgaggtggaaggatggta

SEQ ID NO: 634891 - DNA, 215 bp, Homo sapiens
caaacatttaaaaatgcaattttttgcagaccaaggtataattttaaaaaatgcaaattttctaaagagacacatctcttgaaaaatgagatgatgtggccaggcgcagtggctcacgcctgtaacccagcactttgggaggccgaggcgggcgggtcacgaggtcaagagatggagaccatcctcgccaaacatggtgaaaccccatgtctact

SEQ ID NO: 634892 - DNA, 254 bp, Homo sapiens
tgggggacatcttcccctcatcactgagcatgcacagccgacccatttattagcaacccatgtggattgcacttgcagggttgcatttcagggcccttttgcccgattcagacttcaatttccgggccacaatgacttgccaaagttcagggacagctgcctgcacatgccatgcaaagtttcggggtactcttctccctggctgcagtcacctgctttgagaccctgccttacgtgccaacccaccctactgg

SEQ ID NO: 634893 - DNA, 551 bp, Homo sapiens
  misc_feature (25)..(25): n is a, c, g, or t
  misc_feature (42)..(42): n is a, c, g, or t
  misc_feature (77)..(77): n is a, c, g, or t
ttggttgggtgatctttagtcagcnccacataagatgttcgntaaggccaagttacatatgtgccgtggtctcatangttataatagaattaaaattcctattcctaagtgacatcatagttgcccataacatcacagcacaatgtgttactcacatgtgcgtgatgatgctggtataaacaaatctattgtgctgccagtcatatgaaagtatagcacatacaattgtgtatggtacataatgctaatcatgataataaagattatgttattggttgacatacttactatcctatatttgttattttagaatgtaccacttctacttataaaaataagttaactataaaacaacctcaggcaggtccttcatgagatattccagatgaaggcattattacagagatgatagctccatgtatgttattgcccctaaagacttctcgtggagcaggatgtgaatgtggaggacagtgatactgaacctgaccctgtatatgcgtggattaatgtgtgtgtttgtgtctttttaacaaaacagcttaaaaagc

SEQ ID NO: 634894 - DNA, 473 bp, Homo sapiens
tgtcttttatgtgtgtttgatttatttttttaattttttctagaaattaaaggccagaaaaatccccacttttatccccactggagggtggggtgggaaaaacgcccctggccccggggacaccattgtttccttttaaaacccaggggaaacagggaacaagggcaagtccggggggggggaccactgtcccccaaagggggaattgttataaaaacgcttgggggggaacacttaagccaccaccttggggccagaaaaccaggggccatggggggcctggagggccttatgggtttaaggggctttggaaaactccaaaaagattttgaaaaggattttggcatccccctccccccccttgtttttttgggaaaagaaaacggggttaacggccccaaacttgccacactttttggaaacctcccctttacaggaataatggaggtcctgtggggcccaccatgttgggc

SEQ ID NO: 634895 - DNA, 718 bp, Homo sapiens
ggagagagagagaactagtctcgagtagtggtttttttttttacttataaaaatacggagtttaattccacatgtattattttggtctccccaccatttccatgtctgaccaccgctactactatgtcctatcataacattccatacttacttaaaaccaagcaaagggtggagtctccatctttaaaaactaaccggcttttgggacaacacattctgtggcaataaaacctggacaacttttatcaaacacggtagggaaagttctcactctgctttataaaagggacagccagatatcacctgttacagaattgcaaatacagagggaaaatttttttaacaacatggtttaaactattttcttaaagagacttcctccattgccagagatcttgaatagcctctgggtcagtcatccggaagcaattcttcacataatggatgaattgggctcccacttggggaagagaaccacctttttctatactggctggcatatttggctctaaaggtcttctacagaactaggtccttagggggttccaggagtttttccctgtttcttggaaggattctggtcccttctggatctgggtcgtcgatgatgggtcttcgagtcttgccattcctgattggacttttggagcatagcggctgaagtatctcgtatagatttcttcagggggctttccttacagcttccctcattaatcaa

SEQ ID NO: 634896 - DNA, 162 bp, Homo sapiens
agagagcgactaccctagaacaagcgacctttcagccccactgtggtgtgactgacaggagcatgtagggcaatcccggcaccacattattagggacctctgacacactgcaacagacccaacagaggatgaccaggatggcaaggttcctacaaaccattt

SEQ ID NO: 634897 - DNA, 858 bp, Homo sapiens
atgcccctcatttacatatagatattatactatgacatttagccatctcacttctagcgaatactagtatatcgctcacactctcatatcctccctactatgcctagaaggaataatactatcggtgtctcattatagctactctcataaccgatcaagagccagtccctcttagccaagtattgtgcctcattgccagttagcgtagatcttgtgcgctgcctgtcgaatgactagacggtggtgcctatgcctccatactagtgctcagatctccaacatcatatggcctagattacgttacataacctagagctactccagtgctaaaaactaatcgtgccaacaattatattactacctactcgacgattactttccaataaaaacacataattgggagatcaacacgaatccacccacaggccttaattagttacgcattcgatcccgtctactatttctttgaaccaaagtcaacaactaccgtatttatgcttgtttgcccaatccttttcctccgaccccactaaggacccttgttccttaatagctaatgtacctgacctcctaccccccgtcatcacctgcatggccaagcccgaatcgcccatttatccagatggatggccagttatcacccaaagtaaaaatggctagcttcgtctatgactgaattctgtcggactgaatctccgtgaacttatccacgatggacgagtgcggatgaaactaatcttcatcagatatggttccttcggaaaccagaggttatccccggcttggtgtcatgcacccgatgggggcccgtccgaaagcctgacgggttctattcctgtctccactataggtccctcc

SEQ ID NO: 634898 - DNA, 479 bp, Homo sapiens
agccccacgatgatcgcccagatttaaatttcgactggacaagatctcactgttctctcgaagagctcaaattaatcaacaatgcgcgcggtttaccagaacaatcacagagttgaagtaaggactgtaagtactacggaacagctcacacacctgcgatatgcttgtgactgcctgacgctttgcgattatgaatgcttaatgataccctatcactatgatgatggactcattagccattctcaagaagaaccgcctgacgttgtggcagaggcaccgtaaagtattacgaagatttgacgacttggaactgagagttgaatcatttcagcccgtgtggcagattggtaagctcttgtgtatgcgaaatttgttagcaacatacagcttgaatgtgatgaaagataaagattacataatgctttggtgagttgaataaaaacttccaatattgtgtacctggaagaaaggaccacata

SEQ ID NO: 634899 - DNA, 348 bp, Homo sapiens
cacgaggtgacatcgcgccctaagacagaggttgacaccgttctttttttcttgtgatggagtctcactctgtcgtccaggctggagtgcagtggtatgatcttggctcattgcaacctccacctcctgggttcaagcgactatcctgcctcagcctcccgagtatctgggattacaggcacccgccatcatgcccagctaactgttttatttttgtatagatgggatttcaccatgttggccaagctggtctggaactcctgacctcaggtgatctgcctgccttggtctcccaaaatgctgggattacaggcgtgtgccactgtgcctagctaaggtttttctaca

SEQ ID NO: 634900 - DNA, 276 bp, Homo sapiens
ggcccccgtacccctaaaaatccacccgccaacttcatcggatccggcgtcaggtagcgaccaatatccggattgtagtagcgatggcggttgtagtacagtccggtttccgcatcgaaatactgcccttgaaaccgcagtggattgtcgactttgcccacgtcgagccgggcgatctggccgtaggcgcggtagtgggcggaccagacgatttcgccttcggtgtcggtcagttcctgcggggtgccgaggtggtcgagttggtagatttttagg

SEQ ID NO: 634901 - DNA, 187 bp, Homo sapiens
tttgtattagatcattatgggtatcttcttgtacccgcagtgccgtcatgcagacttcatcctttagggagctaatctcctatttcaggtactgtatttacgattcctttaaccgctataagacctcttgttcataggcatccttgccctgtgcaaggtgtgacccagcgatcatgagtaccgagct

SEQ ID NO: 634902 - DNA, 752 bp, Homo sapiens
tcagttctcagttctaggaatactatggtatatcgctcaccgatctctatatctccctactatgcctagaaggaattatactatcgctgttcattatagctactctcataaccctcagcacccactccctcttagccaatattgtgcctattgccattacttagtctttgctcggtgctgcgtaagcatgcggtgggcctagcccgtactagtcttcaattcttcctaaaactatatggcctagactacgtacagtaacgcgtaaactctactccaagtgctaaaacgtaattcgtcccaatccgacatttatattactaccatctgacatgagtttgcaagaaagcacatgaatttgatatcaactagcgaagccagcccacagacctaatgattagcatgatccctctactatgttctaaccaaatcagacaacaacgctattttaggctgttgcccaagcttatcctccgcaacccctaacagatgcctccttccgtaattacctaaactgaacgctgactccgtaccccatcacgagtgatggcgagcctaacgccagcttgtccgacggggacccaatactcgacgacctcccacctctacctctcttgatatagattctcgcatacaaaagctccctttattatacacgattcccagcccagcgaccctaattcatctcttcatatgtgtctttagaagcccactgctttgccccaccctgggcttaatcgtcagccggtggagac

SEQ ID NO: 634903 - DNA, 221 bp, Homo sapiens
  misc_feature (45)..(45): n is a, c, g, or t
atcccatctggaccaggtgactctactcgcatgagtctcttgtantatatggtgactaccagatgcgtgcatccaagcctggctaatataagactcatgtcttctacaaaattattttgtgaagcccctatcacaagaaaaccttaagggaaatctgatggtgctcaggaatctaactctccctaaaccatcctctataactgcttactaaaatactctct

SEQ ID NO: 634904 - DNA, 312 bp, Homo sapiens
gggggaaggaaacatttttttggaatcaaagggcaattttacgttaagccccaaatgctacaaaaaaattatgaaaataggccttaaacaaatttttcctaaattaacctccccacatgtgaaaataaattttggaagtaaaaagggggggtttggttctggtccctaaaaataaaaacgtgcagggactgcagttttgcacttttggggtggggcggtttttctgagtggctggtggtgggtttgcacgtgagggcacataactgcttttttcgtcaggaattttgcaagaccctggaaagaaaaccaaat

SEQ ID NO: 634905 - DNA, 594 bp, Homo sapiens
  misc_feature (467)..(467): n is a, c, g, or t
  misc_feature (478)..(478): n is a, c, g, or t
  misc_feature (495)..(495): n is a, c, g, or t
  misc_feature (500)..(500): n is a, c, g, or t
  misc_feature (513)..(514): n is a, c, g, or t
  misc_feature (540)..(540): n is a, c, g, or t
  misc_feature (544)..(544): n is a, c, g, or t
  misc_feature (549)..(549): n is a, c, g, or t
ttctgatgtatctctaccaaattcatagtctttggcaatcatttggttctcctacactcttatttggtaacttatctccaagtgtattattggttatttccagtgaaatttggtgtctactttgtaaccaggtttttgtctagaaccattttatttacttagggcaatgttgctatatttgcatgcaaagtacacacagaggaggaatgcaaatttgccgatacagtaacaaaattcacagggtatttcctactgtgatctatttttagactgacttatataaccgattctcaaacactaaccttatttcaaatgatgctatctgtgagttttcattaagaaaaatccggctggccgcggtggctcatgcctgtaatcccagcacttttggaaggctgaagcaggtggatcgcttgagaccaggagttggagaccaagcctggtcaacaccggagaaaccccatctnttactaaaggnccaaaaatgagcctggngcggnggcacaccccgtnngcctagctactcaggaggctgaagcncaanaattnttttaaccccgggaggccggaggttgcagtaaatttaaaattggg

SEQ ID NO: 634906 - DNA, 474 bp, Homo sapiens
cggtccggtgctgccaaagcactgagtagaagaaaaggggccggataaccagcaggcctggcagacaacttctggctcccttgccatttaaggtcccgaggaatgtggagacattggtgggggccaggtgggtttggaaggacggattttttcctctttgtctctatctctctttctctctgtctttttctctttctctcatagcttatgctatgattttgtaaaaaaaaaaaaaaaaaaaaatttctattgtctcaaaattcctcatttgaaggcttttttttttttctaaatttaaatttttttctccttatactgtccggggaaagggacgcttttttcacccaaactgaaagggaaaggtcctcttttttattctattactcacttttcccaaaacttttccttatttttgtacttttggcacagtttttgttgattacttggaaggcgatgtgtttagcatacggagct

SEQ ID NO: 634907 - DNA, 121 bp, Homo sapiens
catctacaggatccccatcatgcgcgttcctggaggaataactagaaagatactatgtcggttgtgaggtgtaaaggccaaggtgccttacctattggatattagtatatatagacatatt

SEQ ID NO: 634908 - DNA, 205 bp, Homo sapiens
  misc_feature (8)..(8): n is a, c, g, or t
  misc_feature (188)..(188): n is a, c, g, or t
  misc_feature (205)..(205): n is a, c, g, or t
cttgggcnaccccgcttaccaaacccttgccgggcggggggttgggcccaagcaattgggccccaagttggacccgcccgaagggggctttcccaagggaagccgaagttgccgggggccgccaagccgggggcccgtccgccgggaaggaaggaagaagccgggggcctcgggccacccttactggnccccgtttttgccgggn

SEQ ID NO: 634909 - DNA, 147 bp, Homo sapiens
tagcagcagcagcagaagcaacaacaacaacaacaacaacatgtgacaatgctggccagggaagcaagtagaacacactgcagcactgtgggcaagcaagcttgttcaaagccaaggcaagcaacagcaagcttgctcaaccttgtg

SEQ ID NO: 634910 - DNA, 114 bp, Homo sapiens
ctcgtacccgtaaatgcagcgtgagcgatgaaagcgacctgcagatgatgaaggcagaccgaagccccagcgtgcaccgatccggtcaacgatccgtccccataaaagataaga

SEQ ID NO: 634911 - DNA, 221 bp, Homo sapiens
gccaaacttcatttatttaaccttacacaccgacattaaaccaaatgttgagtcacaacttcagtcacaatcttaaacaaaacaaaataaaaaggacttcgtaataataggttttgtagatactacagcccatgaatgacgagtcacaaccgagtttaggtcatttctttccactcttcttgagcccagaacctccaaaagcacccttctgtcgtcttctc

SEQ ID NO: 634912 - DNA, 196 bp, Homo sapiens
tactacccaggcctcttggacaccacattcttggaatagaacctgcacaacattcatcacgacacggtaggaaacgttctcactctgcattataaacaaggacagccagatctcacctgttacagaaatgacataagacggaaaattctttcacacattgattaaactatttacttaaaagaggctatacctccac

SEQ ID NO: 634913 - DNA, 794 bp, Homo sapiens
  misc_feature (54)..(54): n is a, c, g, or t
  misc_feature (282)..(282): n is a, c, g, or t
  misc_feature (284)..(284): n is a, c, g, or t
cacgcgtccgcagggatgctgctctccacttttcaaggtggggtccttgggggntacgaagaattccctcatctttctctactgtaaagtgatttgttgcaggtaagaaaataatagatgactcaccacactctacggctggggagatcaggcccagcccataagagatctacgctggtctcaggacgtgttaagagatctgggcctcatgtagctcaccccggtcacgcatgaaggcaaaagcaggtcagaagctatactctgcattatctcaaaatcttntngagatggggtcttcctctgtgcccaggctgagtgatggtgccacttgggtctgtaacctccgctcccaggtcagtgattcttctgcctcgctcctgatagtgggattacggtgtgcccaccgtacccagctaattttgtattagtcagagcacgggggtttccccatgttgggtggggctgggtcttcgaaacttcctgactcagggtgatccacccgctgagcctcccaaagtgctgggattacaggcatgagccaccgcgccgggcccactctgccattgtctaagccacctctgaaagcaggttttaacaaaaggatgaggcagaactcttccagaacaatcaccttgtgggaactgcttgtgacagtgctgaggtccccaagtgtgtgaacgaaggggcggcgggaactccctgacatatctagttaaaagggcagtatgtctaaacctcacaagccgattttgagccgtttaaaggcggtgtcagggtttccactcaaagcccta

SEQ ID NO: 634914 - DNA, 771 bp, Homo sapiens
ggagcttaaagagaaagcagtggccgggcgcagtggctcacgcctgtaatcccagcactttgggaggccgaggcgggtggatcacgaggtcaggagatcgagactatcctggctaatgtggtgaaaccccgtctctactaaaaatacaaaaacaaaaacaaaaaatttagccgggcgctttggagggcgccttgtagttcccagatactcgggaaggctgaggcaggcagaaatggtcgtgacacctggggaggcacgcagtttgcagtggagcagagaatcgcgcccgtggaactccaagcctggggcgacagaagcgaggactccggtctccaaaaaaagagcagagcagtgcagacagggcaatgtaagaagccgctattgcctctacccattttggttctcacataaggctagaaaatgtctacagggaccaggggccacacaagaccctaaatgtcggtacatcagcacggactggttcactaacacacttgtactgggacgtacatcattaggatgggaacaccctggggggtttaccccgaacagcgtggttacaccacggtgggacaacggcgggccaacagtaaaaaataaaccgggggctcaagcaccggcgaaaacacaacgtaaagaggcccaacgtaacagggacgaggagtctaggggactccacagtcgactgaagcaagaggacacgcgaaaagccattggcccccggggggcaacttggggacaggacaacccatagagggggcgtggaaccca

SEQ ID NO: 634915 - DNA, 139 bp, Homo sapiens
ctgatctagaggatcccgagatggtgtcaatccctgtgtctccatcactcttgtttgggggcgggtctctgtgcaccttgtatatcttcatactagtctagagtattactagttgggacactgccagcaccgaagctga

SEQ ID NO: 634916 - DNA, 775 bp, Homo sapiens
aagaatgtggagctcaacatccatctgaccatgaatgacttcagcgtgcatcgcatcatatgggcgcagggaggcgtttgtgcgaggtctatgggtgccggaaggctgacacaggcaagaatgtacgccatgtaaatgcctggtacaatacagcgtcatcaaacgactgaagtcagtgggggagacccgtgggccctgaagctacgtcgcatcatgctctcgctcgtcagtgctggggactgcccatttcattgtctgcattgtcattacgcgttccagcaccgccaggacctaagctcacgcttcagtcctggtagcctctctgaaccggtgtggtgacctgcatctagcaactctccgcaggcacggggtcttctcagaggcctgacatcgcgcttctatgcggccgagcatcatcctgggccctcggacgcacatgcacacaccgcgttcagtggttctaccgcgtgagcctgagatgccacgtcgcaagcatccgttctggacgtagcatggccacgtgcaggatctcggagcctgggcctgagtcgctgtgacttcgtccagcgaagaagccccatgccagcgtgggcacccacgggtacatggctccggaggtcctgcagaagggcgtggcctacgacagcagtgccgactggttctctctggggtgcatgctcttcaagttgctgcgggggcacagcccttccggcagcacaagacaccaagacagatcgagactcgaccagcatgaccctgacgatggccgtgacta

SEQ ID NO: 634917 - DNA, 581 bp, Homo sapiens
cttggacagtctgcatgcaccttgcaacatctcatgcctccttccaagcatctcatcgctcgttccaaacatctcattgccccttccaacgtctcatccgctccttccaacatctcatcgctccttccaacatctcatgcgggccttccaacatctcatggcgcgtgcaacatcgcatggcgccttccaacattgcatagcgcccttccaacttctcatcccgtccttccaacttctcatccctccctccaacatctcatcgcgcctcccaacatctcatgcccccttccaacttctcatgccccgttccaacatctcatggcgccttccaacatctcatcgcgccttccaacatctcatcccgccttccaacctctcatccctccttccaacatctcatcgctccttccaacatctcatccctccttccaacatctcatcactccttccaacatctcatcacgccttccaacatctcatggctccttccaacatctcatggctccttccaacatctcatggcaccttccaacatctcatcgctcctaccaacatctcatcccaccttccaacatctcatc

SEQ ID NO: 634918 - DNA, 362 bp, Homo sapiens
gctcgactttttgagatggagtttcgctcttgttgcctaggctggagtgcacgctgcgatctcggctcaccgcaacctccacctcctgggttcaagcgagtctcctgcctcagcctcctgagtaactgggattacaggcatgtgccaccacacctggctgattttgtatttttagtagagacggtgtttctccatgtcggtcaggctgatctcaaactcccgacctcaggtgatccacccacttcggcctcccaaagttctgggattacaggcatgagccaccgcacctggctaactttctccttgtttgcctaagagttttacaattttacatgtatgtccataatctattttggtcgacg

SEQ ID NO: 634919 - DNA, 1511 bp, Homo sapiens
gtcgggagacatggcgggcgttaaagctctcgtggcattatccttcaggtggggcgtatggactgactttgtcttatgctgggatgtgccttagaggattatggcagtttactggcccttattcgtcctgattttccacgccatctcccccatcccccatttcattgccaaaagagtcacctatgactcagatgcaaccagtagtgcctgtcgggaacatggcatatttcttcactactgggaatcgtacgtattactggcctttggatttccatgtgattcttgctcgtgtaggctagtgatcaaaactggggagcctgcggcctcatgatagtggcaggcaatgcagtcacttttccttacaattcaagggctcttcccttatatcgggaagaggagatgattacagctgggagcagtggtagcactttattctgattacagtgcactcgaatctcttagcaactcatacctatctgtatacaatgtgcacatgcggccatcttactatgcacaactctaatatgctgggttcccacaataccttttatatatcactgtgcactttaacgaaagaccttcataagtaaggacagagacgttctaatctcacgccaaactaggacctggcacacactagcataatgttacctcccaatttcatggtcggccagcataggagggccactttcgatcacggggagacccccgaacaatatttaaccgccagctcgtaaggcagcgccaccttatgcacaggatcgaacacatttggccgggagcactcccgaagagaaacaacaatgaaacagacacaagtgacaaagagggcgcggatgaccccccttaggcagtgaacgcagagtaaggggggcaaccaaaagacaaatatgaactactaaaaataaacgccccacggcgaccactgtataagacgcgaatacaacgaccacaaccaactcatgaacagggtcggcaacagcccgcagagacttagagaagacgcgccacaacacaactaaccacagcgccacacagcgaccaacagaacgacgcacgacgcagcatggggaagatgcaacaaacgacgagagcgagacagagctacagaggaggaagagcaaatcgggggggagaagaacgcgaaggcggctgcgcaccaggggaggaaaggaagaggccagcgaaggaggaggaaggagcaggggcagaatagggagggcgggcggcgagcggagtggtgagggcgaggcaggggcagacgacagagacgagcgaatagacaggatgaaggcagcaacgagcaacaacaggcaggagacgaggaagagcgactaggaacacgtgagcggacgaaacaggacaggagcggaggaagagaaacgagcagcacgagaaggaaggggagacgagagcgcgagcgaagcaagaagacgacaagcgcgaagaccgacccagcacggcaaccgacgcagacagacaggacacaagcagaacgacggcacagccgt

SEQ ID NO: 634920 - DNA, 143 bp, Homo sapiens
ctcatcggccaggttgacactaagccgtacctaggcgcggtgacgcggccgctggccaagatggccgctcgtggacttgtggggctagccgagcgcagcgccgacgccgtcgtggcggctacaccgaccgtgggggaaaggtt

SEQ ID NO: 634921 - DNA, 331 bp, Homo sapiens
gattagacttgaaaactgaaagcaggcatgcagatgtttggctcataacaactcagccttacatctcaaagtctcaccttcctgaatccaaatgcatgtttgtactcaagcacacgtgaatgttcttgctcttctgaggactttgtctagctgtctgggattcactctgcccttccctgtagagcaatccatgctttgaggaaggttctcaaacttgatctggccccatgaggctgggcactgccctgattggagccagggataagcagatatttcttgtgtcaccattccacccccaggcccttccatgtatgtgctgcaccccgccgtg

SEQ ID NO: 634922 - DNA, 429 bp, Homo sapiens
  misc_feature (6)..(6): n is a, c, g, or t
  misc_feature (17)..(17): n is a, c, g, or t
  misc_feature (42)..(42): n is a, c, g, or t
  misc_feature (92)..(92): n is a, c, g, or t
ttttgncctacctaaanccttattttaaggttatgtgtaaancaaggtaaaagaacctaggaaataagagagatgtaaggaaagcctatagnaataaagaggtatttttggttaaaaaaaagccttaaagaaaaataattttatataagaatattaggcccaggtacagtagctcatgcctgtaatcccagcactttgggaggctgaggtgggtggattgcttgagcccaggagttcaagaccagcctaggcaaaagtgcgaaatcccatctccacaaaaaaatacaaaaattaggcaggcatggtgttgcatgcctgcagtcccagctacttgggtaggctgaggcaggaggattggatcgcctgagcctgggaggtggaggctgcaatgagccatgatggcgccactgcacaccagcctgggcaaca

SEQ ID NO: 634923 - DNA, 1076 bp, Homo sapiens
gcctttcggatatcacatgtggacagaggaggagcccggctggagatctgacttacctggaaccggtgtgccttgtgatgcattgaatgcccagtgcagatatacctgagagtactagtctaataaacctgtcttcccagaccaattggtggtgctggaatcccctatgagccttcagtactgggagaaacagagtccagacatagacagattgccatgtcagtcaacagaaaccggaatgaaagatacctgcaaactgatgtagaagtccatgtactgggaagcagcagtaaggcgtgccttggccggcaataccagggcacttttatgtctgatgcgcttggcgagatacgaattaggacgtctcatgcccgagcgtacgagagtgacgtgacataaagagtcgatgagcaaagcgtcttggagctgagtgacgtattggaatccacccccgttgtattgtacaacttgggggagtacatgatggagcaaagggtgccatcaagaagttagatggccatcacaagttgaaggttcgatggtgaggtcgaaaaggacccatggaacgagaaggttcgttcagggaacaagccaggattgatctatcacgcctacttgttgaagctctgtggcggtaggcattggcgcagtcagctccagcactgtatgaaatactttgaaagccatacgagttccctggcgcaggcttgaacattccgtgtgagctcccgtccatagtacccatggcgacatcagagctgccttggtgtgttacgtgggcctagggaaccaagttcgtggtctgtgaccggcgagatcagatgccaaatgtgcaaaggtgaagacactggggctcctgttaaacgatggaagcatttccacacggacaggttagcttcacccggggacaaaagtccacctttgggaacccggggacaacggggtccggaggcccggtctggaggcaaaacttaaggggcagtggcagccaacgcggcgccccctgttgcagaccgcgggacccattgtgctaaaaatgtttgacataacactggcgaacacaaaaaaaagcgctc

SEQ ID NO: 634924 - DNA, 309 bp, Homo sapiens
ttcacgtacctattggccatttgtatgtctttggagcagtgtcttttgagttctattcccatttcttaattgggttgttttgttgctgttgagtcatttctttatgtattttggatattaaccccttattggatgtatggtttgcaaatattttctctctccctgtagattgtctctgaactctgtttttgtttctttgggtttttttttgagacggagtttcattcctgtcatccagggttggagtccagtgagctgagattgcatcactgcactccagcctgggcgacagagcgagacttcatctcc

SEQ ID NO: 634925 - DNA, 503 bp, Homo sapiens
ttcacgtacctattggccatttgtatgtctttggagcagtgtcttttgagttctattcccatttcttaattgggttgttttgttgctgttgagtcatttctttatgtattttggatattaaccccttattggatgtatggtttgcaaatattttctctctccctgtagattgtctctgaactctgtttttgtttctttgggtttttttttgagacggagtttcattcctgtcatccagggttggagtccaatggtgcgatctcggctcactgcaacctccgcctcccaagttcaggcgattctcctgctgcagccttccgagtagctggtattacaggtgcctgccaccacgaccacctaatttgtgtatatttagtagagatggggtttctctatgttagctaggctggtctcgaactactgacctcaggtgatctgcccacatcagtctcccaaagtgctggaattactgtcatgagccaccgcacccatcctcttcaata

SEQ ID NO: 634926 - DNA, 391 bp, Homo sapiens
  misc_feature (63)..(63): n is a, c, g, or t
atctagaggatcccggtattgagtggcatgtgatagaataaatgttagaattttatggtgttngaattagttatctattgctctgtaacaaatttagcagcttaaaacaacaaacattatctcacagtttctgtgggtcagaattctgtgcagtttatcttgggttaactggcttggtctctcaccaggcagtgaaggtgttgatggcggctgtgatcatcccaaggcaggatagggagagaatctgtctccaagctcacattggcaggaatcatctcagaggctgttggactgggcctccgtttctagatggctattggtcagaggccttttacaataccttgtcacgtgggcctctccatagggcacctcatcacatggccactcaata

SEQ ID NO: 634927 - DNA, 475 bp, Homo sapiens
  misc_feature (98)..(98): n is a, c, g, or t
  misc_feature (119)..(119): n is a, c, g, or t
  misc_feature (121)..(121): n is a, c, g, or t
  misc_feature (166)..(166): n is a, c, g, or t
  misc_feature (179)..(179): n is a, c, g, or t
  misc_feature (194)..(194): n is a, c, g, or t
  misc_feature (233)..(233): n is a, c, g, or t
  misc_feature (238)..(238): n is a, c, g, or t
  misc_feature (250)..(250): n is a, c, g, or t
  misc_feature (257)..(257): n is a, c, g, or t
  misc_feature (293)..(293): n is a, c, g, or t
  misc_feature (295)..(296): n is a, c, g, or t
cattcggcacgatgtatgtgctagagattaacaagcggatcacagaggagcaagcccgcaaagccttcgacagagccaccaagctggagcaggagttnacagagtgcttctcagccatngnggagggtgacagctttgaggagatctaccacaaggtgaagcgtgncatcgaggacctntcaggcccctacatntgggttccagcccgagagagactctgattcctgccctgncttgncctggactcgcnctgcctncatcacctgggcccttggtctggactgaattgcccnannccttggtccccgccggggttccttcaaaaccctttatagatatcccccctttctaagtggattcaagccttttgaagggggggacactccctctggcatggtatccccggcaccacaagaagttggggctcctggaacgccagggaacctggggggtcttgggggggaagctgggctcc

SEQ ID NO: 634928 - DNA, 453 bp, Homo sapiens
  misc_feature (98)..(98): n is a, c, g, or t
  misc_feature (119)..(119): n is a, c, g, or t
  misc_feature (121)..(121): n is a, c, g, or t
  misc_feature (166)..(166): n is a, c, g, or t
  misc_feature (179)..(179): n is a, c, g, or t
  misc_feature (194)..(194): n is a, c, g, or t
  misc_feature (233)..(233): n is a, c, g, or t
  misc_feature (238)..(238): n is a, c, g, or t
  misc_feature (250)..(250): n is a, c, g, or t
  misc_feature (257)..(257): n is a, c, g, or t
  misc_feature (293)..(293): n is a, c, g, or t
  misc_feature (295)..(296): n is a, c, g, or t
cattcggcacgatgtatgtgctagagattaacaagcggatcacagaggagcaagcccgcaaagccttcgacagagccaccaagctggagcaggagttnacagagtgcttctcagccatngnggagggtgacagctttgaggagatctaccacaaggtgaagcgtgncatcgaggacctntcaggcccctacatntgggttccagcccgagagagactctgattcctgccctgncttgncctggactcgcnctgcctncatcacctgggcccttggtctggactgaattgcccnannccttggctacgcccggcctgcctaccaccccttcataataatttccttagaaactggatccagtctgttggaggagggacacatctatgcatgtatgcgcgtaccccataactgggctcctgaacgccaggaacctgaggtctgagagggtgatcga

SEQ ID NO: 634929 - DNA, 781 bp, Homo sapiens
agcgaggcgggtgagtgaagggccgggggcgtgtgggggagtggctgggcgctggtgggcggtatctggaccgggtgggctgctggtagagtgggcttggttggtgttcccagggctggggttcgttccgaggtggggctccgcttatgggaagagtgcccagcggatggggccttatgtgtcatgcgtagtggatgagtgaggctggcgaatggcggtggtgcgggcaaatgtgctagtggatgtcgggcatgcgagggcggtaattcgtgacccggagctgtgcgaggagagtaccgaggagggggatcaggcagggagaggatgatacggactacaagaagtagaccttcctcgaggaactagccttatcccattttgctgcctgaagttaactgtttcgttgctgggtcaaatcagggacatgccggcattaggcgggatgagtgggctgtaccggacagggaatgctggatacattgaccggccagtgatcgtgctgagaagtaccacgggtccagcttcttccattggaagcttggacgatgattggggcttgggtacacacccggagggaaataaaggccactgaagggccctcggagagcatggaggtgaccaggggaagccttcgcttagaagctgaatgacaggacgggactgcaaggttggcataccgtgataggttccagaatcatatagaagcggactcttgcgggccaagtgaacgcagagtaaaacttcgcacggtgcgcaacggccaatgacatccgagatccta

SEQ ID NO: 634930 - DNA, 1166 bp, Homo sapiens
tcgagacaatccttagctaaatcatttacccaaataaaggtataggcgatagaaattgaaagcctggcgctaatagatatagtaccgcagagggataagatgagaaattataagcgcaagcataatatatgcaagggactaacgcccttatacgcgttctgcagtagctgaatttaagctagaagagtaagctttgcgaaggagagccgaaagctagagacccccgagaagcgatacggagctaccgtacagcaacaggctaagagagagcacgaccctgtcgtatgtagcgagatagatagtgtggaagatttggtagggttagaagggcggacaaaaccttcacgggacgccgtgggtgtatagcgtgggtgtgctccaatgataacgacatttctgtaaagtatgcatacgttttaagaaatgtctggcctcgaacaggacaatcccgtcttgaaaatctccactctttggttaaagagtttagaatcgtggttcagttcccaaacgtaggcaaccgagcttctctgagggaagcgacctaaggggagacagaaacgctttggtgagcaagaagaagttcagagacaaaatgtgtaaatcacatccgataagattaggggcgctaaacacaggctaggtccaacccaaaatttcaaatgacaaacacgggcggttatacaaaagcccttccaaggaaacaccccaaaatatcccttaaaaatatatattcgcccaaatagcaattataggcttggaaagcttcccctccacgaagcgcaaagtgtgggagcccaaagtcataattcaacctcctattacgaaaaagaaactcaaagtggtctcacgtacactaaaggtaaagccatggaaaagagccatttcttcgccttccctgcccaattaaaagcgcccttgccggttcacaggaactgttgacaaacaacccaacttaggaacacctgtggagcggaaattttcaaaccgaaggcgcgctaaaggttaattgctaaaccaaaggtcaaaagccaaaacaaaaggggttcaatttatttgaaccccctttcaaccttgttgcgagactccccagagcacaaagggggcactgggcgtccaattaacggcgagaaggggttgaaacacaaacacaaggtgacacaaagtag

SEQ ID NO: 634931 - DNA, 91 bp, Homo sapiens
agcgccagcgcgatggccgcgttccagcaggactttcgcagccgccaggaacgcaccgcacccgccgcacccgccgaggacgccgtggctg

SEQ ID NO: 634932 - DNA, 1166 bp, Homo sapiens
gcagtggcggcagctgggggcgatggcagtaactatgcggcagatacagtcgtgggaacgcagagtcggggcgggtgacgggtgtgcggaggtggtcatcgactcttgcggaaaacgtgctgtggcaccggtcagtggcgctgaacggtggttcgtagtaccatgctccgagtgtgcttagcggatggccttggaaatccggcggtgccaagccgactcgggagctaagtccacaatctccgcaaaaaattggaatcatcaagaccagatacaggtattttgaaggtgatgctgggctacgatggaccggtgcccatgtattgcagagagaggtgtaagccgtattacattggattttcttccaagaacgtccaattacggtgtttccaaaggcgaagcaaattccaggtgctaccaagaactattgcatttgcattattgcagcgttagaaaattttctaattttgggaatccgaggtatggcaattggaaggtggatgctaaaaaagcttctttggaattgtagggcatcgtggggaaagggtgggaaatccgtttacgtgtggattggtattggcacgtgttattgggttgagaaatagataccgtgggaagaaaaggtccacttaggggaaatttgtggatccaaggttttacaaagaagcttaagtttaagagttgaccttcgaaatagaaatttaaattgttcacggaaaggggacggaattcccaaacaacttttccttgttctttccaggcgggcaggcagctaaccaagcgcttgtgtcggcgagggggcgggacatctggacagaaagttgggggaatcatggcctgaaagagaaaagacccccttttaattggagttggcgcaattctcaatggttggtgcgaggcgtgtgagtaggcccccttttgtttggtaccccccccaaggaggggggcgcacaatatagaagcaccacaggttaaaaaaggccccgggcgaggagaacacagctgtagggaattatgccggctggttggcggtccccaagtggaagcgaggcgggagaaaccccaaacattgtttgtgacggcccacagagattgtagagacgcttaccacagagcgagggccagcgcgctcctcataagaggaagagcgccccagacagaggaggggg

SEQ ID NO: 634933 - DNA, 1022 bp, Homo sapiens
ggtcccctcgacttccggtgcttccctacccgtggcgccctatatgtccgctgtgccaccgtccccactgcgcgccttctgcatcggcggtcactctcctgtgtttctcccccgtgattcttttcgggccatggccctctccggtgcgcttctcgttggttccgtgtttttgctgtgtctttcccattcccggtgttatcgtcggtctgttctcccctctgtgggtgtgcgtagcctggggtcctcacctggtttaatatttccgcctccttcggcggggtatttctctgccgtgaattgatcgtgtagttgtaatttcattgcttgcattgcgtcccccatttggtgccccttcggttgccgcgtttactgcgcggtccgtggtcccgcttttcgtcggcccccatggggtcgcgctacctcttctctgggtaggttccatggggcttcctacggcatatgccctgtgcgtgccccgccctgtgtgggtctgtctgtttctggccgcttccctgccgtcccgtccctccactggttttcgcgtgggcccttgggacgtttcaacgtctggacgccactcctttcactactatgctaggcgcgctttcccacagttttctaggtctacgccgctacacgtcctatggctggaacgaagtcgtgtttttccctcgaatcgcgcccttccatctcatctgggcctaccccattgcccaggggggcgccttaatgactcggtcggtctccatccctgtgtcgcgggtagcttgcctgcccgtgaatgtctgggcccctcctgtctgcttggtgcccgccttccgtcctcagtcggctggggacagttctcatgcccagtgactgggcctggggctgtctgctcgtcgtcctttgccgccgccgttgtgggtgccctgcgcgtgtcctccgtggtcgctggctatggctcaccaggtgtctagaagggcacggtcatgggtacatctgcgcagcctaggtgctctggccagggccgcggggccctg

SEQ ID NO: 634934 - DNA, 970 bp, Homo sapiens
cttgcggagtgcagaaggctttctggcagctgcctgggtgggccagacccgtgcctcccctcccggcggccaaaccctagtccccttcctgtctccacttgcattcaggggtggctgctgtgctgagcaacagttagaactgggaagagagatggagtcacatggattctttggtgtggcattattctataacttatcgtgatcgcagagttagtgcccccgttattccgagctgtgtgactagttggccgttctaagcagttacctgagtgtcctgactgctgtaagagctgctcagcaggtaggcggcggcggcctggcactgccccttgcattaggtcttgtgtgggatgtgttcttgtgaatgtacttgtgtcagaacaaaatattttacgcggtagggttcaggaggagtttcgttattagactccccatctggctgtgaagttcaggaaacctcccgttggctagtagatcacccgatgtaggtgtacattgtgacaaggtggcatctgagcactaaggggcccccttggtgaccccagcacattcacagcagtgttaaaatggctgcatttggagatgctggcgtggcctttcagtgcctcccaggtaagacatcatggcctttccctcttcagatgcctgaagggagtgctttgaggcaggtgatgtgctgggagtgtgggctggctccctctggccccgtgggccctctgtggaccttgggtccctccgtggaactgggcttcgtggtgagcacttgagctcccttgggcagttcgcctccaggcgccagcaccacttgtcagcatataggacctgggtgctattgtatttaggctgggggtgtaatgctcttcattggtgtaaaaattggtgtgcttttgacagatttgaggtgaatggggtaactgtaaggttgagagttacaatgaagaaaaaattcatgacaaaaaagaaagaaaag

SEQ ID NO: 634935 - DNA, 349 bp, Homo sapiens
  misc_feature (6)..(6): n is a, c, g, or t
  misc_feature (107)..(107): n is a, c, g, or t
  misc_feature (111)..(111): n is a, c, g, or t
  misc_feature (127)..(127): n is a, c, g, or t
  misc_feature (147)..(147): n is a, c, g, or t
  misc_feature (243)..(243): n is a, c, g, or t
  misc_feature (262)..(263): n is a, c, g, or t
cagtangcatgcaatgagtcttggtaactaaggtctcactctccagttagaaaaacagaaaaagcactattgtttctagatttaactctgagcctctataagtttangttngatgggggaaaacacntttttaatgctaagggtcanttcccctgttcccctgacttagcttttccaccacactcacaattatcacaatgtggtttttgtctcagatgtgtgcctgtataatatttgtatacntttacaaacaatgagatcnnccctgctgatttcctggtgtggacaaactagggacattgaggacacagatggatgggctcctctttacacacttactctgtacaca

SEQ ID NO: 634936 - DNA, 192 bp, Homo sapiens
  misc_feature (110)..(110): n is a, c, g, or t
  misc_feature (138)..(138): n is a, c, g, or t
  misc_feature (158)..(158): n is a, c, g, or t
ttcaaaccctggcggcacggcttgtccctcgaggcccggccccttccccttccggagagcccaccgctgggtcctaaagcccaccgctgggtcctaaagcccgccgggtntttacccaggacggggctggggaaaccnggtctttcctagctcttggnttacttcctggagacttcttaaaacgagaggaga

SEQ ID NO: 634937 - DNA, 248 bp, Homo sapiens
gctcacatctttaatcccataactttgtggagctcaaggcatgtggatcacttggtttcaggagttcgtgaccagccttgtcaacatggtgaaatcccatctctactgaaaatagtaaaattagccgggcttggtgttgtttgcctgtattctcagctgtatcttgggagtctgatgcaggagaatcacttgaacctgtgacttattctgagttatctctgatgctagtttctctgttgatggttgca

SEQ ID NO: 634938 - DNA, 220 bp, Homo sapiens
gtgcgtatgcattgtcccttcacgcccagaacttactcacgtcatagctatcacgcctatctaatgcatctggtcagcctttaaatgcccagattttgcctcataaagtcagctcctgtttaatggcgggctctcaagtcccaccttctgccttcctgtgtccactccaggcccagctactgcctttgtgctcttatgaagtcaataatttcctctgtta

SEQ ID NO: 634939 - DNA, 255 bp, Homo sapiens
  misc_feature (2)..(2): n is a, c, g, or t
cngcaagggtttgggagcttttaatgttccccgggggtaggcctttcctgccgggggttttgatgcaaaagtggaaatcgcttaaatgtccttggggtgggggttggattaatttttaataccaaaaaaaaaaattggaggctgatgttttagcttttttcccacccccccaaggtaaaaaaaaaagcagtggcccgcccttttgggaatcagttttgtataatttaaaaaaattaaataaatgaataaatccca

SEQ ID NO: 634940 - DNA, 469 bp, Homo sapiens
gggcttggtagttgcattatacatgtactggctgatagatcatataaactcataatcactgaagtgtgctaaatgatatccgtgaagtgggtatatgccatagtttatctacccattcagatgattctctaaagggaacttaggatttcaacagttttgacacactgtattactaaccaccctaacttatcgaccaaatataaataacaatgatttgcatttgaagggaacagaaatgactcacttccaaaattggtttgcattatataatttccaaaattatgtatctgtttatctattttttgagacggagtctcattctgtcgcccaggctggagtgcagtggcgcaatcacagctcactgcagcctctgcctcctgggttcaagtgattctcctgcctcagcctcctgagtagctgggattacaggcgcccaccattacacccggctaatatttgtatctttagt

SEQ ID NO: 634941 - DNA, 327 bp, Homo sapiens
  misc_feature (283)..(283): n is a, c, g, or t
  misc_feature (304)..(305): n is a, c, g, or t
  misc_feature (307)..(307): n is a, c, g, or t
  misc_feature (310)..(310): n is a, c, g, or t
cttcttctcagggtcttagatgttccattgtaattctctgcctgtaatctcccgctccaagtgcccttgggtctacagttctccggcagttttcatgtgccatggcaccttcccctgctttcagtggggttcaacctgctatccaactatgccaccgttcccatctaagctgagtcatatgaaataaaaatcatttcctcagccaccccccatacaaaaaaaaacagtcaaaaaattcttattttgccccagaaaaaatttaaatctcccccccccccccaanaaaatttcttttggtggaagnnanccnaagaacccaaaaaaaaa

SEQ ID NO: 634942 - DNA, 145 bp, Homo sapiens
taccaggttccgggcgcttctctcggaggagactgctgagcgcgtgcgcatacccagccacgatagaataagacttctaggtgaactctgtgctccacttgtcccaaggaacttctagcagctagggccccctcctttctggtcg

SEQ ID NO: 634943 - DNA, 400 bp, Homo sapiens
atggcgttaaactggctcccccacaccctttttttcggcgcagattcgctaatctaatggagaaagctacttttgacaaggatgtttatctgatctatttcaagaacaccttttttctaacgctgatgggtctaaaactcagaatattatgaactaaaaaaagtacatattaagagcagcttctgagaccagttgtttctggtttatttttttagttaaagagtataaacatattggatgttctgctggtttaattcttcttaaatctcagagatgttaatctgattgttaacatgatgatgtaaagccattatcacatgtgtcttgaacgactcttaaaaaaaaaacattaacatggggatatgataaggataacccatctaaccccacttacaatcca

SEQ ID NO: 634944 - DNA, 497 bp, Homo sapiens
aaacataataaagtacaatggatcctgaccagggtttttaataagatactggctagggcatttcaagtgtggcaaaaaaattagcatagttcttttcaaaagaaacggtcctcagggttctagagacctagagggttccaagaaatcaaatcctaatcagttggcggttgaagtgtatggatggagtccatacattcacactgtagataggcaaaaccaagaacggatgcaggctcaaaggaagagaaagtcagcgcctgtgcctgccatgtcctgagcgattgccaccatggtgcttgctttaatgggacctctcaaaggagcgagatcgttcacgccggtccctatgatgtcccctttcatgcctgtgttactgggcggcatctgagtgatcccgagacttgctctgagatcgagaacgaggatttttccttttatgaccatgtcggttggaactttttaaatcatctcgggtatgctcagggcggggtaccgag

SEQ ID NO: 634945 - DNA, 215 bp, Homo sapiens
tctagaggatcccggtcattttctacacagcaaaaccccatttctacaaataaaaaaaaaaaattaactgcacatggtgggtacacgcatttagtcccaactacttgcgagactgaggcaggaggatctcttgagcccggtaggttagagttgtagtgagctatgatcatgtctctgcactccagccatggtgacagatgtgagacgctgtctct

SEQ ID NO: 634946 - DNA, 535 bp, Homo sapiens
  misc_feature (161)..(161): n is a, c, g, or t
  misc_feature (164)..(164): n is a, c, g, or t
  misc_feature (166)..(166): n is a, c, g, or t
  misc_feature (193)..(193): n is a, c, g, or t
  misc_feature (238)..(238): n is a, c, g, or t
  misc_feature (245)..(245): n is a, c, g, or t
  misc_feature (269)..(269): n is a, c, g, or t
gggctggtggggtggggaaagcagcccattcctggtgctcagagactcccaccccagctcagagggagcaggggcccagccagggacggaccctcattcctcccagggaccccagacctctgtctggccttggctccttgaacttttggccgccatgtgcnttncngaaggtcctctctgatgacatgaagangctgaaggcccgaatgcaccaggccatagaaagattttatcgatnaaatgcnaaatgcagaatcaggacgtggacnggtgatgtcgagcctggcagagctggaggacgacttcaaagagggctacctggagacagtggcggcttattatgaggagcagcacccagagctcactcctctacttgaaaaagaaagagatggattacggtgtccgaggctaccgatcccctgtcccggatcttgaggatcccgcaccgaggagcctggggagagctgttgtgaaccaggtcactgagatggttcccgccctcctgctcgtctccgccctgatgctcgtcctctcg

SEQ ID NO: 634947 - DNA, 830 bp, Homo sapiens
  misc_feature (456)..(456): n is a, c, g, or t
  misc_feature (459)..(459): n is a, c, g, or t
  misc_feature (461)..(461): n is a, c, g, or t
  misc_feature (488)..(488): n is a, c, g, or t
  misc_feature (533)..(533): n is a, c, g, or t
  misc_feature (540)..(540): n is a, c, g, or t
  misc_feature (564)..(564): n is a, c, g, or t
gggctggtggggtggggaaagcagcccattcctggtgctcagagactcccaccccagctcagagggagcaggggcccagccagggacggaccctcattcctcccagggaccccagacctctgtcttttttgggttaagtttcaattttggctggctttggctttggctttggctttggctggtttttacgcacttagcaaggccttctggcctgagagaggcttcggccactaccccccacttttcccataaaaccagctgagtctttgtgccaggaagactgcgtgcagaaggtgactgtctcagtggagctgggtcatctcaggtggggagttggggtccccgaaagtgaggaccctctggggaggagggtgcttctctgagacactttcttttcctcacacctgtttctcgccagcaggccttggctccttgaacttttggccgccatgtgcnttncngaaggtcctctctgatgacatgaagangctgaaggcccgaatgcaccaggccatagaaagattttatcgatnaaatgcnaaatgcagaatcaggacgtggacnggtgatgtcgagcctggcagagctggaggacgacttcaaagagggctacctggagacagtggcggcttattatgaggagcagcacccagagctcactcctctacttgaaaaagaaagagatggattacggtgtccgaggctaccgatcccctgtcccggatcttgaggatcccgcaccgaggagcctggggagagctgttgtgaaccaggtcactgagatggttcccgccctcctgctcgtctccgccctgatgctcgtcctctcg

SEQ ID NO: 634948 - DNA, 319 bp, Homo sapiens
  misc_feature (199)..(199): n is a, c, g, or t
  misc_feature (209)..(209): n is a, c, g, or t
  misc_feature (244)..(244): n is a, c, g, or t
  misc_feature (250)..(250): n is a, c, g, or t
ttcaggtcttacatttaactccttaatccattttgagttgatttttgcatatggtgtgagataagcttctggtttcattctcccacatgtggatatccagttctctggacaccatatatggaagagactgtcatttcctcatgatatgttcctggcacttttgttgaaatcaattgaccatagatctgtgggtttattnctggcttttnattctgttccattggccaatgtacctgtgtttatncttgtnccttgctgttttgattattatagctttataatatgttttgaaatcaggtagtgtgatgcctccatcttt

SEQ ID NO: 634949 - DNA, 1289 bp, Homo sapiens
  misc_feature (221)..(221): n is a, c, g, or t
  misc_feature (438)..(438): n is a, c, g, or t
  misc_feature (1115)..(1115): n is a, c, g, or t
  misc_feature (1274)..(1274): n is a, c, g, or t
ggaactgggtaccggcccggaatttactggtcatagttacgcaacgagcaggcctagagtctgaccccagacgacactgcacgtcgtttctgactacagaggatgcactaattctatttcctgtgccacctgagaaaatcataatctgagaagagaaagtgtcaggccatgtcgtagtgaactattatttccaaaccctcacggaaccctgtaacagggtngtgaattgatggattcatcaacttagcttgactgtctgcctggtatcagccttctgctgttcgcaactcacataaaggctaaagccgcttacagctatggttcattattcctgtccagactcgtttactcgccgctaaagattatctcatgttcatcttggctcagttctcaacgcccacatcgtcgacgtctcattaacggataatcactagccanaacatcaagatcagtaccttcacctttgtgatgccaccctcgaaggtaccgcagtggagataggtccatactcataagcgtagaagggagaagaggggaaaagtcatagaagggacaagcgcgaggggatggctattttcgatcaatttggaccttcctcgttatcgcttctttcctgacacgtacgccggggaatatctccgagcgtaacgttgtcgagaacgaagtgcttgcgaaggaagagatccatattagtggacattcccattctctatgcgccttgccttctagaatctctcccctcttccttctagcacttggtcgtcccctaccacccgtggtttaaatactaggggggtaaaaacccttgttgggtgagcttgactccgtaaactttgtaaggttttaagagaacgggaaatatttagctcgggtggaaagggatgaatgcgggggcaatagggtaggttgcggttttgggacagtcgacggaagcgggagaatttgggaaatttttaatagtgggggacagctcttttgtttgagcgcgcgaagataggaaccgttgacttttcgcgcaacgccgaattataataggtaaccctattcgacgtaagataaggggcctcttggacccggcttttggtttgggaaagagcccactttttaccgcaggnggcgtaggccctctaacgaaaggggcgaaattggttgaccaagggttggaaggaattcctaccggaatgacacgcgcgcactgtgtgggtggcccagcgggagatggcccccgttgtggatgtcgccgtttagggggggcaaaaattctgcttttcttnctccttcaccaaacg

SEQ ID NO: 634950 - DNA, 216 bp, Homo sapiens
tcccacccgagacccactgctcctgtgtgggaagcagagctgagattggggtgcgggggcctttccacggtcctactggtcccatagtgtcaggaccctggctgtttgggctgtgggctctcatgggacctggagcagggtgtgtgacaggactaggaatcccgggggcctgcagcgagaacatggcagtaccttggagggaaacccccccgaact

SEQ ID NO: 634951 - DNA, 677 bp, Homo sapiens
gtttactccttgggcttctttgcgtggcgggcgcttgttcccggtttaggactctgccccggcgtttgtggtctcgcccgccgtgttcttcctgggcgatcctctgcgagttctttcaccgggccccccccaggggtgtttcacgatacaggtctcccctggctccgggccccctcgggttctcggattctggcttggggttctcacccccgggctgtactccgagccccgcgtatcgccgtgggtatccgccacgtctccctttctctcgggcggagtctctgtgcccacgcccccaaatgtgcttttggcctgaggatcttcgctccccctccgctggcttcccacggtttcccagcgccctccctccggtgcccctccttaagggcccccctattggctgcccacgcacgagaccgttgccccccaggtccgcgctcgtgtggatcccgttccacgctgtagcacttctctccggggtccctcgtcctcttgtttgttaacccccccgacgtctttgcctctgtcgcagctgcaacaattctttctcttttgctcccccgagggcgtttttcctccgggggacgctggtttctcctttttcgtttgccccccccccccttcccccgccccctaccccttcccccccacaaaacaaaaaaaaccaaacataaaaa

SEQ ID NO: 634952 - DNA, 1185 bp, Homo sapiens
gtgtgtcggagccacccgcgtgttgccccgatatagtccgggggctatcctcccggtttagttattccgcggccggtttacctttcctcacccggatccccttttccccttggcccttttggggcccccatatgacccaggttgtccccaaagccacggcggtctcggtgtccggattttccccggagttgttttggagccaacggcggtccgggccccctctgcgagcccccgatgtggctgcgcaactgtgttgcaacttctggccgcttgcccttttaaccctcccttgggccaaccttccttggagggaccctctgcccacccatttgaggggccctgagtttcaagggtccgccaaaccccttgtgcacaactaagggggcccaccccagcgcggtagacattcgggggaatcatgcgcccccgactggggtgtcccctgggccccgctggggccccacgccacctgggctggtttactggaccgattgggtcttcgagggccccttttcgaggatatttgacaccccttttattgtagtgacccactgaaacctcttgggcaccccaaaccttctgaggggcctccacaaacccacgggcccctgagggattgtggcccgcggaccaaggaggaaagtttccgcgaggcctgtgaacgaaggcccgcaaattgtgaactataccttcactggaatgttgctgtgtgggcacacacccaggcacctggaggcgaaccccccgggggccacagggcgccttgagagccccctctggtgcctggaatatgggttgttcttggtattcttgaaacctgaggccctgtcctgtgctggcacccactggtccctctgaaaagaccaccagctgggcttctccttagtcaccagaagaacaccgaggctttgggcccacctttgtggagaagcaccagaaattttagatcctgggcgcaacattctcacacataccgtcctccctcgttctccacgggctggcacgggggaggcctcggagattaccccccttagttgagtggagatgaccacgggttcttggttggggagctgaatttccctcggccctcggggttcactagctttgggcttgttccttttttgatacgggaagagacccccatccagatttttccaaatttaagcccgtcctggggaatttcca

SEQ ID NO: 634953 - DNA, 315 bp, Homo sapiens
  misc_feature (18)..(18): n is a, c, g, or t
  misc_feature (245)..(245): n is a, c, g, or t
catagaatgatacctttnaatgacccgcaagctacatttaagtgaacattaatgatttcggtaagcttggtccactctgggaagtgatgtgctgtggttggtttcagttgcatgggagccagtcgaagctacaactcatcgactgccctgtgccagatgaaaggaggtggttgatttttgaacaccttttcccttccttagggttggtgagctcatcgctctctgtggagttcatagtgtccctntaactgagtatcttagctgtgaagccaagcattgtctctgcaggagtggcacacagattttccaaggctg

SEQ ID NO: 634954 - DNA, 344 bp, Homo sapiens
  misc_feature (13)..(13): n is a, c, g, or t
  misc_feature (44)..(44): n is a, c, g, or t
  misc_feature (49)..(49): n is a, c, g, or t
  misc_feature (52)..(52): n is a, c, g, or t
  misc_feature (54)..(54): n is a, c, g, or t
  misc_feature (109)..(109): n is a, c, g, or t
  misc_feature (159)..(160): n is a, c, g, or t
gttccagtcctgntggagatgcagccaaaacccacaggacgggncatcnccncnaggatgccgggaacagaggggtgaagtgcttttctctggtcccatattttctccnccagcttcttagttgcctagatccttgctgctcaaagtgaggtatgaagnncagcagcagcagcagcatcacctacgagagtgttaagaaatacagaatctcagcacacacacccccgctccacctactgcgacagaacccgcgttttaacaacatccccaggggatttggtgattcatgtgcaaaaaaagtttgagaagcactggcctagaagacagcctctgagaatgacctc

SEQ ID NO: 634955 - DNA, 616 bp, Homo sapiens
cgacagatgctattggacatgattagtagtccaattcaatggattacagacttcgtgaggacaggaccaacttatctctcatggggtttttttagaatacttttataacccaggaagaaaccatgccagctgttacccgtcaacttcttaagcagagattaagctttgtcatatcgtgttcttatcctggacatccgtagtttttaattgcccagcatccggtccatcttgtgacgactccctgatgtttcgttaaaccacctcttcctatttgtcagtctgtggtttggacagtctgaccccagccttgagctttgtgggtgaacatgtaattcagacctcatccatcacgccaatccactctgaactgtggaggagaagctctctttactgagggtgctttagctttgtacggatgaaaacctcctacttacccgggcctaccctgtagagaatgaatgcccgtgtcacggggaaagcagagcccaaatatggagagacttgaatcctgatgaccagcgtttgtgcccctggatcccaccgtgcctgaagctagaatatccctggacttttccagttatgtgaacccaataaatacccttttttgcttaagtta

SEQ ID NO: 634956 - DNA, 322 bp, Homo sapiens
  misc_feature (31)..(31): n is a, c, g, or t
  misc_feature (34)..(34): n is a, c, g, or t
  misc_feature (41)..(41): n is a, c, g, or t
  misc_feature (46)..(46): n is a, c, g, or t
  misc_feature (51)..(51): n is a, c, g, or t
  misc_feature (56)..(56): n is a, c, g, or t
  misc_feature (60)..(60): n is a, c, g, or t
  misc_feature (72)..(72): n is a, c, g, or t
  misc_feature (81)..(81): n is a, c, g, or t
  misc_feature (89)..(90): n is a, c, g, or t
  misc_feature (113)..(113): n is a, c, g, or t
  misc_feature (137)..(137): n is a, c, g, or t
  misc_feature (162)..(162): n is a, c, g, or t
  misc_feature (203)..(203): n is a, c, g, or t
  misc_feature (222)..(222): n is a, c, g, or t
  misc_feature (242)..(242): n is a, c, g, or t
  misc_feature (253)..(253): n is a, c, g, or t
  misc_feature (257)..(257): n is a, c, g, or t
  misc_feature (262)..(262): n is a, c, g, or t
  misc_feature (283)..(283): n is a, c, g, or t
  misc_feature (291)..(291): n is a, c, g, or t
  misc_feature (308)..(308): n is a, c, g, or t
tagagagagagagagagagagagagagaganccngcggccnttttntattntcccncgcngatgcaatgaanggaaagganggtgttgnngaatgttccttcgttaagtcacnggaaacggaatgtacctacttctncacaccgctgctgctcgggaaaacnggcatcgagaagaacccgggcatcggcaaagtctcctcttncgcggagaagatgatctcngatgccatccccgagctganggctccatcangacnggggnagatttcgtgaagaccctgangtgagccnctgtgacgggtggccanttttcttaatttat

SEQ ID NO: 634957 - DNA, 634 bp, Homo sapiens
tatgtgatgatttgttggttacaacctagcattttatttagatcttcattaaactgacggaataggcaaccatgcatccgttataacacctccaaaaatagcatcctgaaagggactttctggttagggcaagcagtcatggaattagcatgtaaacaagctggcttctatgtaccacaccatgcaagtcagctttcatccatgagcatccggaccagctactgcctaccttctgtcaacaccaggcagacgccgtgtaggtctaacccaaggtttttctgtaggacaccttggcctacctgggaatgctggaaacatggagcttaaggaatcatggcgatgagagaaaactgccgacagatcttgtaaaagctgacatctgaggcgatggcttctatgtacttacgccataccttagaatacagtctgtgagcagttaaaagacgctcgagcatgaagggatttcctactgatcaacgaaagcactgctctatgaaagaagctggtcactgtgtagctacaccagctgttcataaagctcattggacctgagtttgaaaataaaacacaggttgaacactgcgatgaactattgatcaatgtggacttcttaggcttttttcataacgaataa

SEQ ID NO: 634958 - DNA, 386 bp, Homo sapiens
gccaatgctggtgatcgcctcaggagactctatacaactcctggcagacaggacggacaagcatggcacctttttcacagggcggcaggatcaaacatgactgccagcagtggacctgccagacgcttataaaaccttcagatctcatgagaccggctcactatcacgggaacagcttgtaggaaaccggccccatgatccagttagctccacctggtcccaaccttgacacgtggggattgctacaattcaaggttagatttgggtgaggacacatagccataccatatcagcccagatcaagtagtgacagagtagggatttgaatacaggttatagtcactattgtgttatttcttgacttttgtactattaaaaaactgtag

SEQ ID NO: 634959 - DNA, 102 bp, Homo sapiens
ccccgccccgccgtccgccgaccgccgccgcccgaccgctccccgcccccagcggacgcgcgcgcgacgagacgtggggtggggggggggcgcgccggcgcc

SEQ ID NO: 634960 - DNA, 780 bp, Homo sapiens
gaaacgtcagctgcgctcccctaggagtgctgagcccgcgaacctgagccatgactgaggctgatgtgaatccaaaggctatccccttgcgatgcccactcacaagaagctatgacctcgttcagcagtcatgtaactataagcagcttcggaaaggagcaatgaggcaacaaaaacctcaacaggggcatctctgagttcatcgtgatggtgcagaggcgagccactgagatcattctgcacctgcgctgctgtgtgcaagacacagaattgtgcccatacgtgttggtgcgctccaagcaggccctgggggagagcctgtggggtctccaggcctgtcatcgccttgttctgtcaccatcaaagaaggctcgcagttgaaacagcagaatccaatccattcagcagtccattgaaaggctctttagtctaaacctgtgcgctctgcccaggtgctccctgcaagttttcccccctgaggttgtgtatcatatatctggtgttaagccatggtagtattcaaggctactcctctaatggtgactacaactggtcggtcgttaacacacgacgaagacacgcccgcagacacacacacttttgggcccgccccgcccggaaaaaacgttctctagcaacccccgtggtgggcagcgggaccaaggggcaagaagcacggccccacagcgggcccacggagaccggggccagcacaagtggcgcggtcccaccaacaaccccggcacccgcgcgcttgaaaccacggcggcggccgcgcca

SEQ ID NO: 634961 - DNA, 423 bp, Homo sapiens
gttatttcaaaaattaaaattctcattttctttcttttttttcccccctgctccacccttcaaaactcccgttagatcagcattttactccaagagtgaaaggaaaaccctaacagatctgtcctagtgattttccctttgttttaaaaggcgcccctttcagggttgtggtattcttaggttagcggagctttttcctcttttccccacccatctccccaatattgcccattaattattaacccccttttttgggtgggaaccctggcagttttgctcccttcctaggatctgcccctgcattgtagcttgcttaacggggcccttctcctttttccaaaggtttccattttaggggggggggtgggtttttctgtaaagagatgaacgcaatgccaataaaattgaccaagaccaatgata

SEQ ID NO: 634962 - DNA, 299 bp, Homo sapiens
  misc_feature (186)..(186): n is a, c, g, or t
gatcccacttatcgtggggtatctactattgtcagtgctggatacagcagagctcatcgtctgtgagcacgtctacaagctcgtgccctagggtcttctgatcatgcacacatgcatcagaatgatgtctatatggctcgtacacgtgccaccacagtttcagaaacacatgctgatctcataatnccgacgtgctttttcttctctcacgtgtgttgctgcttgtgcgcaacacccagctgtcaatgagaatgggagtacgctagacttgtctgacctagaagctgagaaactggtga

SEQ ID NO: 634963 - DNA, 552 bp, Homo sapiens
acgcgacctccacgaccgcacgaactacggctacgtacgaggaccgagggttaatcggccgaggcacgtaccgggagctcaatcctgtccatcctgctggaggaggtcagcccgtagctggtgtgcatgcatgctgcacctctgctctgtgcacgcggctgcctgcactgaccgttcacgtgactcagccaaaggacgggtggctatctgcgtaagtgttgcaagaatgctggtgggtttatttggcatcgcaaccctggagaaaacgcacagcagaatctgctgctctgagaagtgcagttctgcaacttacaagcagtgtgatcgtgtgcgagtacagccgtgctgtcgaatctgtgaggtaggatcttcttctgtgctgaaatggagcctgccctcggccataagcctgttgggaacggagtgtttgggccagctatgtgccaaacacagaacagcagccatagcagctgtcacatgcacgcatgtgtgaatgaggaggctatccatctggcgaaacaagcatggttttctactcgtgtgctgggggac

SEQ ID NO: 634964 - DNA, 504 bp, Homo sapiens
tgagtgcagtaatatttaataaaatgagaatgtttgcaagctgaatagatcattcaataatttatctgttgtgtagatttggatatacagcagactcttgacattcctgaggcatacatctgaaaccttcttgaattcccagatccacaaatacaagaatgtttatagaggctcccagctttcgcttgaatcacatttctatggagagccatatgcgttttcctgtgcatagcctcacactacaagttaaccctactttcagatttcactaaatattgctctcacctgatggctgtttttcacagacacaacacactgttttaattaacaagcattgttacaaatgcatgaatgcgcagaacaataaggataaatgacccttttccataacatgtgtcttgcaaagtagacttctcggattcatacctcagcccaactctgtgccacagacccacaggggaacccacaaagaatcacaaacctgtgagttaaatccatgaacac

SEQ ID NO: 634965 - DNA, 1518 bp, Homo sapiens
  misc_feature (716)..(716): n is a, c, g, or t
gcaacagagtgagactccgtctcaaaaaaaaaaaaaaaaaaaggtttcccaggcacaaaaaatacggcttggtcctttcaaaaacaccaaagaattgggtgttctcagaattggcaaaggtccccggggaaaaacccttggcttggaaatcactggagggactctccttaaagctcagttccggatttggcactggtggtggacctttggaccttaactatacaatttgagtcaccaaaaacctctggggggacaccccttatattacaaggattatattaaccccttcatgtgtttcccgtggtttataaggggggggcgcatctcttaacaggggatctcaggcaaaggggctctcaggatgtgttcaagaggacactctcttggagcgcttctctttgtggggcagagaacaagggggcaaatatatctctctcaaaacgtgtgcgatttatttttcaccaatatagctttctcaagaggcatagttgcagggttttctacacaccactatgtgcgatttatttccctttctctacaaaatctcgaaggacactctgggggaccccccttctcacagggaacaccttacaatcttcttttaaacagaatatatataaccccagaagaaaaaatctcgagagggtctcccttataaagaaaaatctcacagggacaaggaacggggggagcaagtggggctctacattataaancctttttttgttgaacaccaacccgcatttatttgggacaggccatggtgtttcttttaggaaaacacgggggggtgactaaaaaaggaagcattttgggcacatgaagtggttttgcggcctgtgaggtgaatattcccccaaaaggcacaactctttggggggcagacggcggccgttcggcgacagcaggagcggggattacaccctttggggagacgagcaacaggcgagaatgttctccgaagaggaaccaagtggcctgtggccccaattctgtgggtgtcgaaaagccccccgcgtttttttgtacccaaaaatatttcacaaagaatttagcccaagagattgtggtgcgacaggggcgcccctggtgtaatccccgaggcataaccccgggggaggcatggaggagcgaggaggagatgggcccgaaacccggggaaggcgaggacgtgtggctcaatgacgcccgagaaaatggtggcacagtgtgaagccacagatgtggggtcgaaaagagaacacgaaagttttgtgtgttgtcgacgaacaacaaagaaataaaaacaaacatactgtgtgtggcggcacgggcagctggaaaagaccttttagaaccatggttgggggggggggcgcgcagagatgagaaagagcagaagtgttgtagctaacaaaggggtgtagcaaggtggggtggttcacaaaaaaaggcgggcgagagagggtgaaacaaacggaatgtagttgattaaacagaagaatgagttgagtcattgatcgatgctgtgagcgcatc

SEQ ID NO: 634966 - DNA, 185 bp, Homo sapiens
gctcctgtgaaaaagcttgtggtgaaggggggcaaaaaaaagaggcaagttctgaagttcactcttgattgcacccaccctttagaggatggattcatggatgctgccaattttgagcagtttttgcaagaagggatcaagtgaccggaaaagctgggaccttggtggaggggtggtgccctcgc

SEQ ID NO: 634967 - DNA, 647 bp, Homo sapiens
  misc_feature (215)..(215): n is a, c, g, or t
ggaataggtgttattgatagaagtggggcgggggcaggagtgaggcttcgcccactttggggccctctctctttgggaaaggaggtgatcccgaggcgaaggcgcagatcgataacctgcatattggggtgcgcgtcagggtggacaccgcagcaggcgcctttcctccctccccacgtcctgagtcagctctgcgccgctggagcgaaggccgngccccgctggcccactttggggtaaaacgggttcctggcatctcgcgggcgcggtcgttcgccccgcatctggtcaggacttcgccccccggtagatggcttgggtggcttgtacagccctgggagcgatgccctgtctgaagtcctctgcatacttagttggctgtcaggacagtgcctcccaggtatgcggcaaagagatctccaaccgcttggtcatttccagccactgcgtctccttcacgccaaagggccaaaaacttgagcgtgaaagttgagtagaattagtattaaaaaaaaaaaaaagttttggtattatatttttctcaaaatttcaaggcttcaagtgttagtaggaatttgctttagtgcagtatgcttcctatagcaataataatgaataaaataatgattcattcagtaaaaaaaaaa

SEQ ID NO: 634968 - DNA, 242 bp, Homo sapiens
ttccatcacaagaataaagccctacttgattatggtgaattagctttcagtttattagtattttggattcagtttactagtattttgttgaggatttttgcatctatgttcatcagggattttgatctgaagttttctttttcattgtgtctctgccaggttttggtatcagaatgatattggcctcatagcataagttagggaggagtcacctcttcaattttttgaaatatttttagttg

SEQ ID NO: 634969 - DNA, 660 bp, Homo sapiens
gtcatcgttttttttcttttcccctccttttttgccaaaagacaccactccacatcacaaaaacaaccggagcaaaaagcgccccaaggaaagaaaacaacccccccccaagagcacaacccaaagcggaaaaaacacacacatcccacaaaaacggtatgacaaaagaaagccccaaccccaccacaacccggaaacaatacacacaaccccaggcagacccaaccaaccaaacccactgcactcaacctccggtacccaacaaaaacaaacaaacattcacacccaaatctacgacacaattcacgaacaaacaacaaccccaaacagccacaaaacgcggagggcaacaaccctctccacacctattccaacacacccccagcgcacccccaccaacatcgccgccgccccaacaacacgaaaagccaaaaaaaacactgccaacgtgctcaagacgcggaggtccacaacaaacgctcccacccgacacagaacccgcaccccaaacaactcccaaaatcacacgaccagaccgcgatccctctacacctccacgaaccaacagacgcaaacaccgcgctctaaaacaatacttatccaacaacacgccgatctacaacacatcgaacacacaaccccaacaaaacccctgctcct

SEQ ID NO: 634970 - DNA, 707 bp, Homo sapiens
gctagcttttctcttctgtactaaccccacacgcctatggacacaactgaacgtgggtaaccattgatttcccttctttttctctattagctcggtatatattaccagggtgtgtttcgtcggagatgcacacaagagtgaggtgctcatcggtgtaaagattagggagaagaaaatgtcatagccttggtgtagattgcctttgctcagtatcttcagcagtgtgcatttgaagatcatgttcaattggtgaatgagagtaactgaatttgcgaagatacatgtagtgagctgatgagtcgagctggaaatagtgactaatcgcttcatagcctttttggagactgaattatgcacagttgggaactcttcgtgaaacctatggtgaaagtggctgactgctgtgcaagacagagaacctgagcagaaatgaatgcttcttgctacacaagatgatgacaacccaaaactcccccgattggtgagaccagaggtggaggtgatgtgcactgcttttcatgacaatgaggagacatttttgacataaatactctatatgaaattgccagaagacgatccttacgttttatgccccggaactcctgtgcttagctaaaaggtatgaagctgctttgacagaatgtagccaagctgctgatacagctgctgcctgtgccaaagctcgatgaacttcgggatgaagggaa

SEQ ID NO: 634971 - DNA, 498 bp, Homo sapiens
tcgagctggtaccgacagcatcctaaccaggtgcaggtggactctttcgggatgtgtagtcagacagggtacgcccatcttccagctgttttccggcaaagatgaaggctctgctgaacatggaggagtgcgtttcgttatcttggatctgggcgttgacatactcgatggtgtcagggggctccacctcgagggtgatggtcttaccagtgagggtcttcacgaagatctgcatcccacctctgagacggagcaccaggtgcagggtagactctttctggatgtggtagtcagacagggtgcgcccatcttccagctgttttccggcaaagatggagctctgctggagacgagcagtggcgtttgttgtcttggctctgggcgtcgacgtaacaacgatggtgacgtggggctcgacctcaagggtgatggtcttgccaagtgagtgtcttcacgaagattcgcatccccaccttctgagacggagcaccaggatgc

SEQ ID NO: 634972 - DNA, 120 bp, Homo sapiens
agaatcagcagagaagcaacaccagtcggagaagctggggtcctcccagccctcttggccatgtggccaattttttctccaatagcctcataaaatcacattatttgagtgtccatggct

SEQ ID NO: 634973 - DNA, 615 bp, Homo sapiens
aaagttgccagacatgagcaggtgcaagaccgatcgagagagaattgtgctgtaatcatcgctaagactcatgattgcgctgtagtggccagcgcctcgaaatctgggtcggtgtctgtcctccttcttgaatcagccccatggaatgcaatgtaatcagcatcctacacacgttctcaattcccaggagaagccagaggggtagtcctctcaccatcgattgtcgatcgcccgggcgatgatttggctcgagcgagcccatgttccattggcgcatggaggcgtcccaaagaacgtccgagtcttaggttccagggggcttggtatcgtacctgctgattggcagaacattggctatccggtctaatgccaaggaacccgtctctcaagcagcagctcttctcctatgccattcttggtaataccctgtatgaggccatggggcgttgggctgtccgatggtcgccttcctcatcctcttcgcatgtgaggctccatggggggtcaccggcttgttgctactggaactccaaccattcttggtgctggggtgtggtcaggctttaccattaagcacaacgtgcgtcaaaacggggaacacaaaagaaaacaaag

SEQ ID NO: 634974 - DNA, 312 bp, Homo sapiens
ttacaggatccccctggggcctgcgacataaaataggttctgttcgttcttcttagcgagacgtgggtctgcagtatcggcatcaggggctatacaacgtcacaggccatcatgggagtattcactgtttatactaaggacgtcacgtgtttcaagaacgcagtctcagagaatgctattcgggatcctaaatggtccctgacgactgcacgctcaccggaacagttctgaaacgctgcttcagaccacctaactctactgccttgccagtatcagtccttactcctgctgccttgccacactcaacatgta

SEQ ID NO: 634975 - DNA, 420 bp, Homo sapiens
  misc_feature (19)..(19): n is a, c, g, or t
  misc_feature (145)..(146): n is a, c, g, or t
  misc_feature (193)..(193): n is a, c, g, or t
  misc_feature (253)..(253): n is a, c, g, or t
  misc_feature (271)..(271): n is a, c, g, or t
  misc_feature (309)..(309): n is a, c, g, or t
  misc_feature (404)..(404): n is a, c, g, or t
ccaagaggcaaaattctgnccagaggaacagtgtggttccggaaagatggataaactccgcctcacttgccctcgtccctgggggagagaggcagccaagtcttaacaaaccaacccctttgcgaaaagataaacctggagatannataagggccgagctgagccagttgtcccatggacaactttatttaancctatttcagatatcaaaacctctagctgtatgatttgtccttgaattttgtttttatcntcaagagggcaagtggangggaatttgtcagcgttctaccaggcaaattcactgtntcactgaaatgtttggattctcttagctactgtatgcaaagtccgattatattggtcgcgtttttacagttagggttttgcaataactttctatnatttttaatagaaata

SEQ ID NO: 634976 - DNA, 146 bp, Homo sapiens
tctccagtcgcaacacaatactaactctacagttacacttctaagaatatatactatggacatatttgcatacatgtacaaagatatgtgttgccgggcgcggtggcgcgtgcctgtagtcccagctactcgggaggctgaggtgg

SEQ ID NO: 634977 - DNA, 125 bp, Homo sapiens
ggggggggaaattggggggccatttttttgagggatttatttaaaatttggactttttgaaaaaacccttgtaaggggtttgtttttttaaaaggggactttttaaaaaagcggttttttaaata

SEQ ID NO: 634978 - DNA, 123 bp, Homo sapiens
atctctcgcgtaaaagtagactctctcgctacagcaggggcgactcctctctcgctaaagcaggagcgactcctctctcgctaaagcaggggcgactcctctctcgctaaagcaggggcgact

SEQ ID NO: 634979 - DNA, 265 bp, Homo sapiens
tgatggctgttctaggaggtccctgatgggtgctgaggcacagggtttcgtattctcgtgaggcaaagtatataagaaacaagagaaggaagttttaattttgaagaatggtatggcaacgctggtcaatgtgaatgcaagtgaatcataatatatgggggctacaggagatttttttctttagaccttggtaaagtacacaagtattacagcaagagagcctgcaagggcgcacggcatgcaacattctcgatcccagactata

SEQ ID NO: 634980 - DNA, 896 bp, Homo sapiens
  misc_feature (479)..(479): n is a, c, g, or t
actctaaattgaaaaatgtatgtatgatctatatttgacccttaaaatgttggatctaactttaaccaaatatggccagattttccatatactaagtcattcaccgtcttacgacataggatagctgtctacccgttctgtcttcttagatcacgattcaattgaagatgctgtctgtaagacgatacaactttcagacatatgttcatatattatgtagaacaagaagacaggattatgtattcgtaggccagtggtccacaaatggtaactagttactgaccatgtagagctgttatagtttcatagattgtcccacgttcacccagtaatcttagaaatctagaaagtctggcgagatactgatatcagctgtatgtcgggtaattccacagtgctgatagtgctattcatcttttagagttacttgtgtcagatgaaacaatatgccaagttgtaaaatattgcagatttctatncatcctcatggttctaggcataattattaacaagccatgccttatgtgtctcatcttatatccgttctttataactaaaggtataaacagacttgtggacaaagtgatttgactgtgcttgctcacttgattgacttggtcagatatttgactgattggtgattacctagattctaatccttgattctagttatctaattatataagtataagaacttattgcaaactctctttgtttgggggccatgtaactggttaataattagttggtagttaggcttccaaggcacagaacacgcatttactaccattctattgaaattgaagacagttctgcaatccgacaattaggtataagctggttcatgtttacaaacccatgcttatgaaaagtagcaacgcgatttacattgcccc

SEQ ID NO: 634981 - DNA, 148 bp, Homo sapiens
ttagcactccaagtgaatagagagggttcttctactataaggactaaaccgcttcgaagcgaaggctactacaaatcatgaaaattcattaatataaactagactagttagacgaaatgaatagagcctaacagaatgataaggatag

SEQ ID NO: 634982 - DNA, 502 bp, Homo sapiens
caacatgcggacacttccatcagtaagatgtcttgtatgcagcacacagttatgctgaagaacctcgtctggtatgctggcctgacctggagtcagcagcgcggtcacggctgcgcaccacaggtatgggcccggcgctggctcctctgcacctgccaccgctacagcagctccttgtactcccgccagctgcagcacctctgcacctcgggatgggcgttcacatcatcctggatctgcgcggcctccgcgtggtgctcccgttcccgcctgcagagcttctccttgcgctggctcagcttctggctccaggactcagcgtgtgtctatcgcccagccacgttggccgggagcagctctcggcctggggcgcgcagaagggtgtggcgcctgtctcaagccatgttggaaaagtagatctgctcgaagttccagcgccgctgcacggctccagtgtctccggtcacggctctgccactctcccagctgcactccaccccct

SEQ ID NO: 634983 - DNA, 481 bp, Homo sapiens
gatgcgtcatcgccttggggcgtcagcagcgtcagcacgccatcgacgccggggtcggccagaaccgcttcgagcgccgcgcggtagcgcgcatcgtcggcgtcgccgatcaggtcgatcgggttggcgtgcgaccaggtcggcggcagcgtacggttgagcacttccagcgtttccggcgccagctgggcgagcggaatgccgaggtcggctgcacggtcggcggccatcacgcccggcccgccgccgttggtgacgaccgccagccgcttgccggccggcttgaagccggtgaacagcgcattggcggccgagaacatctggcccagcgtggacagccgcacgacgccggcgcggcgcagcgcggcgtcgaacacgtcgtcggcgcccaccatggcgcccgtgtgcgaagcgaccgccttggtgccggccggatgacggccgaccttgatcgccagcaccggcttgacgcgggcggccg

SEQ ID NO: 634984 - DNA, 93 bp, Homo sapiens
agtccttgctggggtccccggctgcacctccaacccccaaatccttcaggacccaccagaggccccaccacttcctctccggggggcactggg

SEQ ID NO: 634985 - DNA, 170 bp, Homo sapiens
  misc_feature (65)..(65): n is a, c, g, or t
  misc_feature (100)..(100): n is a, c, g, or t
  misc_feature (108)..(108): n is a, c, g, or t
ctgtcaactgctgcaagaagaagtgtggtcacacctataacctgcgtcccaagaagaaggtcaantaaggttgttctttccttgtaaggcagcctcctgncctgcccntgtcctggagcctcatataaagtgccctttcattgtttggagcatgcaataaggcaaatttt

SEQ ID NO: 634986 - DNA, 356 bp, Homo sapiens
aatgtagtgcaggcccatgcccgccagcatgaggaggaggcagtactccagcacttgtgtgttttgtttgtgttgctgctgcctcaactggggcccctgtggcctctcgctgtgtagctgggaccagtactgtgcgttggggggtgtccagcatctgtgtgtttggtgggcagacttgtcatggactgtggctagtgaaggctttcgtggccacatgaccccagctggtcatcatagctgcggcggctctgctcacggctgagcacacggtatgcctcgctcagctccacaaagcggctgtgcaggcttgggttcacagggtcccggtctgggtgcagctttttgaacgtggagaa

SEQ ID NO: 634987 - DNA, 311 bp, Homo sapiens
aagatcgtcatgaatgactatcctaaatttagagtagcagttttcttttgggtgggtttattcgtgctggttcatcgtgagtaagaagcctgccttgctgtgccggggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtc

SEQ ID NO: 634988 - DNA, 396 bp, Homo sapiens
aacggcatttacaaagaaaacatgaccatgccctcagtagatacagaatacaaatgtacttatagggctttatttttaactgacagcaaatagaaatcctttagtgagatcgtgacaattagatcatgtattataatattagctcaataaaggtacactggggtacctggaagatcaagatctacagctgcctatttccacatctttcaatccatctggctccttaaatagggtaaaaagcccttatttggtggagaagcatttccaaaatgaagttacaggttctattaaaacttactgtcacatcaactgtttaactagggccttttgagtgaagttatttcaccttaatatcaccagaattcctgtcattccacaattgtgattttactatct

SEQ ID NO: 634989 - DNA, 592 bp, Homo sapiens
  misc_feature (345)..(345): n is a, c, g, or t
  misc_feature (367)..(368): n is a, c, g, or t
  misc_feature (500)..(501): n is a, c, g, or t
tgaagagctggctgagcggactgagaccaaaagaccagacatcggtgggcatcagcttcgtggccggtggatctcaggaatggtggctgccaccttaccctacccttcgatgtggtgaagacacagcgacagatgtcactgggagcggtggaggctgtgagagtgaagccgcccagagtggactccacctggctcctgcttcgcagaatccgggctgaatctggcaccaggggactctttgcaggcttcctccccaggatcatcaaggctgcaccctcctgtgccatcatgatcagcacttacgagtttggcaaaagcttcttccagaggctcaaccaggagcancctctgggccgctgaaagtcgnngagcaaccggctcttgcacgggtgggatcaggagactgagccaagtgccttccctcccagtccagtcaccccaggctgtcctcagacctggattcctgctgtttcccttcccaggattgcccctctcccgcnncccgaattcaagaccaaatctgatgatcgcccttttttgtatccccatgtttgttatagcttggcccgaggagcttgggccaggcagtatc

SEQ ID NO: 634990 - DNA, 217 bp, Homo sapiens
cgagctatgcgttacagagcacgatagagaacttagtttgcagtatgtatggctgataatcggacaaggccaagactcattaaaatgctgggggaaagcaaaatgcctcataaaatgtgatatcatcagcctggaaatttacagaaagaaaaaatgactgcagaagatcgcagcctttcttatttatttattttaaacagggtctagctcttattgt

SEQ ID NO: 634991 - DNA, 156 bp, Homo sapiens
atacggctgcagacggagtgctgttatcgataattcggtttatcgcaccgtcaaagtactgccattgggataacacctatcaccagcgatcccgacctggatcactggtatcgagactcttttaaaatactggagtgggaatgtcttgcttcagtg

SEQ ID NO: 634992 - DNA, 381 bp, Homo sapiens
atttgggttttttttttaaacagggtatccacgaaacttctcagcatcccgatggccctgaataaaaattgccccccctcagggcagccatatatttcccgccagaataaaaaagaaatcccttttttaaaaaaacagctttccagggcccttttgccgtttttcaggagcgccagatagatttggaataggaataagctctagttttttaccaccgcccctccccccagatttagaaaaaaggtttccacctaatttagttttccgaaaaatcttgggctagaaaacttttttaaagggattttgaaaactattaaaaccgcttttttttttcccgccaggatcccacccacttgggtttgcttccattaatctttggga

SEQ ID NO: 634993 - DNA, 202 bp, Homo sapiens
acgcataggtcatcatttatattactttaactagactgtatgagtacacttaactatctagtcagagcacaaaactgaatgtatacatttcaaaaacttcaaaatccatttctctgatctacccaaaattattagctttttcataaacaagctgtagtaaattcttagggttattatttgcttttttttttttatttttatg

SEQ ID NO: 634994 - DNA, 420 bp, Homo sapiens
aatagcatcaaaacgggtaaaatacataggaataaaattaacaaaagaggtatgagatttgtacactgaaatctataaaacattgctaaagggaatataagaagttgtaaataaatggggagatagtccatgttcatggattcgaagactccatattattaattaataacaagtattggcaagaatatggagaaactggaaccctgattgctgaaacccacattgctggtgggaatgtaaaatggaatagccactttagaaaacaatttggcagtttcataaaatgttaaacatggagttaccatatgatccaccaattccactcctagatatctattcaagagaaatgaacatatatggccacacaaagacttgtacatgaatatttatagtagcactcataataagcaaaaatggaac

SEQ ID NO: 634995 - DNA, 101 bp, Homo sapiens
gagacagatgtgtcaaattactattatgctcacggattgaagagtttctcctcgtagtactgtcaaatttttgataatatgtttagaagctttgttgttag

SEQ ID NO: 634996 - DNA, 508 bp, Homo sapiens
ctttcaaggctacgtgaagttcaactctggatgagccggcttacaacgagcagttccttaaggagccaacatgacagggggggtcagaatttccctaatgagaaacaaaacgggccaccaacggcaaaatatcaaatggggtaagtccttccttcctcttcctccggattatatacaacatatctcctttcaagactataatttccatcatggcttattccgttcacacaatctaaaaccttgtgaggtgatatggagggaaaccaacatcaagaaaggaaaactcatttcagaaatgaggaaaatgggcagtgtatacaatacacccccagagcatctcaatatcccgggcacagtacaatccagtgtacggctacagcccatagataattatgggcagctggaataagctaattttttccctcagggggttaagggccaccaaacaattacggggcaacaggggttggtggggagagttagaaatacaaaattaaccaaatttggt

SEQ ID NO: 634997 - DNA, 277 bp, Homo sapiens
catggtccgagagaaattagaaatgcctgtatagatgtcctcaggggaacttgtacatagtgagtccccgatgatttactacatactctggtgccctttactacaacgcaagcatggtagcttaccatcacagtaatataccaagtacgtatgtatctagcacagtacttcaatatggttcgcatttaatcgttctgcacactgaagcatggagatttattttttccatttattcttactgtacacttttaatatcctaatttctctcggaccaatg

SEQ ID NO: 634998 - DNA, 815 bp, Homo sapiens
gggcgaagactgcggttcggcccggccacagccgcggtagtgctaggcaagcgcacggagtcacgccggcctcagccagtctgctgaacctctctgccctagcatacccgtaggtgctgcccgggcattaccaggcacgatcgtgccgatggaggccgtacatactgtatgatcccgacggggtgcgtccgttggcaccgatggactccgtcgacaggtcccttgcctcagctgataaacgttgatgcggtagtcggacgctacgtgggaccggttgatcacctcgcgaaaccagtgaatgatacgatgattcgatgcatgggttatcgactgaccgggatatcgtgctgtcgtgtactcatgttagaccgtatgtacgattgttgatcgtgcccagcgtgagtggatcgcaactgcacgtgtgacatggctatggaatgatggacactttgtgtccccaatgagttagaatcagattgggtatgtgcttagggctagggcctctgattgatgattaggcaagcgtgcatacgaaggaggccgtgagtatcattgctaggctacggacatcagcagagttctgacgtcttggtcccaccccattggtacattgcgcctaaggctgcacttctaagctttcgcaacgccaacaatgacgcccctacaatcgtatcaacaggtcccagcctgggctaaggctccaatctgaagcacacggcatcatgccggagcgcattgcaaccgatacggacacacatgtcgtcacacattaccttccgtcccttccgcgctttacctcgcttacatgcgcggag

SEQ ID NO: 634999 - DNA, 186 bp, Homo sapiens
cttaggttcactaaacattctactactcactctcactgcccaagaaactatctagactccgtggagccatcaatttaatatgactagctgacactatagcgtttatagtatagatacctctttacggactccaattatgactccctaaagcccatgtcgaagaccccgcatcgcttggtcaatagt

SEQ ID NO: 635000 - DNA, 456 bp, Homo sapiens
  misc_feature (85)..(85): n is a, c, g, or t
  misc_feature (88)..(88): n is a, c, g, or t
cggcaggtgagtgtcagtggttggggccagtgtcggagtccagccagcctgtccctggacctcagagccagctgcccgggacgtntcnggtctggggcctcctttgggtctgagagggagatctgcggcccccagtaaccacctccccgagagaggactgggacagccacctgctggccacccccctcccagagctgagtgctggtgggcagatgctgggtggatggtgagtggacccctcctcagaggctcaagggtgagcttgggcctccctgcaaggtgtctacctggaagcctggcctgctggagcaatgccaatctccccaatcctgcggccgacgtgcttggttggccaaggtaaagttgccggtgggtctggggggcaacctcccgtggcggcaacttcaacaatcctggttgtcttcgccttccccaacaaggtaacaatgttccaag

SEQ ID NO: 635001 - DNA, 119 bp, Homo sapiens
cttctgccgcttgctgcttctgcctgcttcctgcttctgcctcctgcttctgctgcttcctgcttctgccttcagcctgacccgcagtgccctgccatctagtacatacgtcagggttt

SEQ ID NO: 635002 - DNA, 102 bp, Homo sapiens
gtttgccgccagagcacaggtgtcgtggcactaccctggcgccagatgggagaggggaagactcatatcaccattgtcgtcattggacacgtagattcgggc

SEQ ID NO: 635003 - DNA, 661 bp, Homo sapiens
  misc_feature (561)..(561): n is a, c, g, or t
gaaagagaggttcagcaactccccccaatttctggtgaagccaggatttcactttaggcaatttggctactgagcgtgagttcttagccaccgtattataccacttgctttgcaatgaatccagtttcatttcctctacttaatgaaactgcagaaagcacagctcagtgcctggaattccatttcctgttatatttttatgcatttaggaattgatcctctcattaccactctgagagaagcagtacaggtgtttgggcccctagcacccagccacagggcctgaacacaatcatactcaatacatgtttattgcatgataaatgaagcctaattttactgaggaagaaacagaaactcaaagaggaggagttgattctgaaccaaggccttctgactccaagtccagtgttcttgctgcctgaacttcagctgtgacgtgtacatgcaaccttaccatccagtgggaagaagaaaataccagaattaaggtatggacagtccactatccagtgaataaacagctccattaagattaccctgagagggccaggcgcggtngtcacgcctaatcccagcactttgggaggctgaggcgggcagatcacgaggtcaggagatcgagaccatcctggctaacacagtgaaaccctgtctctac

SEQ ID NO: 635004 - DNA, 522 bp, Homo sapiens
  misc_feature (358)..(358): n is a, c, g, or t
  misc_feature (381)..(381): n is a, c, g, or t
  misc_feature (387)..(387): n is a, c, g, or t
  misc_feature (390)..(390): n is a, c, g, or t
ggaaggtcttagcggatgaagggcagtgctagcgggatggaacgttgagaagagcaggcgctccagtgcattcaccagcggttcgctagtgcagatgactgactgaagagaggttctccggggaggggccacgagaggcacagtggctctgtcgtgttacccataagatcctgatctcgttctcttgaagctgctagtgatccaagcggaaactaggtgtagtagtgaaactggggcacagatgtgaagaatctgccccctgttgagatgggtgggcgtgattgttgccccctagggtcataaaacttggagggactctctatagtgagagaggaggcctggaccgagatgtgagtcntgttgaagacttcctctctagcncccacnctnggtcctctcagataccagtggaattccaacttgaaggattgcatcctgctggggctgaacatgcctgccaaagacgtgtcagacctacgttcgtggccccctcgttcagagactgcccttctcacggctgta

SEQ ID NO: 635005 - DNA, 418 bp, Homo sapiens
cagggagctgccttgggctttcggaaaaggtcatccagcagcttggcaggtgggtccacctgggctatctctttcttctcactcttcttttctttagacttcgcacgttccttgcggcggcgggcacgggaccttgatcgggaacggggcccttctcgaactatggcccgatcccattcacgctctgatcgaggccgctccccgccggtccatttgccgttcccgtactgcccactggacccgcactgcccgtgcctgctaccgctgtactgcccgggggagctggggcggctggaccccggggggggggcgccccccccggccacaacaaccaccacgcccaccggcggcaccgccagctcaacccaccacaagaacacacatcgcacagggggcaacccatcacacactacgctaa

SEQ ID NO: 635006 - DNA, 145 bp, Homo sapiens
tgacacaaatctccaaacctacagagactgcgcggtgcattgagtccctgattgctgtcttaccagaattattgctgggacagggatgggtataacctacactctttaccaagaacagagatcctacagctttcaattgaattac

SEQ ID NO: 635007 - DNA, 378 bp, Homo sapiens
gactagatcgctcaagatggccgccagagtgtctcagaaaatctatcgactccggtgatcatgaatctgaccctccccagtaaggttctgtagaagcatagctgggtctgcatcttctctcggctactccataggtggtcactggccctatggaggtctctgaaaggggaaatagcttttctagcagagggccctggttggggagttcacagtgagaacgaacccctcttaatattataacaggctgtttcacatgaggggatgttaccaatcccgttcgctctgacccttggtagctgatcaccttgagcgacttactttacatctgtgttcctcagtttctcatgggtaatatagggataattactggcacctgcc

SEQ ID NO: 635008 - DNA, 296 bp, Homo sapiens
cgcctagtgttgcagaacatgctgtcggccccagtctgagccactcttcctgagtttcccatagcaccgagagctccgcattattcatccccatatcttcctcgtcggtctgggacaccttgtccatcagccaagggctccagctctgcggctggccggcgccatacaggatgctctgcagggccacgaagctggaacgccgctgggatgcaggatactggtaccgagaggtccctgcagcgtcccgtccttgccttgatcctcgccatatcggcgttgtatggtcccgcgactgg

SEQ ID NO: 635009 - DNA, 155 bp, Homo sapiens
gggagacagagacccagagagagagtgagacacaatcccagagagagggacactgagacccagagagagagagatcgagactctgtgacagaagcagagagagacactgagagccacggagagagatccagatacaagttgagggacacagagct

SEQ ID NO: 635010 - DNA, 201 bp, Homo sapiens
  misc_feature (201)..(201): n is a, c, g, or t
gttcagtgctggtgattcaagggttctattgttctcggtggtttggccagcagcatagtagtttcacagttagctgtgtgcccagcacagcggggtgacggcacacatgcgagtgacgactccctactagatcttcaaacatctgtcggcacgctgagagatctcgaaacaacggacgccctcacgtcctcccatcacaan

SEQ ID NO: 635011 - DNA, 552 bp, Homo sapiens
acagacaatcgcagctgacaggacgaatgaggtccagcggccctctaccgctctaggatgactctgcacttactaatcacgtgcagcttcaaacaaggaggatgttgaatgctcccagtacaaaacagggataaatgtttaagatgatgggtaagcgaattaccctgatctgatcactgtacattatatggatccaaacatcatgagtatgtacaattcgtcaataaaaaaataaaaatgaaacaggtgatgacgaaaaagaagccagacgtcaacaaacaaaaaaacaaaaaacaaaaaaaaaaaacaaaaaaaaacaaaaaaaaaagaacaaaaaaaagcaaaaaaagaaaaaaaaagaaaagaagagaaagatcacaagaaaacgaacgacgagaggacagaacgaagaggcaacaaacaaagaggagcgacaaccacaaaccaccacgacacaacgagcacaccaacagaaaggaggaacagcaacacaaccagagaaagagacagggacaagccagagaaaaaaacaccgcggggccgaaacctccc

SEQ ID NO: 635012 - DNA, 609 bp, Homo sapiens
acagcgtagttgagacatggattcagagtcaaaaccaattctagatcccaccagtatatccagtaacctctctgggtatttccccagctaccacatttaatagtaagaatgaagaagctgtctgctgtttccctcctccttccgatccaaagctgggaataaccttagggaggaggctggaccttgaagcggaccattgaaggaagggccaaggaggtgtttcagaccagccaaaggagtactgaggtagcttgttaagcttggagtttggaatgggaagacgaccagacaagtgtcaccaaggagccacggcagaaaagggtgggtggttgcaggaagccgcccacactttcccacacagggggttggtggttggcctccaaatttacagccgaatcattttacagccacataattccagaaagtagaaaattacccgaggataatggcggcatttattcaaacattttcacttgatttccataaagtataacataattaaacattatacctctacatttccaaaattcacatcaataaaccatcctaattgttaaatgcaaaccacttcaaagttacattcttagtaaacataactaaatctcttac

SEQ ID NO: 635013 - DNA, 375 bp, Homo sapiens
gcacgcgctctcgcgccccaaaccactggggccgcgcttttggtggccccggggccccggtccgccccgacccttgggggtgctccaaagtcctgggctaccgacagggtctccagctccgcagaattccaggggccaattgataaaccaaagaataataagccggttcttgataaattgcaagtgggccgagaaaaaggaatccctgttaaagcccagacagcctcttttttttccaattgggaaggaaagcaggggtgctgctcccgcccgggggtcatgacaactcaataaagccctgctttttttttttgcggttttccatttgagaaaggggagaaataatgttttccataaatgggattcatcccctta

SEQ ID NO: 635014 - DNA, 121 bp, Homo sapiens
cacgagggaaactccaagcctgaggaatgggaaatgccctctcacagctctgacactgttgccacgaagcccgacgactgggatgactatatcggagtgtagtgggaacccacactgattt

SEQ ID NO: 635015 - DNA, 1090 bp, Homo sapiens
ggcgagacccgcgagctggcgctggcccgtcgacggtcaaggccgcctgggcttcgaggtggacgccgagggattcgtcacgcacgtggagcgcttcacattcgccgagacggcggggctgcggcccggggcgcgcctcctgcgcgtgtgcggccagacgctgcccagggctccggcccggaggccgctgcccagctcctgcgctcggcgcccaaggtctgcgtcaccgtcctgctccccgacgagagcggccgggcccgcaggcctcatgggaaagcgggttcccttgctgagccatcccgtgctctctccagctctctgtcggatgaggccccagtcctgcccaaaaccaccccggacctcctcctgtggacaccacaggcaagccatcagtacccagtgctgacagtgagacacccactgacccaggacaggccaggcaagtcccagaggctcatgaggacaagggcaacccagggcgccggaccctgacgggccatccttacagcacacgtaccgtggcactctgaaggaactccagtcagcaggatcatgtcagcaggccaggcagtgggaccctggaggacgagtggcagggccatctcggagatcgactctacttgcaaaccattctggagtcgctgcacccggagagggcaaagcccatcccagaagagtgggcagacccctaagggaaactacgaaaactctgctagctgaggccagagcctgggaaacctctcaacagaacggactctcaccggagctcctgctcaccgacgctgcacgacgaacgctgaagaaacgcacacggcgaaaagcgcacgaccatgcagcacagagctgacgaaccccgagacacccaccaccggcgagctacaaaagcagcacactccaaacgggacacaacaccaacaaccaagaccacacaaaacagggcaacaacagcggaaacgaacaacacacgggaacaacaggccacgaaccacgcaacacgcgccccaaaaaccacactacaagagacgaaacaacacccccaaaacagcggggcgcagccccaccaccgaaatcagagcaaacagccaacaat

SEQ ID NO: 635016 - DNA, 674 bp, Homo sapiens
cacttggagagaacctttccttttcatttaaccaacaaataatatttattttccaatagtctccatgcccaaaacttttccaggaagaactcattacattcctaaaaaaaaaataaagggcttcaggaaataaagggtagggccataaggcaaagaattgtccccaataaaaatccaaccctttggcaaaatagtcaaatattaatggtcaggggttaatccccagtggataatttttcatggggtgtgctcccccccttccactaagtgaccaccttcagctataagcacatctgccaaacagggtaggcaggtacgtcaaaaatgctttcaaactcaaatcaggcaatttttttagtcaagttgctgttacaaacatttgccaggatttcctgggtagatcattgaaacgggttggcttgcaaagctattaaatgtttctgtggatattaggacaatggactgggtgtcatcccccataaccatgttgcctgccaaatgcaaaggccttaccatataccagccggtttcccaaccattatcccatttgagctttccggtatttggttaaaaacccatccaatttccaaattcaaaatggtttttctacacccaaagtgacccaatttttgttaccataaaaaatcattttctttccgggcccaaacagaccg

SEQ ID NO: 635017 - DNA, 211 bp, Homo sapiens
atgtcaagaaggaataatactatcactgtgcatgatatgctactctcgagtaaccctctaatcacccagcgtaccctcttacccaatatagtgcctatagccatactagtctttgccgcctgcgaagcagcggtaggcctagccctactagtctcaatctccaacacatatggcctagactacgtacatcacctaaacctactctggaaag

SEQ ID NO: 635018 - DNA, 439 bp, Homo sapiens
aatccctgtttggccccatttgaatcctgctctgcccctttccagcaatgtgaccttgggcaagtcacttcatctctctgggtctccagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataat

SEQ ID NO: 635019 - DNA, 559 bp, Homo sapiens
  misc_feature (344)..(344): n is a, c, g, or t
  misc_feature (433)..(433): n is a, c, g, or t
  misc_feature (454)..(454): n is a, c, g, or t
  misc_feature (518)..(518): n is a, c, g, or t
  misc_feature (540)..(540): n is a, c, g, or t
tagaatcagaagtttatatattctgtgattccatttacatggcattccgtaaaataaaactggggacagaaatcatatccatggttaccatggagggagggggattggagtaggcgattgatttcagaggggcctgactttttggtgtgatagaaatgtttcctgtcttgaagtgtagtgttcacacagctgtataagtttttcaaaacccacagaaccatctgaaaaggtgaatttaactatatgtaaattatacttcgaaaaatgaataagaaaagacacagtttaatagtagtcaccccttatccacagtttcacttttcaaggtttcagtgacctgtggncaactgcctcttcaaaatattaagtgggaaaattcctgaaattaaacatttattagttttatatgggctggatgctctgaggtatgggngatgaaatctcacacagaccngctgtattctgcccgggcgtgaaccttccctttgtcccttggtccctggtgtctacatttctgnccgttgggacttcgtaggcctnttcgtgtccggtccgcgtc

SEQ ID NO: 635020 - DNA, 399 bp, Homo sapiens
agccgatcatggactagacgtagataaacgtacattcaagtctcccatgcggcggtagtgaccgaatacagcaagtctctggaggtagacggcatcagataccataacattctttcctgagaatcaaacttccaagcaatggtgatgccgccgatgactgagtcactgactctcaggaggaaggtcccatctggctagttacatgagtaggtcatggggactgtcgcttgtttacaagaccccaaaatggccccgtcattccaatgaggctagagatgtttaaataacacttccattcacaccgtcaaaccattgccagaaagtgtaattccatcctggtaaattctccctgttgaactgggaccaggacacagacaggccactgtcgtcctccaggtg

SEQ ID NO: 635021 - DNA, 740 bp, Homo sapiens
atgaggtttcttaaagcttatttttataaagctttttcataaaaaaaaaaaaaaaaaaaaaaaaaaaaaaaaaaaaaaaaaaggggggggggaaaaaaaatataaaaaaagaggggaaaaaaaaaaaaaaaaaaaaaaaatatatattgaaaaaggggggagtgttaggtaggtgtattatattagtagtcttaggatggagtgcgcagtcttctaatacaaagtcgatagaagcgggggaaagcacggtatgttgtgaatcttgattgtaaaaggacaacctactatctttggggagggtggaaactactggtgcgaagactagtctctactctatgatagatatttataaatactatgagggagataagctatataaaaattctaagaggagaactaacgaggggtaagaaccaaacaaccgagcgaacaaaacaagcagatagcagggcaacgaacagactgatctcgacacctatcacgcggcgccctcttactacttctgctgagacacctatctatctatccatacaccagcaggggagcggccatatgtccataccataacccgccgaacgaaaccgcaaccatagcaagaaccctaaagacaacgactaacactacacaactatctaacggtcactggaacctcatacgaaagccactacccaacaaagtacaccgacccaccccagcccacggcaaaatcgaacaagaaccacacaatcaacgagagagaa

SEQ ID NO: 635022 - DNA, 123 bp, Homo sapiens
tggcgtgtggcagtttaaagttattagttttataaaatcagtactttttaatggaaacaatcttgaccaaaatatttgtccacagatattttggagcacccttttaaaaaagttaatgtgcag

SEQ ID NO: 635023 - DNA, 120 bp, Homo sapiens
actgcgtcaggatcagaatcatccttggagtggagtgcctggactgctcgatcatgtaatcaacgataccatatttatctcgtgggccgttgtaatcataaggccttcctttgtggaaac

SEQ ID NO: 635024 - DNA, 409 bp, Homo sapiens
atttcgagtgatggcagggtattatttattacaggtgttttaatttgatttcaaggcactttcaggtttttgcatgttttcaagtggattgttcatgttccgaggttgctatcatacaagtgatctccccgccatttataagtgcataaacaacacaagcttttattttttagcagtcactgttatcagaaaaaagcatgtttttccacaccccttgttcttcagtgagcccatctggatacttccggcatatgcctcccgtgttcgagggattctcctgtcttagcctcccagctactcgggaggctgaggcaggagaatcgcttgaacccgagaggtggaggttgcagttttctgcgatcatgccactgcactccagcctgggtgacagagcaagactccgtctcat

SEQ ID NO: 635025 - DNA, 137 bp, Homo sapiens
gcgaacacattgtcagtttgatgtggtctacagcgactaggatactcccagtcatgcatgaaatggcggtaaaaacaaagcccatctccctttccagcctcagtgcatcatgaggcctggacttccccagcagcgtc

SEQ ID NO: 635026 - DNA, 695 bp, Homo sapiens
acggtaggtgcgggattaacgtcatcccgtgggtgttcgacttcagcgagaggatcaaacaggtgcgaacatctcactgggagctggatcttgtggcgcccaagagcgaaagaacatccacggtgttactggggtgggctggtcgtggctgaaggggacatcactggcaacaaggagtaagtgggccagggcaacagctgggtcctggagggagctctggctggaagtcaacgtcagcaactcacaggggggggcaccctttacgcttgcagcttcggagtcacgggtttgaaacttcgaaataggtaccaaggaggagactctcagattctacagaacggggggtcgcagtcttgggcgacagagtaaacatttctaacttgccctttctgtaatcagtgaaagttgggatttaaacatttattcatttttaaaatactttgggaggtctgaggttgtgaaaacaaagtgggtggtctgagggtggagggaactgactgggatctgacgggtgggagttgtggggaaattggagggtatcccgaagggaattttggaaggggcaaggggggggcccttggggacaaaaccgtatgatgatccgggaacccgcaagaaatacctcagtacagacaggacaacaacgggggaggcccccccgcgtaccagcggcggcgcgtaggcgggcagccacg

SEQ ID NO: 635027 - DNA, 382 bp, Homo sapiens
atgatccccctgtgttgtcaggtctcctcgcttgctctcttactttctttctttcttttagaaggagtctcgctctgttgcccaggctgctggagtgcagtggtacaatctcggctcaccgcaacctctgtctcccaggttcaagcgattctcctgcttcagcctcccaactggctgagactacaggcatgcaccaccatgccaagctgatttttgtatttttagtagagatggggtttcaccatattggccaggctggtctcaaactcctggcctcaactgatccacctccctcggcctcccagggtgttgggattataggcgtgagccactgtgcgtggccccaatttctcaatttcttccccactaaagtgctcccagt

SEQ ID NO: 635028 - DNA, 900 bp, Homo sapiens
cggacgcgtgggcgacccactgcgtccgaagtacagccaaatgggtcagacagccctgcttgtctctggaattccgaaggccagatctctggtgtcagcgctatgggagaagctcccgttgtcatccttcgggccaagagctaggtactcaggcagcagttctaagggccccagaagtcactttggctacagatgtgtatgttaagcctgattatgggtgtgaggacaaacaagttatctggattactataacttgcatatggaccagttggaggatagcgttagtgttgacttggggtttatcattaatctaagttcttagtactttcgcagaaagtcaggtaagattagtgagctaagtacaagaagtagtcttgtacgtgcgtgcgataagttataggcaatgagtagagatatttctgatcaatcactatgatatcaggtggatttctagatagaggtcgtgaactttgtagctctataagtctacttccgtgcggtcataacattcttgcgttacagcagtactaatattgagaattcacgatagccacgatatggtgtatagtatttaggaagaaagaggctgagttgcagcagctcacgcctgtaagtcccaggctacttatgggagagctgaggcggttggataatccttgaagtccaggagttcacagcagcagcctgggccaacatggctaaataccgcatctccaattataaatacctaaattaggcaggcgttggttgagagcaagcctgtagtcccagaatactccaggagggttgaggccaggagaatggcttgaacccaaggaagccagacggttgcagtacactgagattgtgccatgtgctcagacctgtggcgacagaatagaatggttcaaaacacgacaa

SEQ ID NO: 635029 - DNA, 319 bp, Homo sapiens
tgtatgtagttagtgataattctactgaactattacagagtgagccaggaatcacatttatggattctggggatgtgtactgtaattctttgattggcgatagtgaaaactctagcctaaaaaaaaaaacaaaattatcactcaaatataagacaagtctcattcacatttctcttatacttcatgtgatacttgggtgaaactctcattttgactggcggtcccactcgtgcttttggaagaggctttgggtccacgtccccacattctcgattggcttttcgcactcgccttttgagattactcagagggtgtctcc

SEQ ID NO: 635030 - DNA, 622 bp, Homo sapiens
cggaggccatgccgtcggccggcagcagcctctggctctctgagctcttgaaagccttcatcttaggaagggaaaccgagggcaggtaacgacagggcagccaccataggccaggatggacagggcttgtctggtagggcaagcagaaacgggccccggggtactgcaccagggtgtacccgacacctgagcagacatctgggtgcctcagtctgagcgctcctgcgtgggctgtaggcaaagctcccccagcctggccccttaaagtgtggtaccgacatgtcagcacgcagcagctccgcctggagccaagctccaagcccctctccattcctgccccggaccctgaactcagtggagcccactgcagaggctcgttgggggtctattctgggccccatcatatctcccatgtggcacttgggggagccacaggcctattcgcccggatggactcatccgccgtaacgcgccaagcaccatatcaccaaaggcccaatggaccaacaccactcaccaacaacaatgggactagcgatacataggtcccaagatcgaagcaccaaagcatcccaaacggcactgatcgtggcgaaaacggagcgcataaggacagacagag

SEQ ID NO: 635031 - DNA, 352 bp, Homo sapiens
gccccctgagcggccacctgtcgccggcgcaccggataccgaccgaggaggtcagcaagcgttgcctccgccgcctcggtgacagcgctgggcgtgcggctgaactgcacctgcttgagcacctttgccagcggcgctcgttcaagaagcaactcgggaagagtcttgcggctgaagttggtcttctgggcggcctgcatcattgtacaggcgttcttaaacattagcttgatcggaacaactgacttctggagtcccctgatgaggtgaacggctcgacgagggcgcttcggatgccgacggcactcgggcggatctcccgccttatactagatcttgtggcgtacggcct

SEQ ID NO: 635032 - DNA, 90 bp, Homo sapiens
gagagagatgaagggtcttactactgtgcctgtgacaccgaaggtatctcttcaggggggatacgaacctgggacacccgacagatgttt

SEQ ID NO: 635033 - DNA, 163 bp, Homo sapiens
cgtcaggagttcgacgaccagcactggcctacgtggcaatatgctggtctctactagaaatataaaaataagccaggttatggtaggtggacgcctgtaatacccagccccctgggagtctgaggcaggagaatcacttgaacccgggaggtggcggttgcaa

SEQ ID NO: 635034 - DNA, 148 bp, Homo sapiens
ctatgtccaccagtgcggtggcggtcggcgtcaagccggaatgggtgcagcagaaggtgtgccaggccttggcggttatcttcgggaagggttcgtgtgctccggcgagctaggcgaagccgccggcccagcagctgcctaagcgctg

SEQ ID NO: 635035 - DNA, 172 bp, Homo sapiens
cagacactgcttgcatgattatgatcctgattatgcaagaaatgacccaacatagacttgcaagacatggcctgtatgagagaaaagacctcaagaagcaacgaaggacgcaagaacaagattgaggagtaggggactcaaaggccatgtttgtctgcaaaagaataggtct

SEQ ID NO: 635036 - DNA, 179 bp, Homo sapiens
gatcccgtgtacttcaattggttgagctggatagtatgcagtgagaggaatgttagtaatgggaaaaggtgatgttggcattgtaatgcaggcaaaagatctcagtgcatatcattgagtgggaggatcttgatgtagtgagaggtagcctgtggaaggtctagtaggtacggcgggat

SEQ ID NO: 635037 - DNA, 493 bp, Homo sapiens
tgcgtgataccaatcggtagcgccgacctggtcgtgcgttgtcacctgtcgggctcgagtacacgttttggttgccgaagttggtgctacccagtgtcgtgccaacgtacgaatcggtcgtgtacaggttgagcacgcccaggcccgaaccgctgctgtacttagcataggacaggtttaagtacgcgtcggtgcgcttcgacagagcgtaatcggtgccgaccacgaacaaccacgggttacccgcgttgctgttcttgaactgttggtagtaagccgtacccgtcagcgtcagagccggcgtaacttggtagccagcgcccagacagtacaggtacgagcgcacgttgccgtatgcagcaacggtagcgaagttggcatggtaccaacggtagacagagtacagattggacggaccatatgcgtacgtgccagcgatcgtggcgcgtagtaccttgttgtatgacgtagcaatgatcgtctggttacattg

SEQ ID NO: 635038 - DNA, 221 bp, Homo sapiens
  misc_feature (4)..(4): n is a, c, g, or t
  misc_feature (14)..(14): n is a, c, g, or t
  misc_feature (30)..(30): n is a, c, g, or t
  misc_feature (35)..(36): n is a, c, g, or t
  misc_feature (69)..(69): n is a, c, g, or t
  misc_feature (75)..(75): n is a, c, g, or t
  misc_feature (117)..(117): n is a, c, g, or t
  misc_feature (120)..(120): n is a, c, g, or t
  misc_feature (143)..(143): n is a, c, g, or t
  misc_feature (180)..(180): n is a, c, g, or t
  misc_feature (182)..(182): n is a, c, g, or t
  misc_feature (217)..(217): n is a, c, g, or t
gaanaagtaggaanggtttatttagcactntcaannttttcactttataaaggacaagtgctttgaaangcagangtttatgtacagttgtatatacagtatgacaagatgtaaaanaanatgtttttcatgcagtttaaaanattactaacttaagggtttctatgtgctttttaaaanantccttctttgatgttgacatcaaataaagtatgtngttt

SEQ ID NO: 635039 - DNA, 174 bp, Homo sapiens
aaaaaaaaaaaaaaaaaaaaaaaaaaagttaaccaggggtagtagtgcacacctgtaatcccagctactcaggagactgagatgggacaatcacctcaacccaggaggacgaggctgtagtgagctgcaatcacagcctgggtgacagagcgagaccctgcctccaaaaagaaa

SEQ ID NO: 635040 - DNA, 332 bp, Homo sapiens
  misc_feature (181)..(181): n is a, c, g, or t
  misc_feature (188)..(188): n is a, c, g, or t
  misc_feature (263)..(263): n is a, c, g, or t
ggatcatcgaggtcaggagttcaggaccagcctggccaacatggtaaaccccgtctctactaaaaatacaaaaattagctgggcgtggtggtgggcgcctgtagtcccagctgcttgggaggctgagggaggagaattgtctgattccgggaggtggaggttgcagtgagctgagatcgtnccactgngctccagcctgggcaacaagcgtaaaactctgtctgaaaaaactctatctcaaaaaaaaaaatagccacacaggnttttatcccttcttcccaatttaaatttgtctttttcttagggttacttcttgtggctaaaaacatagt

SEQ ID NO: 635041 - DNA, 482 bp, Homo sapiens
cggtctgatgcacgcagatcactggctgaagaccgacaggacggcacgggacgggagaccgccttagttactcactaacagatgaaatacagcctcattttgtctccataccctatcaccccaattgcgagccacaaaaaggacaacttttatcttgacagatgaacaacaacacctactactacagaaaaagagtcctccaaaaaaaagacacagattcctacaacggacggactactgagtcttagtgtctgacactacctaggacttgcaaagtgaaatctactatattcctttacacactcacattggtctggtctcatcgctaaatgctcgaagttgggggagcaagtgtgtacaaggggcaactaccaataagcatcctaaatatttatgttcattccattggattttaagtcagtctacatagagatcatagggtcttaatccaggcaagcctgtctattcttaggagaggtaaa

SEQ ID NO: 635042 - DNA, 232 bp, Homo sapiens
cgcttctagaggatccctgaaatacgacctcccacctcataaggatgcactatcaaaaaataaaaactaacaagtgtcggtgaggatgtggagggattgaaatccctatgcatgctggcgggaatgtaaggtggtacagctgctgtggaaaacagtatggcagttcctcaaaaaattaaaaatagaatgaccatatcatccagcaattccatttctgggtatatacccaaaa

SEQ ID NO: 635043 - DNA, 351 bp, Homo sapiens
cccaatggaatccccctggagattcggtgtcatcttccaggacaaacagcggcatactgccgtgtgtcacggtccccgcgctgtacagctcctcccagagcttctcaacagggaatatttttcccgccagactgttatccgtctgcgaatccgcaataatcacccactcccacaggtaaccttttcggttcaaagggctgatggtgagcgcgcgataaggccacgcgctaatcaccccttgcgcaagcacactttttcctgaccctttaccgccctgtaatattagccattgttcctgaattaacgtggaaaacatgctgtcccgaatcagacaatgccgcgtagtataaa

SEQ ID NO: 635044 - DNA, 737 bp, Homo sapiens
tcctagaggatcccgcctacatagtgtcaaggaaaggcacagaatgatgtctctttcaatcagaagccagaaatgattaagcgcagcaaggaggccatgtagaaggttaagatccactaacaagttagacagacggctgtgaacacaaaggaagagttctggaaggaaatttagaggtggtactccacgggcgaaatgaatactaaaaagtgaaacagccttattgatgatctggagaaagcgcaagtggtctggatagaagatctaaccagccacaacattcccttacatgaaagcctaatccagagcaaggccccaactctcttcaattctatgaaggctgagaaaggtgaagaagctgcagaagaaacggtggatgttagatgaggtaggttcacgaggtttaaggaaggaggccatcaccataacataaaagtgcaaagtgaagcagaaaatgttaatagaaaaggtgcagcaagttacccagaagatctagctaagatcattgatgaacgtagctacactaaactgattctacacgtagaccaaaaagccttctatgggaagaagatgccatctaggactttcatagctagtgagaagtcaatgctggcttcagagtttcaaaggacagtctgactctcttgttaggtgctaatgcagctgacatataagtttaaagcaatgcttattgggcattctgaaaatcctagggcccttaagactatgctacatta

SEQ ID NO: 635045 - DNA, 118 bp, Homo sapiens
  misc_feature (48)..(48): n is a, c, g, or t
aattagctggacgtggtggcgggtgcctgtacgtcccacgctaccttncggacggctgacggcacggacgacactgggtacccgacgctcgacacttcgtaactcactggtcactacg

SEQ ID NO: 635046 - DNA, 1227 bp, Homo sapiens
  misc_feature (839)..(839): n is a, c, g, or t
  misc_feature (843)..(843): n is a, c, g, or t
  misc_feature (846)..(846): n is a, c, g, or t
  misc_feature (864)..(864): n is a, c, g, or t
  misc_feature (1070)..(1070): n is a, c, g, or t
  misc_feature (1097)..(1097): n is a, c, g, or t
gaaattgtacagtagtacaataatacattctaatccatagtttatattcaaatttcatctcttgtctcaaggatgtccttcatagtgtttcgttccccctagtccagtatcaagttgtcatgcctctctggcctttttaatctgggttggtttcttagtctttcatgaccttggctttggcctggggctggggcgttaaaaagtacagaccaattattttgtacagtgtcctttgatgtggggattgtctgatgttttcttgtgtcctctttgggatcatgtatttttcagaagattgctatagaagtaatgatatgtccgtttcaatgtgtcttatcagaagggtgtgatgtcactttgtcctataaccagtaatgttaactctgaccacttcgttaaggtggtttctaccaggcctgtccagtggaaatttatttatttttccttttttaaatgatgagtaatttgggggaagatactttgagactatgtaaatatcctgaatctccttaaacttttacccactagttctagcatctgttggtgagtcttgcctgaatcagttattactataaagaatccatgctgggttttctaactccatcattctgtctacatttattagaatcagtaggctgtaatatatcactatcagtatttatttgcttatgtttgtttaaacttatttaatgtacattcagtaaaatgcactgttttttagtctgtacttgtgaatttggacgaatccattgagttgtgtaaccaccacacagtcaagcaacagaagctccatcacctcccaaaatgttccctcatcaacccttcacgcctcccttgancttngtnctccatcgctaatgattngccttttccagaatgaatatctatggaatcctagtctgggttgcttttcagtctggcttctttcacttaagataatgcatttcagattcatctactttgttttatttaccattaatttgttctttttaatgctgagtgctattccattgtgtgaatgtgccccagtttgtttatccatttaccctttaaagaatatttgggttgtntccagttttcagaatttgggaataaanctgctacaaatgttcacatacagtttttcatgtcaacataggtattcatttcatttggataaatgcctaggagtcaaagagtctctctgaaagtattctggtttgggtggctggctggctggggttcaaa

SEQ ID NO: 635047 - DNA, 111 bp, Homo sapiens
agcctgacctctccttcataaagttattcagcttcctacactattaaagtttactacaaccacgaccaatgatatgaaaaaccatcgttgtatttcaactacaagaacacc

SEQ ID NO: 635048 - DNA, 207 bp, Homo sapiens
ctggggctcccctttggccatccctctcctcccagggcctgcccacagctcgggccctctgtgagatccgtctttgggctcctccagatggagctggccctctcctggggatgtgtaatggtcccctgcttacccccaaagacaagtctttacagaatcaaatgcatttttaatctgagagctcgcttgagtgactgggtttgtgat

SEQ ID NO: 635049 - DNA, 385 bp, Homo sapiens
cccagggcacagggaaccagcagcgtagagctgcagcgaaagggcggagggatcgcgcaaaatatgaggaaagaaagcaacatgcagagggggcacaacatgaactcacttccataaaacaaagagcaaggtttaaaaattccacgtggttcacgtctgtaatcccagcacttagggccattgtaacacattttttatatccagtccaccactgacagacaagtaggtggattccgtatctttgctattgtggatagtgctgtgaaaaacagaagacctgtgtctctctggtagaattatttgctttctttaggatatatacccagtaataggattgctgggtcaaatggtatttctgtttaaagttctttgaggaatctccaaa

SEQ ID NO: 635050 - DNA, 134 bp, Homo sapiens
gccgtcatctactctaccaaccttttcaggcacactcatcacagctcttagctcgcaataattttttacccccccccgggctaggaataaacccccctgattttttattcccgcccgcgcccccaaaaaaatta

SEQ ID NO: 635051 - DNA, 239 bp, Homo sapiens
  misc_feature (8)..(8): n is a, c, g, or t
  misc_feature (38)..(38): n is a, c, g, or t
  misc_feature (40)..(40): n is a, c, g, or t
  misc_feature (42)..(43): n is a, c, g, or t
  misc_feature (45)..(45): n is a, c, g, or t
  misc_feature (48)..(48): n is a, c, g, or t
  misc_feature (118)..(118): n is a, c, g, or t
  misc_feature (152)..(152): n is a, c, g, or t
  misc_feature (165)..(166): n is a, c, g, or t
  misc_feature (168)..(168): n is a, c, g, or t
  misc_feature (179)..(180): n is a, c, g, or t
  misc_feature (223)..(223): n is a, c, g, or t
  misc_feature (225)..(225): n is a, c, g, or t
  misc_feature (229)..(229): n is a, c, g, or t
cgcaagtnaagaaatatatacatatatatgtatatatntntnncncanaatctgagagctcagggaggccgtggaaatttggggaagaagaaacagactccctgagcagagctcaggncagcagctccaggcatgcctgctgagcccatcangccaccgcacctnntnaagagcctctnncctgaactgctggggatgggctgcagaaagcctgagacatttngnccancaccttccca

SEQ ID NO: 635052 - DNA, 771 bp, Homo sapiens
caccatccagtcgacatggcaagcacaatggcgtatgcacacagaacactacatttctcactatgcatcagagagaacatgcattttcacaagtcataaccagtttgcagtaattcaagcctctaaaacaggaccagggacatttagaaaccagatgtccatgtgctacggtgtggagcaataatgttgtcaataatcaccacagctattaagaaagcgatcatcacgacacatttgccttcagtcttggtaaaacattacttatttacactgcattaaaaataccttctatgtattagtgtccaacttttcacacttctgggcgtaagaccaaatgtagtttgtatacagagaagcacacacctcaagtaataggcatttcacgtaaaagtctacctgtgtattgggctaacaacggctgctcacaagttctatttcttgacgcactaaattctacctccttgtgtgccactgaaccaggttctcttcctggcatcatcaaggcagtggtgtaactcattttacattcccactgacaactttaccagtatccccttctcattcgaagggatcgggtatccgagctctaataatagttggtttctaaatcagtggtggggcatctaactccacgctgcgcgtcactcactatcaaggacagaggcggcaccaacgttttgcaacccacgttcatcatggaactcgccctggaacactcgttcgcgccttaaggcgggctaggagccacacagggaccgcccggcaccgaaa

SEQ ID NO: 635053 - DNA, 162 bp, Homo sapiens
tgtggtgctctagagttccccaggcacaagctcctacgggacctgtccagctgggagctggaagcctggtactgaggacctgcaaggaggtcctcgtcttcagaatgaaaatagggggtcacctatgtattcacctcactttacggggcttcagaggggttt

SEQ ID NO: 635054 - DNA, 1610 bp, Homo sapiens
  misc_feature (1)..(1): n is a, c, g, or t
  misc_feature (990)..(990): n is a, c, g, or t
natgcttgtagccgtcgggtgtgctgttcgtgactgcgtgcttttgcttcgtctgtgtgatgtcagtggtgcccctctctcttcttgcttttgttggagtggagtgcttggtctgctcgtcggtagcctgtatcgttcactacctgtggcaaggggctggtttcttttgttacagggtgcgcttcttctccacccccttcttcgctcttggcggatgtttcttgttcttcgcgcctccttcttgtggcctccttcctgctttcacgcgtcgcccttctgtgtgatggtctggcgccgggcgagctctctcctcggccaaggctctgttgtgtacgcctccaacacacggggttgtttttctgcgggggcggaccgaacacaccacccgatggtgttgttcgccggcgccctctgttctccgctctcgtggctttgtccagtagagagtggttgttttcctctccccttcttggggtctctccctcccttgcctccctcctggggatgttgttcctacggctttcctctgtcgccgcgcctccccctcctccgtggggtcccgcgcaacatggttaactcctccgccgtgtggtgggaattctcgttgtgggggctccccactcttcctctttgggggccccgtccaccaaggggcccccgcacaccgcgtgtgcccccagccgccaagaatgattgagggaagttgtttggcccacacacccctcagggggaggtgtttatctcggtacccggagtgttcttctggggccccccccctccccccatttctgggtcctccccccccggcccgtagaatggccttgtctttataaacccgggagctttctcccgcccctagaggttgtcgcgttatcgccactctttgggctccgcccacttgcgggttttatatttggaggagaatattgagaaaagttggtggccccccctcgggccacaaaatgggcaccacccacccctccactgggngctataggcctcttcactcgcagaaatctcgggagattataagcgcctctttcgcagaaatagagaagatgtgggcccctctggagaaggctttgtgatattctgagtaattccacgccactctcggagattgtaagagaactctgttgtctgagattttgagcccctctgtatattgagaagttataaactcgttgtccccctctggtatattaaacgcggtccacgcggcttgaagtgttttctcgggatatttcttcttagagggctggcccacgaaacccagttgtgtttggttctctgcgggttctgtccacgggttgggaagttcccacgcccgcttggagcccacggttcctctttcttaagctgatgttctcttggcccggacacccgctgggctgttacttgctttgagttggaaagcggtttgcactttacgcccgtaaaagtattcactttttataatttaatgtaaggttttttttgtaaccccatttctcgagtttctttgaaagagatgacacaccaattttggttttttactgttatgctgcaggacctttggcccccgccacacgtccttgtgtaagggaaaattaaagtgctgccgtaaccct

SEQ ID NO: 635055 - DNA, 153 bp, Homo sapiens
gacaaatcagtcatagcactgcctatagcattagccagtgaccaattagggacacgtcttggcacagattgcttatcaaggacatttccacaagaaggaaatattaagggttatttccacagagcccaaacgcttggaacacagaggtaggag

SEQ ID NO: 635056 - DNA, 682 bp, Homo sapiens
  misc_feature (3)..(3): n is a, c, g, or t
  misc_feature (101)..(101): n is a, c, g, or t
  misc_feature (117)..(118): n is a, c, g, or t
  misc_feature (194)..(194): n is a, c, g, or t
  misc_feature (217)..(217): n is a, c, g, or t
  misc_feature (224)..(224): n is a, c, g, or t
  misc_feature (226)..(226): n is a, c, g, or t
  misc_feature (241)..(241): n is a, c, g, or t
  misc_feature (246)..(246): n is a, c, g, or t
  misc_feature (248)..(248): n is a, c, g, or t
  misc_feature (266)..(266): n is a, c, g, or t
  misc_feature (278)..(278): n is a, c, g, or t
  misc_feature (280)..(280): n is a, c, g, or t
  misc_feature (282)..(282): n is a, c, g, or t
  misc_feature (285)..(285): n is a, c, g, or t
  misc_feature (287)..(287): n is a, c, g, or t
  misc_feature (291)..(291): n is a, c, g, or t
  misc_feature (300)..(300): n is a, c, g, or t
  misc_feature (315)..(315): n is a, c, g, or t
  misc_feature (334)..(334): n is a, c, g, or t
  misc_feature (341)..(341): n is a, c, g, or t
  misc_feature (343)..(343): n is a, c, g, or t
  misc_feature (354)..(356): n is a, c, g, or t
  misc_feature (358)..(358): n is a, c, g, or t
  misc_feature (368)..(368): n is a, c, g, or t
  misc_feature (386)..(386): n is a, c, g, or t
  misc_feature (394)..(394): n is a, c, g, or t
  misc_feature (401)..(401): n is a, c, g, or t
  misc_feature (405)..(405): n is a, c, g, or t
  misc_feature (422)..(422): n is a, c, g, or t
  misc_feature (445)..(445): n is a, c, g, or t
  misc_feature (448)..(448): n is a, c, g, or t
  misc_feature (484)..(484): n is a, c, g, or t
  misc_feature (491)..(491): n is a, c, g, or t
  misc_feature (514)..(514): n is a, c, g, or t
  misc_feature (596)..(596): n is a, c, g, or t
  misc_feature (656)..(656): n is a, c, g, or t
tgnaaataaaatataaaaactgttcttggaattatttctaaacagaactggcctctaatcctaacatcacagaaatgtatataataatcactattaggtanttttttcgtgtgaggnnaatttcaaagcacggaacaacagaaagtgaaacatcacattccgcacaaaaatattgccgttctctatagatcttnccatcctcgtcattgtgtgaccngcaaaantncagtgaccagttggnttttntntcttttatggtggtaatnctgttgggaaantntnttncnggtnggccaagangtgtgacatcatcanagcgtggacgaccccaganacgttgntnccctggttcannntntttttttttnatccttttaatcaatttnatttttangtttctnttgnaaactatttgctcaganttttccttcttgaacaggatgtnggngttaagcactgtaatgtttagaaggtggagaaaganttttttntatcaaaccttgtgtgttatctnaggggaaacgctgcagccgcaagcaccgctagcatgtattctcggcgcaaaagggaaaggattttaatgatattctgggaanatgtgctttctctgttctggatgttgacctcagccaggagaattgtgattcctgtctttnctcagggaaagaatcttcctcttcct

SEQ ID NO: 635057 - DNA, 334 bp, Homo sapiens
  misc_feature (308)..(308): n is a, c, g, or t
atccggcagcacgcttgattcggagctgccgcttcttccatcaggccctccaggtccattgctctctataatctagcactgttgtgctgtgatcatcatttatgctgtaaaacggaccatctttcaacagggaaagcattactgtgatgtgcttaaaccatttccatttacagaagcacacactgtaccacattacgaacagcgaattttttttcaccctaggtgcataaaaataattatagtagaataactctttccccatcttcatcacactgtccactgtccactattacaccatcaccctgatntagagtacaagcatttgattttcaca

SEQ ID NO: 635058 - DNA, 325 bp, Homo sapiens
ttaaccctaggcctctggtgccatctccgctccctggaagaccttgtcccagttcttatctgtcgtgcaaaggccagacattgctacatcagtatagcttgtcaggtacagcaacacatacatcattaatgtagaagtcgtgaaggggcttttatactttttacattgacttaagagattaaaaataaaaccattatccatctaataaataagacatcatctccaagggtggcgatagcttgggatggtcttcaatgtcatgtgtccatggaagatgttgggctggttgagggtctcgtggttagaggatacagcttctcttaaa

SEQ ID NO: 635059 - DNA, 364 bp, Homo sapiens
cgtcttctcacatctggttctgaggctgagagacactgggccagtgcagaggggatgcctgccctgccctgccagctctgaggctgagacacactgggcctgtgcagagggggacacctgccctgcccagccatggcccccaagagcacaggggtgcaaggccaggccagaagtggaggccgcccagtcacctctgcgggcacttgcagaggtctgagcagagaacacctctgcgggcacttgcagaggtctgagcagagaaccagacacctcaccccttcacacccttggtgtgcactacctgcaagagtcaatgaatgaatgagtgagggaaggagtgcgggaataaaccaatgagtgaaag

SEQ ID NO: 635060 - DNA, 129 bp, Homo sapiens
aggttaattgtgttcatctgcagatgagttttgtaatcattttgttttgttttgttttgttttgttttgttttgtgttttctgtcctttccttccctgtcccttaccacttcccttctgtcgtcttctc

SEQ ID NO: 635061 - DNA, 344 bp, Homo sapiens
ccgtgcgcgatggctcatgcctgtaatctcagcactttgggaggccaaggcaggcggatcacctgaggtcaggagttcaagactagcctggccaacatggtgaaactccgtctctactgaaaatacaaaaattacccaggcatcgtggcacacgcctgtaatcccagctacttgggaggctgaggcagaagaattgcttaaacctgggaggcggaggttgcagcgagccaagatcgcgccgctgcactccagcctgggcgtcagagcaagactctgtctcaaaaacaaacaaaaaaaaccaaatctaaatgcggccgttcgagctcacttggccttcgcccttg

SEQ ID NO: 635062 - DNA, 980 bp, Homo sapiens
  misc_feature (270)..(270): n is a, c, g, or t
tgtgtccgccgttcctcctgcaccacacctgggcggtgctgcatccatctcgccggcgcgggttgagtacatagccgcgcggtggttgtgccggcccacgatcgggtggtcgccgtcagccccttgggtggtgcattttgctccccactccggggggcgtgcgcactatattgtgtgcccccccagcgtgttcgctccgtggtcgcccccggcgtgctttgttttttgtctcgccaaaaagcgggtcgtccttcataaacaaggcggagnacagttttgttgcgttgtgatcagtactgcgtgattggtggccacgcgcgtcggaagaacagaccatgtgtgggaacaacaaacacttcccgtgcgaggggcggcgctccccccgcccgtgctttttgaggtgaatgttccgttgggggttggctcgctccaacccgccggcgctctttcgagggaacgtcgcgttttgtcttctgggccaaccaaatgtctggtcgcgagcgtttatagccatgttcccttcggggggagggccacgcctgtcttcgctccgtatgatctattctctcccagacccgtggagatataacaacttagccctgctcgtgttttgcagatacatagcactcgctcgaagtgcactcccccgcgcgtgacacctcatctttttcttgctctgcgtcgcatcccccctcgctaatctgtatctattggtaaggctacttatcggggtggatccataagagcagcggtgggtgttgttaaagagagagggggatgtatggatatacagccccccttcttggtccagaagagtatctcttctcttgttgtctccctctgttctgtgctgtgaaggaaggcctgcgtcgtgtcgtgatgtttcgtttgtgccgccgtctgtctaaggaagagcgggggaccaactttgcccccccgtccccgggatttttttttggggggtttctcccaacataaca

SEQ ID NO: 635063 - DNA, 168 bp, Homo sapiens
agagtctcctgaattttctagtatttttccccgagttgattttggtctctctgttttggcaatagggggccgggctcagtgcggaaggggctgccgagatcccatgctctcacaccatgtttttgtaccgaactgatggttgaatctttgttctcttgaaattaaccg

SEQ ID NO: 635064 - DNA, 651 bp, Homo sapiens
tccctcagccaccaaattttagacagctcttgctctgacagaggtgcagcctatgactacatggctccagggcatgccactcaccctgcagtccgcatggccttgggtggcggctatcacgcttatccatcaggggccggtaaagctctttccgaaagtcgctgccgcatgtgtgacaagctgcttaatgccaaccagccatgagcttccagatttatcagacatattgcaccgacgtgtaggcagacgctaacagcctgatcacttggaacctgcagctcaagtacatctaatgctttatgtgatgcaatttcgaccgtgatggtgcgtttctactagatgttagccacgtcgttcaggaactgaccgagacgaagcgtgtaagctacatgacgtacgtagagatgaaattctagtttgtcaaaccgagctcatttcgagacatcaagacgacctcttcactttgccgcatctcgcccctagactccttgaccgctccccctgtccttggagttcgttgaccaggcccctttggcatcttatagccctgcctccctgccccctcggacccctatctctccgccctacctgttcccatcttcttactgaggctgttcagtctattccgccctctcgctcccccctcccccg

SEQ ID NO: 635065 - DNA, 120 bp, Homo sapiens
tgagtagcgtgcgtcagcgattggccagcgtcatggcgtggcaaagcattcatcccggtcacttttggttacaggacgtggcagctgtcgggctagtcggggactgtcgggctagtcggg

SEQ ID NO: 635066 - DNA, 122 bp, Homo sapiens
tttttttgtgcaaatatattgactttatttgtctcctttcaggagcctcacagactatcacggtaaaaagatcgttaaataaatgccttcagcccatcgcaatgcaaaaataaatatcaatc

SEQ ID NO: 635067 - DNA, 665 bp, Homo sapiens
cggcctttgcaggcccactcgagccctaatggtgggtctcctggtgctgggcttcctggccacagtttgtggccaccgatgggcatgaagtgcacgcgctttgggggaaacgaccaagtgaagaaggcccgtataccactgggtggaggcataatttgtcatcgtggcaggtcttgccggccttggtagcttgctcctggtatggccactcagagttgtcacagacttttataaccccttgagtgccctgcccaccttaagtatgagtttggccctgccactctttaattggctgggcacgggtctgccctagtcaatcctgggagggtgcactcgctctcctgttcctgtcctgggaatgagagcaggctgggtaccgtgtaccccgctcttaccctaagtccaactcttccaggagtatgtgtgacctgggagtctccttgccccacgcctgacacggctatgggagtgttctagattgcctgaaagggcctggggctgagctcagccttgggcagggtccggacaaaggcctcctggtcactctgttcctgcactccatgtatagtccttcttgggttgggggtgggggggttcccttggtgggagagaccaaaagagggagagtgtgctttttgtacagtaattaaaaataagtattggga

SEQ ID NO: 635068 - DNA, 185 bp, Homo sapiens
tgagtacagctatacatcattggccgtcgtgtacagataacagctataaccaagcacaggccgtcgatagtacagttaacagctataaccatgcactggccgtcatttgtgacagctaaatagctatgaccatgcattgcccgtcgttgcccaccatcggcaataaccatgaatggctcggcatg

SEQ ID NO: 635069 - DNA, 174 bp, Homo sapiens
tagcccgctcattctggccctccttctggccgctgggtctctgttctttctgttgatttccttaagtaaataatgccaaacactttaatcagtcataaaattgtgaacagtatactaataattgatttaatatgttagcattatttacttaagggaatccacagaaagaacagg

SEQ ID NO: 635070 - DNA, 105 bp, Homo sapiens
atatggaggatggaccgcacagctcacagccgtttctggagcttctggatcctaggctcatctccacagaggagaacatgcacgcagcagagatcatggtgctga

SEQ ID NO: 635071 - DNA, 433 bp, Homo sapiens
cccccttttaaaaatagattggttaaaaccaaaaacctataagagagaaatgatatttcaattgtattgtaggtttggggaatcctggttagatttataatttctggccgggtgcggtggctcatgcctgtattcccagtacttttgggagcccaaggtgggtggatcacctgaggtaaggagtttgagaccagcctggccaacatggtgaaaccccatctctactaaaaatacaaaaagttagctgggaccacaggtgtgtgccaccacacctggctaatttttatggatttttttttcttttttttttttcgccatgttgcccaggctggtcttgaactcttggcactcaagcagtccttctgcctcggcctcccaaagtgctgggattacagatgtgagccactgcacctggccccagaaattatgctta

SEQ ID NO: 635072 - DNA, 159 bp, Homo sapiens
aatttttttgcccccccaagggggggaaaaaaagggccccggattttcctggatttcccccatatttttgttttttttccccgaaaaagtttatttaggccatgtcctttgctcaaaattgagggggtttttccccataaaccgtaagtttttgtttta

SEQ ID NO: 635073 - DNA, 233 bp, Homo sapiens
aagatagaagtgcataatgtgaagcactatggctagtatatgtttagccacatacgcttgtcacctatgaggaagatcacacagtgtgtaccacacttcggcatacattatcatgttgctgctgctatcatgtgttacaagaaatgtcgtacggtatgacaaagttgaaaatacacatgaagtgaaaaatgtcttaggaaaaaaatagctattttcatgcaattatgtacagt

SEQ ID NO: 635074 - DNA, 235 bp, Homo sapiens
  misc_feature (224)..(224): n is a, c, g, or t
ttggaccggatgtgctgtaggccagcgtctacctgttccgcttccatggcgccagcggggctcgacggtcgccctcctgctcggcgctctcggcttcaaggcgctgctgctgttcggggtcctggccgcccgcgctgcccgccgccgcccagagcatctggacaccccggacaccctaccacgtcccacaaccgtgtcctgtagtccctgtttgcgtgatttanctgtcgcacca

SEQ ID NO: 635075 - DNA, 376 bp, Homo sapiens
  misc_feature (46)..(46): n is a, c, g, or t
gactctcgagggagcccagcgagcagcattccagctacaatatttnaccctttttaatgtcctctgtgtccttaaaatgacagcctcctctcctggaactggtctctactccgggacatcaacaaggccctgactggaaagcacatagaaaaagggcagatggaggctgggcacagtggctcacgcctgtaatcccagaaccttgggaggctgaggtgggcagatcacctgaggtcgggagttcgagatcagcctgaccagcatggagaaaccccgtttctaccaaaaatacaaaattagccgggcatggtggcacatgcccgtaatcccagccactcagaaggctgaggcaggagaatcgcccgaacccaggagg

SEQ ID NO: 635076 - DNA, 344 bp, Homo sapiens
cccttttttctggggggcccccccccccggggggaaaaatttttttttgcccgggggggtttattccttttaaggggggggcccccgggatttgccaattggcgggggttttcccccccctggggggggttccccaaaattttgcccccaaaaaaaaaattttttcccccgggggggggagaaaaaaaatttttttttttccccccccgggggggcgggtttttttttcccccccccccccccccccgggggtttttttttcgggggggggttggccccctttttttccccccccccccccccccccggaatttttttttttttccccccccttttttttttta

SEQ ID NO: 635077 - DNA, 407 bp, Homo sapiens
ggaaaaccactgtgactcagtaaacagcttcataaattatccatcaaatgtttttatttatttcacgcactcatactaagctagacatattgcttattaaggtttcacttatttgagcatggtgatgcttttactagagatttatagaattgcatcagtttctcgcttaaatgaacacctaggtcctttcaaacttttatatatgtggtccctcacctaataataattttaccaagtcaattttttccagctactaactgtgacaaagatgcttgtaaagcatgtaaaagtctgttaaacccctgtttacattggacatctggtctgtaatacagtagtttctccttttctgctgtttgtcagttaattaaaatagactttaaaataagttaaagttgtttcctcta

SEQ ID NO: 635078 - DNA, 980 bp, Homo sapiens
ggtgcgcgacggtggtggcgtgcgcgggaggttctggagcggtggagctcgtggctcgcggacggtatggaggactacgagcagagagctgtgcggcgtcgaggatgatttccacaagcagttcgcggccgagctggaggtgctggcagagctggaagtgtggctgtcgactccgtcgccctccgggggtccccctgttcacctgctgggcctgacccctgtggactgttcggaggatggcccttgccaagagggggacgctgggcgtccaagtcccgccccagcctgcatcttgtgtggcaagcatgccagtggctggctgccatgtggaatgacgggcctgcgtgtgactgcctgaccttgcatgctgtgctgggtccctgcccccatgccgcccatgtgatcaaaactgtgctaagtgttgcatgttgttggtccaagatgtgcttgaaccttcaagtgtcggaggagattggatggagcccgccccttccctgattcctccgccgacgtgacatcaaccgcgcgcagagcctgaaggactcgcagagcttttgggggccaccggagtctcagaatgcttgctgctgacgtgggtctcacacgggcctcaagcagctgcctgaatcccagtctgatggcgtgcccccatctttggaggactacgtccactgtgaccttcaacggcaggacgtccggcgcttatcttggtgcttgcggtgatggcccctattgagcccgggggtagcagggactctctcctacacgtccattgcgaggctggtgccacgcttgaactggcttggatgggtctttagccttcctgaagaagaggtcgacggcaaaacggcggaaccgcgtgttaaggaggccaggagattaagacacgtgaacagctcaggtgtggacgaggaggcccaccttggggcctaagagaacgatgacgcagaggatacaactggtgtggttagtgacgccac

SEQ ID NO: 635079 - DNA, 128 bp, Homo sapiens
gaccatgatcatgggcccctcggcttcttgccctgattctgggccccctcgtgcttcttgcactgattctgggacccctcggccttcttgccctggttctgggccccctctaccttttagccctgatt

SEQ ID NO: 635080 - DNA, 2270 bp, Homo sapiens
  misc_feature (72)..(72): n is a, c, g, or t
atggcgtccatgcgggagagcgacacgggcctgtggctgcacaacaagctgggggccacggacgagctgtangcgccgcccagcatcgcgtccctgctcacggccgcaatcatcgacaacatccgtctctgcttccatggcctctcgtcggcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaagaagggcacaaaacaccgaaagacaccaa

SEQ ID NO: 635081 - DNA, 1434 bp, Homo sapiens
  misc_feature (236)..(236): n is a, c, g, or t
gacagcatgtgcaaccacgatcttcgtgagagcatcctggctgtaccacagttaccgacgcctcgatcaaggaagtacttcaagggctacgtgcgaggtctgacgacggaccagtggatcaatcagccgatgccgtcacatgaccggagcacaggtccgcggcggtcataggtgcctgtcggtgataccaagtggttcgatgcacgcgagtgggctcgactgatgacggagtcatntgctagaagagagccgtagtcacccagatcactcagacggcacgcaatggaccgtgcgcgtgacaggcctgtgacacgtcgtacatggaggcgaccatagtccctggggaggtcacatccacgagcgaggcctttgagcatgtgggcgttggacgacatgtggtgggatgccgcaacccttgaaatccgagacggatctgtatatcgagggtcgtgaacccgctcgagggaggattaagatccataagcccagattccacatggtcggtaatacgggttgccaaagcgcctaatgctgttggcgttgcaatcccacagagaggctcgggtcgccaattggttaaccctggtgcagcctgtgggtcctctctggcccgcgctatacggattctaagcaagctccacttacacgctacgtggaccgcaatgacacacacctgaggccgtgttaagcggagcacccgaaggggtaagccctacaaaggcgactgtggctacgtagaataggctctatagttgtaacggggcgcacagggaaatataacgcgcctacccgatggggttaaagccgcgccaccgcgcggttaaacacccgacttccgggaattaccagtgggggcccccgaatggcgattgtgtaccggtttggccccgctgcagaccgattatatggcgggggattggtgggtgtaccaattaacccgattggttgccggattaatgtgcgctgcctcttgtttaccccagggttgcgccagttaatgggaaccccgactgtgaagcgcgcggggccgaccgtcggttgtcagctaccaatagcgaaacgccggtggcgacgcgaatacaggtgtgccacggtgccggcagtgggggagcccgacactacacgcagcccgctttgatatttgcggtgatgtaggaaccaacacgggagatcaacttgcctaaaggagtgggatcaggggaccacaggggcattaaagcagcccacattgggggctaacaggtccccgcctatgggaaacagtccccggttgggcacaacattggaccccactgttgtttatcaacacagtggtggtgggaagcctgggactttagtaccccctgtgttagtgatgccgtagcgaccgtcgggtgagtggttgtgcccacaccctgttgagtgcttgagggtgccacgcacacaattggtcgg

SEQ ID NO: 635082 - DNA, 389 bp, Homo sapiens
gggtgcgctcctcttcatactaactacctgactcctaccccttatcaaaaattaattcaagatggattaacagactgaaactgttagacctaaaaccataaaaaccctagaagaaaacctaggcaataccatacaggacataggcactggacaacggagttcatgactaaaacaccaaaagcaattgcaacaaaagccaaaatagacaaatgggatctaattaaactaaagagcttctgcacagtgaaagaaactaccatcagagtgaacaggcagcctacagaatgggagaaaatttttgcaatctcacccatctgccgaaagggttaatatccagtaatctactagagaactttaaacaaatttcgcaagtacataaaatcaatacc

SEQ ID NO: 635083 - DNA, 157 bp, Homo sapiens
  misc_feature (126)..(126): n is a, c, g, or t
cgaagttagttcaaagaaaagcagaagtgtgagacgcagacgcttagcgaaaggtggtcctctgcctgggaagaatgggaggcagcatcccggcaatcttccagccacccgtcatgtcactttagnacgggaaagccaacctaacagcaggccacca

SEQ ID NO: 635084 - DNA, 2171 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 635085 - DNA, 174 bp, Homo sapiens
ggtatccacctcagaggctctcagcaactgacaacgattcctcctcatgccggaactggacactgatacatggtgttgtcatccccaaacagggtccaggctgtctgtacctgtcacagactctggaaagctctgagggcagcaagggaaggcagtgagaaaggggggagtggg

SEQ ID NO: 635086 - DNA, 2267 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 635087 - DNA, 2275 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcgatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 635088 - DNA, 441 bp, Homo sapiens
  misc_feature (89)..(89): n is a, c, g, or t
  misc_feature (232)..(232): n is a, c, g, or t
  misc_feature (238)..(238): n is a, c, g, or t
  misc_feature (243)..(243): n is a, c, g, or t
  misc_feature (381)..(381): n is a, c, g, or t
  misc_feature (432)..(432): n is a, c, g, or t
cttgattcaccttcacctgctctggccacccgctgacccggggtttccggccggagagcagtcagatatgaacggacgggtggattatntagtcacggaggaagagatcaacctgacgagaggaccttcggggctgggcttcaacatcgtcggtgggacagatcaacagtatgtctccaacgacagtggccatctacgtcagccgtatcaaagaggatggggctgcggcagngattgngggcntccaaggagggtgataagatcctctcggtaaatggccaagatctgaagaacctgctgcaccaagatgctgtagacctcttccgtaatgcgggatgtgctgtgtccctgagagtacagcacaggttaccagtgcagaanggacctatagtacatcgaggtgaaaggagagccaagtggagttcctgtaanctatggtgc

SEQ ID NO: 635089 - DNA, 334 bp, Homo sapiens
caatctgaagaaaaagcataatcaaagtaatggcaagccggacaccacctgggtccaattaaataaaaacaaaccaggtcatgagcaaaggtcatggcaaaagttttactggatattcaaggcattttgcttgttggctttctagggggtcaaaggcaataacatgagcttactatgaaagtgttttgagaaaatcagccaaagccttagaagaaaagcactcaggaaacctttaccagagagtcctgctcaattctgtcatcaaacgagggcaattttgccagagttttgatgggaaatcattatatatttaaattacaatcctgatttgaaa

SEQ ID NO: 635090 - DNA, 2309 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtcaccagcctcgatgtggccgtggaggggcttaacgggcagctgcccaaccttgacctgctcaatctcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 635091 - DNA, 2146 bp, Homo sapiens
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacatcttccagaccttctgccagaaagggggcctgttgtgcacgcttcagggcaagctgcagcccgaggactggacatcattggatggaccgctgcagggcctgcagacactgctgctcatggttctgcggcaggcctccggccgcccccacggctcccatggcctcttcctgcgctaccgtgtggaggccctaaccctgcgtggcatcaatagcttccgccagtacaagtatgacctggtggcagtgggcaaggctttggagggcatgttccgcaagctcaaccacctcctggagcgcctgcaccagtccttcttcctctacttgctccccggcctctcccgcttcgtctccatcggcctctacatgcccgctgtcggcttcttgctcctggtccttggtctcaaggctctggaactgtggatgcagctgcatgaggctggaatgggccttgaggagcccgggggtgcccctggccccagtgtaccccttcccccatcacagggtgtggggctggcctcgctcgtggcacctctgctgatctcacaggccatgggactggccctctatgtcctgccagtgctgggccaacacgttgccacccagcacttcccagtggcagaggctgaggctgtggtgctgacactgctggcgatttatgcagctggcctggccctgccccacaatacccaccgggtggtaagcacacaggccccagacaggggctggatggcactgaagctggtagccctgatctacctagcactgcagctgggctgcatcgccctcaccaacttctcactgggcttcctgctggccaccaccatggtgcccactgctgcgcttgccaagcctcatgggccccggaccctctatgctgccctgctggtgctgaccagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagcta

SEQ ID NO: 635092 - DNA, 382 bp, Homo sapiens
  misc_feature (21)..(21): n is a, c, g, or t
  misc_feature (23)..(23): n is a, c, g, or t
  misc_feature (55)..(55): n is a, c, g, or t
  misc_feature (112)..(112): n is a, c, g, or t
  misc_feature (162)..(162): n is a, c, g, or t
  misc_feature (252)..(252): n is a, c, g, or t
  misc_feature (347)..(347): n is a, c, g, or t
  misc_feature (363)..(363): n is a, c, g, or t
  misc_feature (378)..(378): n is a, c, g, or t
tcggcacgagggagacggagntnactctagtcatccaggctggagtgcagcagtncgatcttggctcactgcaacatccgcctcccaggttcaagcgattctcctgcctcantctcccaagtagctgagattacaggcgcccaccagcacgcctggctaatntttgtatttttaatagagaaggagtttcaccatgttggccaggctggtcttgaactcctgacctcaagtgatccaccggcctcggcttcnaaaatggttgacattacaggcataagccaccatgcccagccttttgtccctgtatttaatcagcccgtgaggtaaaacattacctcagtttaagnttaaagaagtaggggntaggtaggttaaggntttc

SEQ ID NO: 635093 - DNA, 1224 bp, Homo sapiens
  misc_feature (1124)..(1124): n is a, c, g, or t
  misc_feature (1140)..(1140): n is a, c, g, or t
  misc_feature (1160)..(1160): n is a, c, g, or t
  misc_feature (1181)..(1181): n is a, c, g, or t
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggggctctgccagtggcctggcttgaacggacgatgcggtcagtagggctggaggtctacacgcagagtttctcccggaaactgcccttcccagatgagacccacgagcgctatatggtgtcgggcaccaacgtgtacggcatcctgcgggccccgcgtgctgccagcaccgagtcgcttgtgctcaccgtgccctgtggctctgactctaccaacagccaggctgtggggctgctgctggcactggctgcccacttccgggggcagatttattgggccaaagatatcgtcttcctggtaacagaacatgaccttctgggcactgaggcttggcttgaagcctaccacgatgtcaatgtcactggcatgcagtcgtctcccctgcagggccgagctggggccattcaggcagccgtggccctggagctgagcagtgatgtggtccaccagctcggccctgcggcccagagcttatttnccttttagttgagggnttaatttttagctttggganttggccttctttttttaaaangttcgtgacttggggaaaacccgggggttttacccacttttaa

SEQ ID NO: 635094 - DNA, 636 bp, Homo sapiens
  misc_feature (624)..(624): n is a, c, g, or t
ctcgaaagatgagcacaatttcatcatgcacagaagggaagtgtaaagacaggaaacagcatgtgaaaggcattctattctatttaaatctaggaatactggctttaggatgttcttggctgattaaatcagatgcatcatcatattatactatcatgatttacccatactgggtattgcctagaatttatccatggactcttcattggcatcattagtgatgagagcttgaagcttgagcacaccctggcataaagatgtttgtaacacaagacatagattggactcttggttctctgtgtcaggtttgggttcacctctaaattgagatataccacgtattaaactgggtgagttgctacacatggaaaggttaaaaaattaatggccatctataccaaactcacattaaaccatatgaggcttccactatatggcacacgaagaatatggcatatcacctaaatctcaagctatgctatatagaaaatgtctattcctatgagcacatgagtctgactaccttctcttaaaagtaatatatataacatctctgtgaattaatttttctctaacaataattatcttaaaggtgaccgaaatgcctgtggtttatcatggganataggagttttt

SEQ ID NO: 635095 - DNA, 1567 bp, Homo sapiens
  misc_feature (726)..(726): n is a, c, g, or t
ggcgctatctcgcagcccccgaccagctcggcctgctgtcgggcatctctgctgtcctccggctgtagggctacctgcctccctcccggggggtgcactgcgagtccgactctagtgggggcagcgcctagcggactcccaaacccgctcaggtcctgccggcctcaccggcaccgcccaccctccagccggccgcggctctgcgcttgcgcgccggcagcacacagtgttaggggcgcgccctctgctctggacatgcgcgccgtcgcgagcgtctctgggaccggaagtgcgggcgagcgcgggtccccgggtctgacaggagcagcctgtgggcaccgcggcggtagttggaggcgggagagggtccgtagccgcgccgccctgccccgccatgggcctcctgtcggacccggttcgccggcgcgcgctcgcccgcctagtgctgcgcctcaacgcgccgttgtgcgtgctgagctacgtggcgggcatcgcctggttcttggcgctggttttcccgccgctgacccagcgcacttacatgtcggagaacgccatgggctccaccatggtggaggagcagtttgcgggcggagaccgtgcccgggcttttgcccgggacttcgccgcccaccgcaagaagtcgggctggccaccaccatggtgcccactgctgcgcttgccaagcctcatgggccccggaccctttatgctgccccccttttnggtcttggggggctgaaccaagcccggcagccacgctccttggcagcctgttcctgtggcgggagctgcaggaggcgccactgtcactggccgagggctggcagctcttcctggcagcgctagcccagggtgtgctggagcaccacacctacggcgccctgctcttcccactgctgtccctgggcctctacccctgctggctgcttttctggaatgtgctcttctggaagtgagatctgcctgtccgggctgggacagagactccccaaggaccccattctgcctccttctggggaaataaatgagtgtctgtttcagcagctaaaaaaaaaaaaaaaaaaaaaaagaaaaaaaaaaaaaaaaaaaaaaaaaaaaagagggggggacacacaagaaacccacaagggggccccaaataagaaaaccacaatatatggaaaaggggcccaaaaggagccaaaaacaggagccaggaccacgaattaacaaaaatgtgaatggaaaaaaccgagtagcaatcgcaacacttgaaaagagcaccaataacctcgcagggggacaaatattgcgacaaaaccactaagagatataaaacacctagggacaacattacaattaacaggtgctaacgggtgagaaacacaacaggaatctatagagcgggcgagagaaaatattcagcaagagggtatagtttgagaatttcagggggggatagtaatatagagaagaagaacaacataggagaaaagaagaatgagacaaacagagaacacaagataaatcaagaaaataaaagaagagagaagagaagaaaaagaggagtaaataaaaaaaaagc

SEQ ID NO: 635096 - DNA, 538 bp, Homo sapiens
tgcctcagcctccggagtagctgggattataggcatgcaccaccacacccggctaattttgtatttttagtagagatggggtttctccatgttggtcagactgctctggaactcctgacttcaggtgatccgcccgcctcggcctcccaaggtgctggggttacaggcatgagccaccgcgcccagcccacagtaaaatatttagttcctcttctcccatgcagcacctacaacaatactgggcacatagtctttaataaataacacttcactgatttagtgaccttttcttctccattgtggctccatcaccaattactaactgatagaactaaaggcaatagaaacaccactgctttgcatatctaaagtttcatgtgtaacttaatgtcacgaatgctgatctttcttatttggccctcttttcctgtatgttgcaactaataaaacaggtttctaataagaattaaattaaaagccaaagtttccaataaggtagtgagcattactggagaaagagagaaggccctgaaagtga

SEQ ID NO: 635097 - DNA, 445 bp, Homo sapiens
gggagagagagagtactagtctcgacttgttttttttttttaaatgttaaacactgacttctttaatgtaactctttccagattatttcaacaagcaaagtaagtgtcagcgttttactataattgccaaatggtattaggaatataacctttcctcccttgcttacaacaaaaacaatacaaaaattaagttatggtaagatatttatcaaaggggattttaaacaaaattctcgctcttgtcaccaaggctggatgtgcaggggcgcaatctcagctcattgggaacctccacctccggagttcaagcgattctcctgcctaagcctcctgagtagctggggatatacagggtcccaccaccatgcctgtaatcccagcaaattgggagatattcaactagagacagggtttcgcctgggtgacagagcgagacaccatctca

SEQ ID NO: 635098 - DNA, 568 bp, Homo sapiens
  misc_feature (433)..(433): n is a, c, g, or t
  misc_feature (470)..(470): n is a, c, g, or t
tagatcgagctcggtaccggccccctggggaatgggtggcaggaggcagtcccatggtctcggacggcactcttggagtcactgtgaccttttctgaaggataacacagtgggccctcagctgagcagctctatcagccagtttcctgtctaaacaatcccactaatctgatagccttctttcacttcatcctgtccaagctggcagtgtttgtgttgagacggttgactggctctatcacatacctaatgtcttcacaaaagtgtagccacactcttagccctgtctccagaacatgttattcagacaggctgagaattttctaaattctcagatgctagttccttttctcttagcaggtccttactcgattgctcatttgtgtcacattattaagcagcaaaaagaaatcaggctacaccttccacaattngcttggaaatttcctcaatgaaatatccaagttcatngcttacatattctattttccttccaacaatagaacataattcagccacaatctgtcactttcttttttcttttttttttttttaagcaattccacagg

SEQ ID NO: 635099 - DNA, 253 bp, Homo sapiens
gcggcggcgagcgctctacgatgatcgacaagaactgcggaggcggagagaagagcggcgcgggcagtgacgttgctgctgttgggtgctggggagtcacggaagagcaccatcgtcaagcagatatagatcatccacgagaatagctactccgagaaggaatgccggcagtaccgagccggatagtctacatgcaacaccatccagtccatcatggaccattgtcaaagccatggggaacctgcagaatcga

SEQ ID NO: 635100 - DNA, 595 bp, Homo sapiens
  misc_feature (539)..(539): n is a, c, g, or t
  misc_feature (541)..(542): n is a, c, g, or t
  misc_feature (544)..(544): n is a, c, g, or t
agaacgaccactgaggggttgcttgctctgatggaaacgttattcctaggcttcatttctgaatatggatgtcccactgccagctttgggaagccttcaccatctctgcctatacagatggacacactccctgcctgtgctgctgctagactgtgcttacacttccatcacagaatttatttgattgggttatcatggcttctctgctggaatggaagctacttgggagcctggggaaatgcttggctcaaagcagcctaagattggacttttgagatgtcttttcagacttctgcacttctgatggttggatgactccactgagacccaagacttaagactcacctggtcctatagcccccacccagaagtggactcagcacataagaaccattttctacatctctatgattgcacccctgaccaatcagcagcacccattccctagcccccagcccacctaactatcttgaaaaaactctagcctccaaattttcagggaatctgatttgagtaataaaatcaacccatctgttatnannantctggccatttagctggttctatgtatattaacctgtttctctattgcaaa

SEQ ID NO: 635101 - DNA, 561 bp, Homo sapiens
  misc_feature (505)..(505): n is a, c, g, or t
  misc_feature (507)..(508): n is a, c, g, or t
  misc_feature (510)..(510): n is a, c, g, or t
agaacgaccactgaggggttgcttgctctgatggaaacgttattcctaggcttcatttctgaatatggatgtcccactgccagctttgggaagccttcaccatctctgcctatacagatggacacactccctgcctgtgctgctgctagactgtgcttacacttccatcacagaatttatttgattgggttatcatggcttctctgctggaatggaagctacttgggagcctggggaaatgcttggctcaaagcacttctgcacttctgatggttggatgactccactgagacccaagacttaagactcacctggtcctatagcccccacccagaagtggactcagcacataagaaccattttctacatctctatgattgcacccctgaccaatcagcagcacccattccctagcccccagcccacctaactatcttgaaaaaactctagcctccaaattttcagggaatctgatttgagtaataaaatcaacccatctgttatnannantctggccatttagctggttctatgtatattaacctgtttctctattgcaaa

SEQ ID NO: 635102 - DNA, 258 bp, Homo sapiens
agaaggatctcaaactcgaaccaccagaagaagaaattattgaagggaatactaaatctcacatcatgcttgtagcagcggcagatagtctgtgatagacagaggacctggcaagaattccatgctcgctcctgcaacactacgtggagcagtgcttcctcccaacagtgtgatgcttgcagtatttactatacagacagctttcaaattgaatctcgtctacatgatctatgatgttctcgggagcaatacgtagtg

SEQ ID NO: 635103 - DNA, 419 bp, Homo sapiens
gcatattattgcaagtgcttcaagcaaagaaaagaacctgatttcacatttgagatgcattttaaaccaaaggtctgttctggtacctccacaaggaagcatcaatcggaccacagaaaatttacatccagggatttgtcttctggaatggatctcactgacctacaagaattgaatttgcccgtgtcttcacaacaccttgttagtggtatcaaatcaggagattgaagtgagccatagtgagagtatggacaccacagaaatcaacttacatatcaaggctttttctttatttcaggagagccagttcaatagtacaacacttttatgatcttccctcttttgctcacacctccctgccattcctgttcccagtccatacttgaataaaaatgttgcaaataacatcagttcagaaa

SEQ ID NO: 635104 - DNA, 403 bp, Homo sapiens
gtaatccctgctggcttttaactttttagtaataactattctgactggcgtgagatggtgtctcactgtggtttagatttgcaattctctgacggttagtgatgttgaggattttttcatttgttggtcacttgtatgtcttcttttgagaagtatctgtccatgtcctttactcactttctagtggggttatttgtttttgtttgttgatttaagttagttatagattctggacattaggcctctattagaagcatagtgaatattttctccattctgtgggttgttgatagtttctgttgctgtgcagaagttctttagttatttggtcccactgtcaatttttgtttttgtagcaattgcttttgaggacttagccataaattctttgccaaggccaata

SEQ ID NO: 635105 - DNA, 210 bp, Homo sapiens
ggtctatttccactccctcccaaaactccacttaaatgaaaaaattttaaaaagatgtatttggaagaggaggataacattagagatgtcagcaaatttttggaagatggacaagtaggatggggggagtagcagcaaacgcaacaaagcagagcaacctgtaccctaaaaggcttgcagatgggggtactaaacagaagcgagtgtttg

SEQ ID NO: 635106 - DNA, 245 bp, Homo sapiens
  misc_feature (2)..(2): n is a, c, g, or t
angttgtgcagtaatcatattatggccaagggtcatgatggcaggagtaatcagaggtgttcttgtgtagtgatatgggtggacaggttagaggagtcgcttattaggtacggtagatggtaaaccgctggctagggtgagttcatatgagatcgtgggggctactgctcgcagagcgccgatcagggggtagtttgagtttgatgctcaccctgatcagaggattgagtaaacggctaggctag

SEQ ID NO: 635107 - DNA, 370 bp, Homo sapiens
  misc_feature (14)..(14): n is a, c, g, or t
  misc_feature (31)..(31): n is a, c, g, or t
  misc_feature (49)..(49): n is a, c, g, or t
  misc_feature (144)..(144): n is a, c, g, or t
tagctgaacaaaanggcagtaaaaacttctngcaggttaaacgtccccncgttgacagctctgaagagagcagtggttctcccaggcatggtgtttgagctctgagaatggacagactgcctctcaagtgggtccctgaccccnctgagccaaactgggagacaccttcccagtaggggccaacagacaccctcatacaggcgggtgcccctctgggacgaagcttccagaggaaggataagcctgcaatatttgctcttctgcaatatttgctgttatgcagcctctgatggtgatacccaggcaaacagtgtctggagtggacctccagcaaacttcaacagacctgcagctgagggacctgactgtt

SEQ ID NO: 635108 - DNA, 767 bp, Homo sapiens
ccgctgctatgtagccccattcttgactagtgacttcatctttcccgcagtcattcatctctattcaggtgaatatcagctccgcagacacagcagttatacagcggagtcccccacagtcaccctgatggccgtacttagtgattctgggtctacccatcccctgttgcacctttgtgcacagtccaattcatgtgggaaaatgttctgtttgtagaactcctagtattcacttatagtgctcatgtcacggaatggccagtgacgtaagagcccccgagtaatctgcttttgttagcacgttatgccaagataagtgaaacaacatggccaccttcttttctagttctaatcacgtttttagacatccagatttatgttactttgcactgacgatttgtttcctattatttgagatatgtggctatacgcttggattaggaaaacctgcttgaatgtattgtcagttattaaagcacatgtgactaagtttgcatttgtcagtacttgttctactgtttgtactgagaagtctcattttaaaattgccgtacttaacagctgtgactataccttgtaattttttagattctccacttgtgattctttaaatgtttccagatgcctttagttttagctggctgtaaaatagctactttgcgttatttgatatagaattgttttttaaaactccctttatttatacagagacatttataatattttaccaacatttttatattctggataaatatttctaattccca

SEQ ID NO: 635109 - DNA, 500 bp, Homo sapiens
  misc_feature (33)..(33): n is a, c, g, or t
  misc_feature (59)..(59): n is a, c, g, or t
  misc_feature (76)..(76): n is a, c, g, or t
  misc_feature (105)..(105): n is a, c, g, or t
  misc_feature (136)..(136): n is a, c, g, or t
  misc_feature (153)..(153): n is a, c, g, or t
  misc_feature (177)..(177): n is a, c, g, or t
  misc_feature (277)..(277): n is a, c, g, or t
  misc_feature (334)..(334): n is a, c, g, or t
  misc_feature (479)..(479): n is a, c, g, or t
  misc_feature (482)..(482): n is a, c, g, or t
caaaaaaaaaattaaattgaaatttggtttacncttttttgggccaagtttttttgtgnctcctttaacacattanccctgtgactccttaaggtaacatatttnacccactaagccccttaaatttaacacaagntgaaatatgctgacttntgagtcaaaaaacttcacaaaaanctccgaactcacagaaacaagtcagggcaccctcccataggggaaaaacgtaatgtggccacgaattgggtgcacgcctgtaatcccagcactttgaganccgaggcaggcagatcacttgaggtcaggagtttgagaccagcctggccaacacagnaaaaccccgtttctactaaaaacacaaaaattggccaggcgtggtgcacctgcctatagtcccagctacttgggaggctgaggcacgagaatctcttgaacccaggaggcagaggttgcagtcagccaagatcatccactgcacntcnccctgggtgatagagcaa

SEQ ID NO: 635110 - DNA, 865 bp, Homo sapiens
gaccaattctttgctttatagccaaagaagaaggaataaatctaagaggaggaactggtcaaaaccatactcccacttgtcttcttgtatgacatcacagcctttcttacattgcatgtaatcacctgtccactgtcaggctcctggactatgagcgctttgagggcagagaccacattttttttttttccgtgggattggagttctcacttcctgtcgcccgggcgtggagttgcacggggcgcagctttgggctcactgcgttctccgccttcccgggtttcaggcagctctctccgtgccttagcctcccgagtggggctgtgggatctacaggtgcccgccaccatgcccgtgtcatccccgtgccgtggcatgagtgtcctgaaaatgtctataggcatttaacacaacggtacattggaataaacaacttgacattctggtatatatgtcaataaaactgaattaaatggactatggatgcaacattttaactcccaacacagtgctggcattcgattttctttcttaacttcttaaggttgaccatcgaaccttacagcatccaggacgacctaaacggcaacatcggcacttttgggctgacccagaaatccatttctgggtacttaggcggacttttttacaacataatacttcattcaagcgagctctcagggggtggcacgctttggggcaccgcccatactctgttggataactttcataccggcctatttcacgtcgcacaccgcgcaagagacgattatctcatctgccggcgctacacgtatagacgccaggcgatggaccggtttgatgaccaaacgtcttccctagctaaataatatcgtcagtattc

SEQ ID NO: 635111 - DNA, 917 bp, Homo sapiens
gcgtctttaaggccctgcgatggaagtccctggacgcaccgtctgtgctgcctaggctagacacatcgggcgatctgggaagtccaactacttccttatgatcatccaactattggatgatccatccgaagagtgtgccattgtgcggagcgagacaatgtgggctccaagcagatgcacgcagatccgcaatgttcccttcgtctggtgcgcacaagtgcatgctgggtgctgatgcgtgcaagcaacaccatgatgcgcaaggccatccgagcgcacctgcaaaacatcccagctctggagcacaactgctgcctcatatccgggtgggaatgtgggctttagtgttcaccaacggaggacctcactgacgcatcacgggacactgttgctcggccaataaggtgccaaggctgctgccctgaggcttggttgcgcgagttgcccccattgtccaagtcatcttgcagccaaggctccatgcaacactggatctacgtgggcccgacgaacgacctccttttggccaaggctcacagtgtgatcaccatctaacaatctccagaggggcacccatttgaaattcctgacgtgattgtgcatgcttgatccaacgaccttggacgacaacacgttgggagcccaagcgaacgccacgcctggccttgaacatgctccaacatctaccccccctctctcccttttgcggctttgttcatccagcaacgtgttacgaacacatgggcaaggcaatcctatcaaccctgaagcgttgctttgcatcatccaccagacggaaaaactcctgcatttctcgcccttccctggaggcggtgtcccgcacatgcagccagatgtctgtcttgccagcattgggctacccacactgttcgcattcagtaacccattctattact

SEQ ID NO: 635112 - DNA, 741 bp, Homo sapiens
  misc_feature (25)..(25): n is a, c, g, or t
  misc_feature (64)..(64): n is a, c, g, or t
  misc_feature (70)..(70): n is a, c, g, or t
  misc_feature (107)..(107): n is a, c, g, or t
  misc_feature (111)..(111): n is a, c, g, or t
  misc_feature (115)..(115): n is a, c, g, or t
  misc_feature (125)..(125): n is a, c, g, or t
  misc_feature (128)..(128): n is a, c, g, or t
  misc_feature (134)..(134): n is a, c, g, or t
  misc_feature (142)..(142): n is a, c, g, or t
  misc_feature (144)..(144): n is a, c, g, or t
  misc_feature (146)..(146): n is a, c, g, or t
  misc_feature (148)..(149): n is a, c, g, or t
  misc_feature (151)..(151): n is a, c, g, or t
  misc_feature (154)..(154): n is a, c, g, or t
  misc_feature (158)..(158): n is a, c, g, or t
  misc_feature (162)..(162): n is a, c, g, or t
  misc_feature (173)..(173): n is a, c, g, or t
  misc_feature (176)..(176): n is a, c, g, or t
  misc_feature (186)..(186): n is a, c, g, or t
  misc_feature (213)..(213): n is a, c, g, or t
  misc_feature (220)..(220): n is a, c, g, or t
  misc_feature (228)..(228): n is a, c, g, or t
  misc_feature (236)..(236): n is a, c, g, or t
  misc_feature (242)..(242): n is a, c, g, or t
  misc_feature (245)..(245): n is a, c, g, or t
  misc_feature (261)..(261): n is a, c, g, or t
  misc_feature (273)..(273): n is a, c, g, or t
  misc_feature (278)..(278): n is a, c, g, or t
  misc_feature (296)..(296): n is a, c, g, or t
  misc_feature (312)..(312): n is a, c, g, or t
  misc_feature (318)..(318): n is a, c, g, or t
  misc_feature (320)..(320): n is a, c, g, or t
  misc_feature (324)..(325): n is a, c, g, or t
  misc_feature (333)..(333): n is a, c, g, or t
  misc_feature (358)..(358): n is a, c, g, or t
  misc_feature (360)..(360): n is a, c, g, or t
  misc_feature (367)..(367): n is a, c, g, or t
  misc_feature (400)..(401): n is a, c, g, or t
  misc_feature (413)..(413): n is a, c, g, or t
  misc_feature (415)..(415): n is a, c, g, or t
  misc_feature (439)..(439): n is a, c, g, or t
  misc_feature (442)..(442): n is a, c, g, or t
  misc_feature (445)..(445): n is a, c, g, or t
  misc_feature (464)..(464): n is a, c, g, or t
  misc_feature (466)..(466): n is a, c, g, or t
  misc_feature (480)..(480): n is a, c, g, or t
  misc_feature (483)..(483): n is a, c, g, or t
  misc_feature (485)..(485): n is a, c, g, or t
  misc_feature (489)..(489): n is a, c, g, or t
  misc_feature (531)..(531): n is a, c, g, or t
  misc_feature (537)..(537): n is a, c, g, or t
  misc_feature (553)..(553): n is a, c, g, or t
  misc_feature (579)..(579): n is a, c, g, or t
  misc_feature (589)..(589): n is a, c, g, or t
  misc_feature (717)..(717): n is a, c, g, or t
gggatcggacgccgaggcaggtttnggagtggggagtgcccattttctctacttccaaagttcntggccnccaaacgccatttgcaggcgggtgggttgggtgaggntggncggncggaggggantcncgtaangggagagngnananngngcnccgngaangaatgaggagnggngttaggtaancatgtttgagtgtggaaacagtgagcntggactntatggganagaggggngggganggnggaaggagggtgggtntggtggcccccngaatntctttgggcctggtggtngggagagggagtagantggagnangggnnagagaganaagggatgggagggaagagaaaagnanttccgtnatgcagaaaacccccatcatcctctcaaaaggnngaggagaggggngnaaagagggaggaggtggaagaggnggnggnggggggggtgggggagggncngtggagaaggccanggntntcangaagggaggggagggggggaaggggggtgtggcgtgagaggngcgtcngggcctgagggcgagncccaacaccccctgcagcccctgcgncacacaaggngggagaaggaggggcagagacccacacagcctgtgtaccagatccagaaccggggcatgggcactgccgcaccagcagccatggaccctgtcgtgggtcaggccaaactactgcccccagagcgcatnaagcacagcatcaagttggtggat

SEQ ID NO: 635113 - DNA, 376 bp, Homo sapiens
tctatgccttggtataatacaaaggaaggattcggagagtggaggaatgtggaatatcggagtgaactaggcacgtatgactctatcaccaactccttctctatgtccctaagagtaccctgtactaaagcagtgaagaaaacactgatgtcaaagtgagtagtggacaatgatgggaattcttcatatgtaagggataaaagtgggcgtgaagaccttggcatggattagttgaggaagacttgagcaatttttaacacagattttgaggcttgcctttctttggcccattcttttttcctttttctccaatattccagtctctttcaacatgaccctttatattctaaagtgtgtaaccaataaagaacatagc

SEQ ID NO: 635114 - DNA, 139 bp, Homo sapiens
aggagctgctgccacagctgctgctgcacgacgagcgctgcctgtgttactgcagcttccacttcatattacgggcgggatcggagggggtgcgtcgcgctacagccccagtccccactgttggagagggctacggtta

SEQ ID NO: 635115 - DNA, 396 bp, Homo sapiens
  misc_feature (116)..(116): n is a, c, g, or t
  misc_feature (122)..(122): n is a, c, g, or t
  misc_feature (127)..(127): n is a, c, g, or t
  misc_feature (140)..(140): n is a, c, g, or t
  misc_feature (155)..(155): n is a, c, g, or t
  misc_feature (297)..(297): n is a, c, g, or t
agggtcctgcttttttcctgctgttttgggaccaggcttttgctcctcctcagccagcggcaaaagcagggttgatgttcagggaccccccaaccctcaaaccttgcctccaaggntgggcnttaantgggtgccccgtngccctcccaggccantaggttttgatttttccagcacccatggatgtgccaaaggcctttgggttggtttgcatgtcatttgcaaatcgtttgcatgccctcatcccccccattttcagggcagtatgggaagccccaaggtgacctggccaagtancaataatttgggtccagggtcccctattgcccccaaaggccttttaaccccaggttggggccccagcacaaaggcaataaaggcagtggtcccttccca

SEQ ID NO: 635116 - DNA, 121 bp, Homo sapiens
ccacccattttcttgggaaaaagcttgagtgtaaacccatttgtaaaaggctttcccatactcattttaatatgggcctgttgctgttaacttttgatgaataaaaccctttcttttctta

SEQ ID NO: 635117 - DNA, 307 bp, Homo sapiens
gaaatatatctggggtaaaacattttgattttattcccttgttatgccatgagtcagattagaaagtaagtcacaatatacagggttaaataaaacccatctgctgagaatttatggtttgtagggcatgactccccataccccttagaaaggaatttgggcaagatgcacaactcagagcttcagtcctcaggtgaataggtggagcattcatacattgttggaaaagagtgcatgcagcatcgttactgtaggctacgtagaagttacagtagttataggttaagtggcacgtggtcgcagattc

SEQ ID NO: 635118 - DNA, 568 bp, Homo sapiens
ggccgggcgcggtggctcacgcctgtaatcccagctctcagggaggctaagaggcgggaggatagcttgagcccaggagttcgagacctgcctgggcaatatagcgagaccccgttctcccgaaaaaaaaaaaaaaaaaaaaaaaaaaaaacaattgtgtgggcgcgcgcgcctggggccccgagaaaaagttttaaaaaccaatccgggggggcgcgcgcggggcgcccaaggggaaagggaaccagggcgcgcaatagcgcgggttcccaatagggaaactccggggaccagagagaaaaggcggcggggagattccctcccaatatataaaaaagcgcgccgggggggggaaacccgagaggcgtttctgggaaacaatcccaaagagggggggtcccggagaggagccaataaggggagatctatacacacaaggggagaggccccaaaggaggaaggcccagattatacaaatttaaccgccccgctgcgggggggatcaagaaagaagaagaacaaagaaaaaccaaacaacacacaaaagacaaaaacgaaaaaaaaaggc

SEQ ID NO: 635119 - DNA, 1162 bp, Homo sapiens
ggcgggacaaaagcacgccccggcggtccccaccacaagagatttggagaggaaaagggtgcgtccccccgcccgcgcagcacgaagtgtggtcccgtggaggggaacgacggaactttgaaaagataagtgccgccccggacaccaagggggagggaattggaagaagtgtaaagaagggaaaaggaattttttgcaaaatggccaagcgcggggttttccaagtttaaaaaattcggaatgggggcaaaaaggttctcggaaaccgtgtgaattatgtagaacccgtgacccccttggcctggggagttttccatgggggaatggtccattcgagccaactttgaaaccacaggaaccggggagaggaggaaattttttccccgtttttgggagtctttaagtggaccagcccacaaaggggtttccgctttttttgccttgggaacacttcggtgattgtaaacacgccttcggagagagagggcgcccacaaggtgaacaaaaagtgttgtggccacaaaaagttggaggagaaaagaatctttttttggtggggcaccacaaaagggagatttccccttcaatcttgggtggaacctcacatgaaatgcgcccgcaccacacatcccgcggataccccgggagtctcccctctaatcaacaagggtggaaatgagatacccacttcaagagttagaattataagaggagctgggccaaagagttacctcgagtgtttcacttcaaagttttcgagacacctcggtaaacctcgtggtaataggtgagaactcggaggggtggttaacacctatggaaagagaattggtgtgaatcacccacaacaagaagaagagaggcacaccctggagttctttttagaacgctgggttcacacggtgagaaagaatgccacaatggcaaacaagcttttgccacactctgaacctttccaacactttttgttaattggcaagggcacacacaaacactggagtttttcttccccgagggaaaagggtatccgcctcaccacttgctgaaagaagaagagacacaaaagaactggcggccacaaacaagagagcagtgggtgaaatgggtccctgggtgacatgtcagatctttgtacgtaattaaaaatattgtggcaggatta

SEQ ID NO: 635120 - DNA, 280 bp, Homo sapiens
cgctcccgattcctaattacggagctgtagccgccagcctatgccagaaccacagcaatgcgggatccaagttgcatctgcaatctacaccacagctcacggcaacaccagatccttaacccacggagcaaggccaggatcaaaccctcaacctcatggttcctagtcggattcgttaaccactgagccacaacgggaactcctaaaagagtcttgatgcttttctctgtgtatcttttgtgcgtgtgtgtgtgcgtcttttttgttgagctttgacttt

SEQ ID NO: 635121 - DNA, 505 bp, Homo sapiens
aaaatagattcttgcatgaaaccatattcatcacactctttaatcatgcctaaaaatccatagacctgcttgcgattaactcatcccggaacgcagacatcacacaattcaacactcaggcattgtttcctagttttcttacacctttccatcatctcggtcagcagagcctcgcgcgggcatggtaggagatgcactggaagatccagtccactggcaggcgggtacaaggggaggtaagatgggagctccactccttggaccaccagctggttctggaccgtatccccatgaatctgtttgaacgtaaggaggaagtcaaagaagttcttatttacgggtttccttcgagatgtggggccacttccattcccacccggcacaggtcggcacgggcatacaccgacactcgtgggtctccgatccctctgatcatgcatgtcaactggggcaggcactctgaaactcccgttttggagaggaatttgttacatttcaggatgga

SEQ ID NO: 635122 - DNA, 979 bp, Homo sapiens
  misc_feature (1)..(1): n is a, c, g, or t
  misc_feature (132)..(132): n is a, c, g, or t
  misc_feature (136)..(136): n is a, c, g, or t
  misc_feature (168)..(168): n is a, c, g, or t
  misc_feature (170)..(170): n is a, c, g, or t
  misc_feature (179)..(179): n is a, c, g, or t
  misc_feature (200)..(203): n is a, c, g, or t
  misc_feature (216)..(216): n is a, c, g, or t
  misc_feature (224)..(224): n is a, c, g, or t
  misc_feature (236)..(236): n is a, c, g, or t
  misc_feature (255)..(255): n is a, c, g, or t
  misc_feature (258)..(258): n is a, c, g, or t
  misc_feature (267)..(267): n is a, c, g, or t
  misc_feature (320)..(320): n is a, c, g, or t
  misc_feature (323)..(323): n is a, c, g, or t
  misc_feature (327)..(327): n is a, c, g, or t
  misc_feature (334)..(334): n is a, c, g, or t
  misc_feature (399)..(399): n is a, c, g, or t
  misc_feature (441)..(441): n is a, c, g, or t
  misc_feature (451)..(451): n is a, c, g, or t
  misc_feature (528)..(528): n is a, c, g, or t
  misc_feature (649)..(649): n is a, c, g, or t
  misc_feature (865)..(865): n is a, c, g, or t
  misc_feature (979)..(979): n is a, c, g, or t
ntttgatagaggggacaatcttgaataaaattacaccactgtacttaagggcaacactacatagtaagcaaaatctgctctgaaccctttcacagaagagacacttcagaaaggaattttacatctcctganagtnttacaacattcatacctctgatgcacttctancntcaacccanctctcattttctaacttcttnnnnagaaatgtgtgtncacaagtngtgtgtgcgtgnacatgtgcctctgtgtgtncanaaaaggctnattttacctacttgataaatgagctgagacgatgttttgggaaaaaaaaaatnggnaaanaaatgtnaccccaacacgatggagaagccaatccaaaaaagcttcatgctagagctagctttctcctcaganacttacatcctaaaaacatccctatgggtgcctaaaaatggnaatccagtgngttcatggccttgagttcactcctgtcctgaatttctcccagtgcaggtccagaagggcgagatgtggcagaaaggngaatgtgggaatgtgtgagtgtcccacagccagctcacagtgcggcttgcactcagaaaggggactcagggacacaaggtctcaggatgcacagttcaccttggcctcatgtacctgggcnggggagagggagaccattcaaaagcctgtgcttggccgggtgtggtggctcacgcctatcatcccagcactttgggaggctgaggcgggcagatcacttgaggtcaggaggtcgagaccagcctgaccaacatggtgaaaccccatctctactaaaaatgcaaaaattagaaaggtgtggtggtatgcacctgtaatcccacctactaaaggaggncgaggcaggagaattgcttgaacctgggagtcggaggttgcagtgagccaagattgcgccactgcactccagcctgggtgacagaatgagactctgtctcaaaaacaaaacaan

SEQ ID NO: 635123 - DNA, 406 bp, Homo sapiens
gtcttccagttccaacaatttaccatgccttgggcccagggcctgcccccccccttgtttattcagtcagccaacagcccctccgcggggcaggcccccagggtgtccggcgatttagggccttagctggcaaggccaaggacccccacccaattttttccatacagccccaggcaatgggcccagcttcctccccaaaggacccggccgacctcagggcctcctgcaggttaggacactggtgccctcccccccatgcctgggggccgagattttccagcaaaaaaatgcaatattttttgtttcctttttttccctttttttttttaaggaatcaatatttccatatgttgagtgtgtgtcccatgctatgaaattaaaatttttaataacatttttttggcca

SEQ ID NO: 635124 - DNA, 751 bp, Homo sapiens
gcaggagtaagccagcaagggcggtcgggtcccgaggtcaggcgagatttctcaggtcccgccggccccctccctggagtccacagcgccgccggtgtccagaggatgggacacggcccggcccgggcatggcctcgtggctgaaggtggatcaggaagtgaatgctcatacggttgattcttgcaggggtagcggatcgacaagtgaggcaggcacagactgggctgggagaattgtttcccaaagaagtcattagaactgtgatagttttctgagaggaaccgaatcttagacatccatgacctaactcagatccactctgacgatgagatcgtcccagtccctgagcccgattcgttcgtcgagccgaatagcgcatgatggactggatgggtcccacttataaggaagcgaaggttgggatgacgtgtgacgagtgccttccagaggaaccgaaggtgtaagtgatgcccaatgggatgctgaatacagcaagccagtcggttggtggacattattgagaaagtgaaagctgagatccggctgtgattgagaaactgtcatacacggtgctcgcatgttgggtacagctcctgtagttcccaggatatgacgatggaaaccacttgggggggtcccttcaggaggacaacagttgcgagctaagaacgtgagagtgagcggctctatctggaccagattccgatttttttccggaccattggttctaagtgtagttcccttggggct

SEQ ID NO: 635125 - DNA, 315 bp, Homo sapiens
  misc_feature (21)..(21): n is a, c, g, or t
  misc_feature (41)..(41): n is a, c, g, or t
  misc_feature (115)..(115): n is a, c, g, or t
  misc_feature (133)..(133): n is a, c, g, or t
  misc_feature (139)..(139): n is a, c, g, or t
  misc_feature (142)..(142): n is a, c, g, or t
  misc_feature (155)..(155): n is a, c, g, or t
  misc_feature (159)..(159): n is a, c, g, or t
agactatgtctgccttgcttncattttgtaaactaaaaatntagcagaatgcctcaggctcaacaaaaaatttttcggttaagtggaaaaaagatcaataaattcaatccccctncatctcgttaatctattnggcatngtncacagaattcatncatnctcggtaccagtgaaagaattacttaaagtttgtatgacaactgttatttcaatttatacagatgattcaggattgagtaaaggttgaattaagacatttggtcaggtgtaatgctcaataaattgagcattcgctgagattagtaaatgctgtta

SEQ ID NO: 635126 - DNA, 195 bp, Homo sapiens
gggggcccccttttttttttcccggggggcccggggggggctttcttccgggagggtcccccccccccccccccccttttggggggtttttttttttcccgggcgggtggtggggggggggggggggttgggccccttgggcttttcccccctttttttttggggccgggttcccttaaatttttttttttctca

SEQ ID NO: 635127 - DNA, 800 bp, Homo sapiens
  misc_feature (279)..(279): n is a, c, g, or t
agcggatgggggaagtgatctgttggctggagcgatggcccggggctggagctcgcggtcggcgtcggcgaagtccgccgccaccaatgtcctaacaatgaacggtcgctccgcggagcgagcccgctgccgacagcccgcgcagcatgggcctggagctcggcgggtcttcgggagtggggctcgtgtcggccgtgtgaggtggaccgaggagttagcccgatgctcgggaggacctcgatatacgtccgtggctgtggtaggcgcttctcggggtgngaggccggcagcccggctcagatacagactcgcgcgagacaatcgcaggtggttacgcgccaaggggcctcgaggaaccatggcagagggcagttgggggtctagtcaagggtcggccggggagcttgggtctttcatctaccagcgtcccagagctcgcgtgtacgtacggcgcgggtgtcttcctgcggagttcgtattccctgcgtgcctcgtccggaggccctcccgcgtgtccagcggctttccataggaacagggatggcgcagcgtaggcagaagcaggggctcgtagtccgaagtgcaacagagaccatacagcaccgcgaagcccccgggccctttaccatgggccagcgaaggggccaatttgtgtacgttcattggacgggacgcccagtggcgagggtaggtctagtgggaactttggattaggtcttagcctcggaggaaggttcccccacttttctcgttgattcgggacggaacccattccttgcccgttggcaaataggggaaca

SEQ ID NO: 635128 - DNA, 296 bp, Homo sapiens
agcgccggatattcactgaagtcccttgggaagacacagcctgccagcatcccctgtcgagacgcgtcatatggatatgagggtgttgtcttccatctcgctgtcaggatctgtcttgcagtcactgtcttgttccacagctccatcctctcgtgctggaggatcacctcctggtacacgagctccgcaggatagggcaggtaaggtcttcagcgatccatgtctagtccgtgatcgggaccttcaaacgtgcggtcccgtgttgccgatccttcttagagtcgacctgtaggaat

SEQ ID NO: 635129 - DNA, 533 bp, Homo sapiens
gagagagagagagagagagagagagagaggagagccctgcgcctgtgctggctagctccttccctgccaccgatgctgcttctgactcatgactctgtcctgcctggtgtggacggctctgtctggagctcatgaccaaggacgagaagagaccttagatgcaccatcatgggggcataggttgtcacctggacaaggcagccgtggatgccaccgtcaccaactgaacctgggggcctgggtcctaacatgtctgatcatgaccccattatgtatggagagcttggaggaggcattgtcactatccaccaggatgcacgacttgacgttgatgatagtcatggcctaacgctggcaatggtgtagtacgagtacccccaagtactcgtactgctacatcgctgaatgtgaagtgactccccaaccactactgccatggtaggcaccataaggacagcgctgaaactgtttgagcagagtaaaaggtgcctcgaggagcatgcctgtacaaaacctggcactcttgtttcctt

SEQ ID NO: 635130 - DNA, 192 bp, Homo sapiens
tagaggatcttcctgcgtacagttgcgcttaccaaaagtgggcacttttggtagcgcattccacgcctggtcatgccagcgagctgggtttcttacccatttaaagttgagaataggtgagatcgttcggcccaagacctctaatcattcgctttactggataaaactgcgtggcgggggtgcgtcgggtcg

SEQ ID NO: 635131 - DNA, 1477 bp, Homo sapiens
ggactttgcgaaggcatggcggggaacctgtgcaatgtcagcccagaaggtgatcagagccgtgtaacttacaaagtggacaagacagacagaaagggaaccgtagaccattcacggttctccctgtggaagactttttcggttttgccattatacgcctgcggaaaaactgcacgtattctggccttaacaaccgccatgtacatgtacaagggtatagggctttgagttaccgtgtcagggccggaattgtgtcagtggaaccccttaaagggctttcctaaatgtgtaacgtaaggcatcgtcccctaaagccggcaacgaattttcccgggtgaaccatttgactctcgtgtacctttagtcttaacagaagccggtaacaacgttattacggggagaaacgcttggcacacagggttccctccgggccacaaatgctcgaattgtgctttttgtggccacttaccattctgtgtgctttacacccaaatatgccgttgcgctttcgacagggacctttgaatgcccccaagtttgggaccgaattggtcgcggcgttttcccaacttcattcgacgaacacgggaacaaaacgcggctgtggagagaacctttaaggccatgtggtaattccccttgtggcggatgttccaaccgcgccaatggacaaagacagaccaactcttctgtgcggaaaacctgcccaagtgggagcgacgccccggagaaatgacctcgccccgcgtgaaaacgcatggcaacacaagcgcggacggaggaattaacggccacgggcgaaaacacccacaacctggtttgcgtccttcggtgtggccaaccacggtaggaaacggttcacacagagacagcgagggggagggaaaaccaccgggcccgagattcccctaagatcgattttcacaccaagcaaaaacaacgggtgtgtgcatgcacgtgacacatgcgtgccgtgtgcaacaaacgacagacggcagtttgttctaccagcacgcctaaactttcttaacaacgttacaggcagtggcggctaggcccctctgtcgtgcgcggcacaccatccggcagctccctctcacccagtgaggtgagcacacgttgtgtcttaatccaccgcgggaatcgtgtttgacaacaggacacccgttttagttcgctgttcccaatgcccgaagtgtcgtataggccagcaccattatgcttgtgggacagaacagccttttatgaaaacatatttgtcgggccacacatattcccgtaagtggcaacgcgggcgccccctagtacagaagctcgttacaacgcgccattggtccgggcgagtacaacatgtgaggcgccccgtacaacaatgattgaggtcccatcgacacttgttaccgacattgcgtcgtgacacacgcgtgttagaacacacaccatataagccttcgacccgctaagccagcacatcttt

SEQ ID NO: 635132 - DNA, 425 bp, Homo sapiens
cccacccctttttttttttaaaaaattttgttttaaaatttttggccccaagggggggggggtccccaaactctttttgggccctaaaaggggggggggggggaaacccccggggggggccccccgggaaaaaaaaaattttttgggccccaaaaaaaaatttttttccgccctttcttggggggggggttttttggttttcgggcaaaaaaaaaaatttgggaaaaaatgttaaaatgggtttaaaaaaaaaaatttcccctttttttcccccggttttttaccccccctgggaaaaaagggaaaaaatttcccttttttttttaagggggattttttctttccctgggaaaatataaggggggggttccggaaaaatatccgggggggggtttccccccccccctttttttgggggccccctt

SEQ ID NO: 635133 - DNA, 194 bp, Homo sapiens
  misc_feature (97)..(97): n is a, c, g, or t
  misc_feature (156)..(156): n is a, c, g, or t
  misc_feature (171)..(171): n is a, c, g, or t
taagcacttgcctctccctattgaattaaggttcacatttaattgaatatgtagtcattgtgtcttctttagtctcttaaacctacgaaagtctttntttaatgacattttcttcttgaagacagcagacctttgtgttgtgcagagttctacatnctggatttgttttcncataattgtatttagggtaaatt

SEQ ID NO: 635134 - DNA, 163 bp, Homo sapiens
tcgttataaacggcacacacagcgcattgtttcctcatgcaattgtttcagcagaagtaaaaactaacaaagttataagtaaaagaatatttacagaagcactatttttggtggcaaaagtactttaatatcttaaatgctcatataatgaaagatactttaa

SEQ ID NO: 635135 - DNA, 149 bp, Homo sapiens
ggatcagcagatagtagagggactgaactaagacacgaccaactggctgctattgcagggaggccacactgatgttcttgtgactgaggctccttccattcactgaccagagctttgtgggtgctgcacattgggcggctgacattggg

SEQ ID NO: 635136 - DNA, 150 bp, Homo sapiens
ccggtaccgctctaccgatggggtgggactggaaggaagaagaagacttgtacggtttgacttgtttgtttagtttcattattgtttagtttgtttgagacagagtctcactccgtcgcccaggctggacgtgcagtgggaccatctcgg

SEQ ID NO: 635137 - DNA, 673 bp, Homo sapiens
  misc_feature (7)..(7): n is a, c, g, or t
  misc_feature (72)..(72): n is a, c, g, or t
  misc_feature (84)..(84): n is a, c, g, or t
  misc_feature (135)..(135): n is a, c, g, or t
caagcancagaatgctttccatggctggctgtggggcttgcgcctgtaatcccagcactgtgggaggccaanacgggcggatcncctaaagccaggggttcaagaccagcctggccaacatggcgaaactccgtntcaaaaaaaaaaaaaaaaaaagaagagaaaagaaaacataagtttcagccaggcatggtgggtcacacctgtaatcccaacactttgggaggccagggtgggagaactgcttgagcccaggagttcataccagtctaggggcaacatggtgagaagttgtctctactaaaagtaaaaagaattagctgggcatggtggcatgcacctgaggtcaggtcccagcgacttgggaggttgagaggttggaggattgcttgagcccaggagatgaggctgcaatagcatgatcacgccgctgcacttcagcctgggtgacagagcgagagcctgcctcaaaaaacaaatatgtttcaacttttttataataaatatgttcattttgcaactagcaaaaaaaaaaaaaaaaaaaaacccgaaagaaaaatactcaggctggtctaggtgaagtggtgtttacagtaactgatcaccaccagttacagatttctttgttccttttccactcccactgcttcacgtgactggccagaaaaaaaaa

SEQ ID NO: 635138 - DNA, 863 bp, Homo sapiens
  misc_feature (487)..(487): n is a, c, g, or t
tctgtgcaaagaggcatccagacgctggcggatcccggttcctttgactccaacgccttcgcgcttctcctccgggcggctttccagagcctgctggacgcccgggcggacgaggccgcgctatccacccatacttgaaacagatcgacccagtggttttaaagcattgtcatgcagcagctgcaacttgcatcctggaggcaggaaagcaccaagttgacaagtctactctaagcacttatttagaagactgtaaatttgaccgagagcgaatagaactgttttgcaccgagtatcagaacaataagaattctctagaaaccctactgggaagtataggcagatctctccctcatataactgatgtttcttggcgcttggagtaccagataaagaccaaccaacttcataagatgtaccgacctggatatttggtgaccttaaatgtagagaacaatgattcccaatcctacccagagattaattntagttgcaacatggaacagttacaggacttggtggggaaacttaaggatgcttcaaaaagcctggaaagagcaactcagttgtaatttggggaggctgatgaccccaggagcctagaggaaaaccagacgcgccttgtctcctgctggaccatcgttcgcgcgagctggatgtcattttcagtggaaaaagagctagcacccttttgaagtgatgccaaccatcaattttgacactttttttacacatgtgaaatggttaagagggagactcttaagcatctggattttcagtattactcttgcgttccttctatcttgagcgtcttcaagccctattaaagtatcgtaccctgaataaatacggtggtattccca

SEQ ID NO: 635139 - DNA, 108 bp, Homo sapiens
tgggacggcgtgctctacgctaactctggtactgcagcgggagaacggtccctgatggcttggtcactgtctgtgccacctcgaccaggcggacaccctgctgcttgg

SEQ ID NO: 635140 - DNA, 603 bp, Homo sapiens
ggaagcagaggcgggaaggtggtgatggggaggagctaggagcgtgggagatgccggccggtctgctgctcagtggtcctgcacgtctctgagaaaccccgtagctctgtacagtcagtagtgagccccgaggtccgggagtgtgcaggcccgtacattgtgggggccgttggtgctgaggcatggacctgcaggcagggaatgcactcaagcgcttcctcagctcgcagaccaagctccacgaagatctctgtgagaagaggacggttgccacccttgctacccacgagctccgtgccgtcaaagggcccctgcgtgtactgcgcccgggccccacatggacctcaagattgtccccttgtgtgccggaaagaagccaaggccaaggagcgtggttgcgggcaagcttgccagctttggggagggccggaagggaagcacgagggcaacgcaatgaaagaacgcggcgagaagttgtgttcgggcctgcgacagcataccttcacttgctggctggacaatgagaattacccgggtcttgtggattgcagacggtgcatgtgatatcccttcccagcaataaccgaacagtgagaagacaag

SEQ ID NO: 635141 - DNA, 1014 bp, Homo sapiens
cccagaggtgggagggctttgctgcaatcctggaaggccagtggcttagaaaggcaccctttacccattgtgcagacagggcacctagggttcaaaaggcagcacctaccccctgtttggacttcccacattaatgtgggagcttccctgagcccccagctccatgagtgtcctctggtgactctttaagacggcatttcttgtgggccagcagcatgtgtgctgtgactgtcctaggtaccattcagaaggtgacttgagccctgacctattgaccttctctgactatcccttcggcgaggaagcatgtgagaaattgtgggatattcttggtcctcgttagaggaacagagaatgtggaatctgaaacatcgctgtccatcacatgaccccatgcactgtgatgtgatgcatgatggcgaatgtgcttcctccccagagcctcagtcctcctatctgggatcattgggcatatgggatgaggagggaggggatgctggggcccccccattctggtttttggcatgtggtctagagttgtcttatgtcccacagatggttacactcagtgtggcttgtgatgaccccttcttgggcaggcagccctctcccctccagaggccctccctttgccatgcagccccgatggactccagcctttggtgtccctcctccccctgaatggtccctggggcctgggatgaagcgagccgggtggacagccgactgtctggttcccacagtctcagaattgggtgaacgagacctgcggttgaaagggtggaaaacgctggcaggtgtgtgcctcccacatgctggagcccagctggacctcagcaagggaggtgacatgtctgggagccatggagtcaggcaaggaaagagcctttgttcttcttttggggaatgatcagtaactacaaggcgagtgaacggcagggaggacagaacagagagaacggaaaacagagaccaagagagaaacagacagaaggggagcacacgggcactagc

SEQ ID NO: 635142 - DNA, 144 bp, Homo sapiens
gaacatttcaggatataagtatttttctagagtttaaaagcataacctaaagttaacttgtaggctttttctttctaatagctttttactagagtaggtaaagcatgagcaacctattttttatgtttaactagccaagatact

SEQ ID NO: 635143 - DNA, 334 bp, Homo sapiens
cccggggcccccgggaagggggacggggggggccccccccggaaaaatgggggggcccccccccaaaaagggccccccgggttttttggggggggtccccgtaaaaaaaccccagggccccacttttcccccccccttttcccccattttttttatggccaaggcccccccccccgggtttttttttccccggggaaggggttcccccccccccccggggaaagaaagaacccaaaaaggggggcccccccaaacccggggggaaaaggggccccgggggcccctgccaaattttgggggggaattaaaaaaatgggggcggggttaaacccca

SEQ ID NO: 635144 - DNA, 186 bp, Homo sapiens
cataatggatcttccgtggtccagtggggtcagcatctgggtggcccgtcctccatccgggccgggcaccgccggggtcagaatggccatcgccggtctgacgatcgctcgagcttccatggcgtgagccttgaggagactatgaaaaacctgcaggacgatcttctggtgtatggcgaattgggc

SEQ ID NO: 635145 - DNA, 122 bp, Homo sapiens
gctcgtggttgtcctagtggtgggtggttatggatcgtggtgggggaattggtggatatggtagcataaggttctaaaaacagtagaagagggctacagtcctatttgctggcgagagagga

SEQ ID NO: 635146 - DNA, 507 bp, Homo sapiens
cttttggggtctttgctgagtttacatgatgtactgacagtgacaaagataacataaaactcatgtactgccgcaaggacatagacaacacatgagttaaatgaacattgtcaattcaaagaatgtttaagattagccatagcgttagaaaacttgaatgcgttatagttttacaactcacatataaaagacatttgatagaggcctttctaaatttaaatgattctaaaaatgtacatgacaataccagttataaattgtgaagataaaacttcttaactattgtcatagaagataaatattgatcagtcatgctagaagaaagactaaatcaaccgtctgttgtcatagaatatattataaagttgtggacatacaaagaagcagtcaaagagtatccacccaaaatacgagagtaaagaagtactatagctggatacagtagctcagacctgtagtcccagctacttgggaggctgaggcaggagggatgcttgagcccaggag

SEQ ID NO: 635147 - DNA, 114 bp, Homo sapiens
tcaaaagaagtcagacatatttaatccagaaatagtttcgtttgagggagggcttgcaggtctgtaaatagcatttgccgtgttgcaaatgtgtaaaataaagattatctggca

SEQ ID NO: 635148 - DNA, 216 bp, Homo sapiens
ggggccccccccaaatttaaggggttttttttaaccaaggggggggggggctttcccctttggggttcccttgttttggccccccccaaatcccccccccccgggggggggggccccttttttttgggggggccaaagggccccccctccccccccccccgggccccttttttccttttttttggggccccttttttagggggggggggtttttga

SEQ ID NO: 635149 - DNA, 119 bp, Homo sapiens
tgaggaaatccagcacgtcccttcttcccagtacgaggcctatgtcgacagtaaagttgacatggtgacgtccactgctggctttattgaacagctaataaagatttatttattagtaa

SEQ ID NO: 635150 - DNA, 226 bp, Homo sapiens
  misc_feature (66)..(66): n is a, c, g, or t
tgctgggtgtcagaggatcccaggctgaggcaggaggatcatctagaggcaagagtcaagatcagnctgtgcaacatagtgatacctatctctttaaaagaagaagttttaaattttgaaataataataggtactggatttatgccaatgtcttttctagcgtctttttgaggatgagtatccaggtttatcttttttttccccttttattcttctgggatggatt

SEQ ID NO: 635151 - DNA, 642 bp, Homo sapiens
accacgagataatatacaactggctaaggggcgtatgtgatcagtaatcaagagagaatctatacatgcagctaggttgagtacagctaaattctgtacagtacacaaaacccattagtaatgtagtatagagaccaaaaggtagagagagatcgaatacattactgatgtgtggattaattcaagttcaggcatctacttgtgttacagcacagctgtcaaaaggcgataatgagtaaatcataaaacgggtttgtttcttcccacattattctataaatggaccccgatgggtagtgaagcaatggttttgctgtccaacttcagaggctgctgtggcgggggtctagttctgcatctgctcaaagaacttgtaggttggattttcgtagccgttctgctgcatcctggacaggtggcgctcctctggggtgacagcggcgtcaacctccaccacaccatgatgaatggatgtgtactgtatcttcttcagcatcaccaaggtgatgacgatcactgtcgctatgacaaacacgaccaccatgagtccaatgattgcacctttgtttgaacccacatcttctgcaaagaacaccattttagatgatgaacttcatatcctgagtcatgtgggaatctgca

SEQ ID NO: 635152 - DNA, 209 bp, Homo sapiens
tctgctgatggtgatcggagtaaatcgccagagtccctgaactctcgctactttttactcccctgcatcggatcaccggcgtgccccaccatgtaagacgcagccgtagacaccagctccgaaatcaccacaaggacttacaggagcagaaggaagttgttggtaagaggcagcaaaatgtgaagagtacgcccctgcttaactgggaa

SEQ ID NO: 635153 - DNA, 184 bp, Homo sapiens
gctgagggacaagtgcaccagtgacagaactccctgcgacactcctcctcctcttggccagcagcatctggctggagaagagctgtaatgctgctcgctggctgaggttgttgcacaagttgctccagtgccattcaccctgcagtggcctgggggccatgtggcacgtgagtgtgtgtgcaca

SEQ ID NO: 635154 - DNA, 400 bp, Homo sapiens
tcacaaaacctagttgccaggtttatcccctcactggggtggtccacatacacagcacagaggcacgggcaccatggggaaagggcagcactccgtgccttctgaggggatctgggcctcacgggggtaaaaagggaaaggagggtttctcttctgccctcactagggcctagggaacccatggagcaaatcccaccacgccttcacatctcttcagccaagggaagaagccacctggtgtgacgttatagtctccaaccatttatagtaatgtgtgaagaaggggatgggccgggtcccaaccattacggggtgaacgatataaacagtaaagggaagatacagtttgggatgaggccacaggaaggagcagatgacaccatcaaaagcatatcgcggg

SEQ ID NO: 635155 - DNA, 115 bp, Homo sapiens
aagaatatgaaattccagcaataagaaatgacaaaggtttggagctgaaggcctaaagtgcttgctttttgcccgttgaccagttaattggacttcttcattatctttgcagcat

SEQ ID NO: 635156 - DNA, 498 bp, Homo sapiens
  misc_feature (246)..(246): n is a, c, g, or t
ctttttttctagcccgaccgtaccaaccaaggcctgggtcctggtggggtggtggttggcctcggatttccacccccccaatcccctcacaattaattttggctgggcaaaccccgctggggttaagggtgggggcggggtggttaagtaaaaatggcccaagaccggacaatcccttgggggtttccccccccccccccccccccccctgggtgggggggggggcggggataaggaaagcccttnctggggggggggccgggagggggggatttttttttccgtccccccccccccggtgggttggaaaccccctccatttattttagggggggggggggattttagttttgggttttttccccccgggggaacggtccccttttttttatccccgccaaaggtggggttttttttttgcttccccccccggccttgcctttttgtttttgaagggggggttttttttttccccggtttaatttaattttttttcca

SEQ ID NO: 635157 - DNA, 749 bp, Homo sapiens
ggcgggcgcggtggctcacgcctgtaatcccagctctcagggaggctaagaggcgggcaggcggagcttgaggaaaccgcagataaagttttttctcttgtgaacagatagagattaatacaactacttaaaaaatatagtcaactaggttactaagatatggcttagcgtcaagttttaagcgtaattataatagcttaagattttacagagaaacatactgaacgaccttagaagagtagcatgaggaaggaacacagatacacaacgcgtttctaaaaaccactgaccggagcgtcgaccgactgaacgctctcttcagtggacgtacacaaaaacagtgtattttcaacaaggaaacactgacgacgaagaggactacaagagcccccgaaattaatacccaaatagaaggggcaacgtgcttttagatcaacaatgacggtgactcaaaccaggctttacaggtatagcttaaacacgtttgtacggtgacttacaacataatttgagacggcgactcttttacacaaaacggaagatataacacccgacaggtggattcaacaagaccttggaaaatgcatgaccgcagggcagcaaattcggggtcatttaacagccttagttaaacgcattttactaaaagcgcagaccgaaatcctggcacagattactttgggcgtggtaggattgccaccactggggccgaaagcaagaaagttggacggtgcaacaagtggaacaag

SEQ ID NO: 635158 - DNA, 497 bp, Homo sapiens
  misc_feature (29)..(29): n is a, c, g, or t
  misc_feature (58)..(58): n is a, c, g, or t
  misc_feature (72)..(72): n is a, c, g, or t
cccctcaaacccaataacccaaaacaaanctgcaacttgggggtaaaattgctagganccaaataattgaantgtgtggtgttctgttaagggttttgccaaacaaattccctcctgaagccttagcctaggagttccattatgccttccctgtttagctggtccttctttccttctactaaataagaaatgccttcatttttggccgagcacggtggctcatgcctgtaatctcagcactttgggaggccggggcatgcggatcacaaggtcaggagtttgagaccagcctggccaacgtggtgaaaccccgtctctactaaagatacaaaaaaatcagctgggcatggtggcgcccacctgtaatcgcaactatttgggagttcgaggcaggagaattgcttgaacccgggaggcggaggttgcagtgagccgagatcgcgccattgcactccagcctgggcaacagggtaaggctccgtctcaagaaaaaaaaa

SEQ ID NO: 635159 - DNA, 125 bp, Homo sapiens
accggatcttcggagacgacttgaccatacctttccaggtcaaagtacagaatagaatacattgatacaaagtacagcacaatactttgctttttatccatttcttttactactgtgtaaaagac

SEQ ID NO: 635160 - DNA, 2030 bp, Homo sapiens
  misc_feature (267)..(267): n is a, c, g, or t
  misc_feature (284)..(284): n is a, c, g, or t
  misc_feature (830)..(830): n is a, c, g, or t
  misc_feature (1330)..(1330): n is a, c, g, or t
gcatagcgccgcatgagtgctggcatgatctcctggttcgagcaggcggggacgccgggtgtctcgctgcgctgggagcgcattgggagttggtaaccagttgtgtaactaacctaagggaccgtattcttgtaacggagtgagtaactaccggtggaaccgttgtagtacagcagcgacgcgtacgagcggggtaacaacagctgactctagtgtactggctcgagacatacgcgcgcgtatggtggagtggcacaggagtaatanacagtagattaacatancaccagtccaacacatactaggggatgcagtagtgtgtctgcatggtgtaccacatagacagagtaccatacgtcctacctcttgtgtacagcggacgtatgttctataatctgtccctcgcttcctacgtacgcgcgcggtacatacgtggacatatgcgatgcaaggaaccgtccacgtcggactattgtcaattcaacccgtaagaggcgtggccccatactatccttacatgaggtcggattgccacgcgcggttcttggcacccctagaatatcaataagaatctcaattgtgctcgaggcagaggcccacttagatatggctcgaaatcttggcggcggcgcctggccacttggcgctcggggcccacagcggctctaggcggcacctgttccttttcccataggtttaaggggtcctttatggagcgcgaattgggaaactccaaaacggaaattggctcaatcggaaaattggcgcgccacaattttgtggcggtatggtgtttagaaacggtttggcgtttcgcaattgggaagganttgacgtacagatgcgcttaggcaagaaacgcactattctcgtactggggggtgcccagctccaatgcggtttgggcgtctcaaacgcctttcgttctccaatattctgggtgccactcgccggatgggcccggttataggcacggaggttaaaacttagacgcgaacgtaaggacgccaagactatatacggagagatataatgacccgccattagccaccccttgtaacaccccgtgtaggccataggtgggtggacataggaggacgcccgccgtttggtccgtaattcccctctgttcgaacagggttaaaccggcaacatcgaatttttccctctgtggagcttccatcggaggtcttccttagtagagccgcctcacggtgcactttcctgtgacacactccggtgacttgagcacacgtttaaccaatacacgcgctagaggcttccacctgttaactggggggtggccacatgataacgttggtgtttgacnctagacattttacacacctcgtttcgaggcttaacccgttgtgaagttgtgcacacgcgaagagcccactgtggcaccctgtgtgtgcgctttataatctgtagcggacaccaacagagctcccatcctttctaggagaagggcctccaatagtactcaaagcaggaccacttaactcaggccgtcaaacctttgtattcgtgccggggagcgcattcttgtcttcaagacaaagacagcgctgtgtgtgtttaggcccaaaaatgctgaatcccgaaaattccagcgaacgtccttcacatgtaggaccgccccctgtgtaaagagaacccttaacacccgaaacagtagttgctgggagccgccggtgcagcacaaatagtggcccccaggccgctcgcagacaaaaaggacatggggggtttacaacacagcaacgcgaacacacagcctaaaaagaacacgaggcgagcgaacgtacgtacaaacgacaacacacccgacggagctaagaagatactcggaagcagaccaagcacactccagcacccgccagccatagcagacacacgacacaaacaggcacagcgacaacaacgtacgggaacaacaacgacaacagagagcagcaaccgcagcccagcagtagccaactggtagcgacagcacagcgaaccgcacgtgccgaacttcgctctat

SEQ ID NO: 635161 - DNA, 320 bp, Homo sapiens
acaccccggactagattttcagaggaatactacactgtttggtcagttaaggaaggctgtgtgttattttggattgcctgcccttggctgacactacaggggtgcataccatcttgctgtggcttggctgacattgcctctttgtcctggcctcttagttttcttttgatatttcatagctctccttagtttcactctgcctggatagaaagttgaccactaactgcaggtttaagtactaaactgcagccttttctgtcgccagcaattaaagaccaccaatcttgtttgtccatctacatggtttgtccggggttgtt

SEQ ID NO: 635162 - DNA, 176 bp, Homo sapiens
ctcatgcctccttccaacatctcattcctcctttcaacatctcatatcacattttgataattgtcacaatattttaaaacttttcattattattacatctgttatagtaatatgtgatcggtgatctttcttattactctagggcaccatgagcaagcggcatgagatttggaagg

SEQ ID NO: 635163 - DNA, 142 bp, Homo sapiens
  misc_feature (50)..(50): n is a, c, g, or t
  misc_feature (65)..(65): n is a, c, g, or t
aaagcaagttctcacttccgtttagaggggcaaagcctttgagatattcnttgggagaccctaanctagtgtacacagcagtaggccatggggcgtaacataaagagggagtttccaaggctagaaccctgctgagctgtgc

SEQ ID NO: 635164 - DNA, 1077 bp, Homo sapiens
  misc_feature (496)..(496): n is a, c, g, or t
agcggggcgggtcgcggagggggggacggggactgtcggctcagtcgcgagatccgcgtgctgctgaccgagatggagcgtctacgcagcagcaccatggctcaagagaagaaccttgcaaggctatgttgggattagtcctaactcgtgcacacaactcacaaggtactacaagaaacaatcgtgtcgacaacgagcaggttattgaaattcacggcatgtatcggtagatcgggtgagctcgtcgggagtagggaggaggtcggacgattaaggtcaacatcgattataaccgtcacagatgatgtattcgtccagaggtatgcgaggtgccttcctccatgagaaagtctcaccagaaggagtggtacgagtgtggaacgaacatccgaaagtctaccaggtcgatccgaaaggtggttgtgtcaagctagcatgctcacgagaaagttggataccaccaggagtaatggcattatgcgagatgtgcttctangtatttagcttggacagccttgtaatggagataactatggataagtagataaccgaaggaccgagtctaaaatcgcatgaatgcaccgaggtggaagcagacgtcagatggctagataatcaggggatagtcagagtaagtttataacttcatttgctcggttgcagagaccatgtggatctataaaatgcgattgggatagttcgaagttgagtgaaggcgtgaggatggaatgtagagtgacactattctatcgacactctattgcggaatggatgacacaaactcggcaccagtagtgaatgccaagtagggtttaaaataacggatcattgaacgaagattcctaataaaccttggcattttttggcaatttgttcctgacaatttcccaagaacccgggaatgtatggaagaaagaagggaatcctggcgttggtcctcctaggagtctccgggacccgacttaccgcctggggaggtggatcggaagtagggaacggaaccggcggcgcttgaatgggccaatgggggtctaaaggtaggcgcaaaccacgagggggggttgccgccgtgcaaac

SEQ ID NO: 635165 - DNA, 325 bp, Homo sapiens
ttacctggctaggtgtggtgcctcacgctaataatccaagcactttgggaggccgagccaggaggatcacttgagcccaggagtttgagactaggctgggtgacatagtgagaccctgtccctacaaaataaaaaaagatttaaaaaaattagccaggtgctatggcatgtgcctatagttccagctacttgggaagctgaagtgggaggattgtttgcattgttgaattgaagtgggtggtctaggctgcagtgagctgtatcactccactgcactccagcctgggcaacagaacgagaccctgtctcaaaaacaaacaaagcc

SEQ ID NO: 635166 - DNA, 398 bp, Homo sapiens
cgagacgcattgtgtgcacggagttgacgtggaggtaggagcagaacgccacagtcccagacctggaaccgctcagagaggagcacgcaccacctgtgatctactatgtccctgacttcatctccatagaagatgacgagtatttgcttcgacaggtttataatgcgccaaagccgcggacccagctctctgtgagacagtgacagaactggagtgggcttcctcatcgcacagggaaggatactgagcgggtgccaccatggctctcagcgctacgtggacacagtgacagacctgaacctctgtggaggcactcacagctaaccatgtgctacatgaaccagcatctgcctgtagagggcatcatgagccacacacactcgggccgtgtccgtccc

SEQ ID NO: 635167 - DNA, 177 bp, Homo sapiens
  misc_feature (1)..(1): n is a, c, g, or t
nctattgctgtgggtatataagcaatcgtattgtacttgagatagcacaatgctgcctagtactatgccaaatacagtcaactttagatgctttctgaggaacagaaaactggtacactgatggatggatgagttcgaagttaactatagtatagtaatttgtacagcggggatcct

SEQ ID NO: 635168 - DNA, 139 bp, Homo sapiens
tatggacaaagaagacacgggcaccggtgaagataccaactcgaaccacagccctgacagcagcattcatagcttgggcattttcaccagaagtttaaacagcaatggctttgtcaatccccaaggtttcgggtggcca

SEQ ID NO: 635169 - DNA, 623 bp, Homo sapiens
  misc_feature (1)..(1): n is a, c, g, or t
nggggagaagagggaaagaaagaggataaagagcaggaaaagcaggtaggagagaggatggaagaagcatgaaaaaagggggagaaggaagggaaagaggaaagaggagaagagatgagaagatgttggtaggaagatgaagcggagagacatgatgaagaaaggggtgaaaagaatagacaatgtgagaaagatacagtatgagaagaatgcaatagaggcacgatgaaacagggtaagtgtggatgaggatatgggataaaggagaggcagtgtctagtaagagaattgaagtaaatgatctcatgaagaaaagtgagagaggtatatataaagtggctttatacagttaggcaattaggtattaaaatgatcctcaaaatacagaaaaaaatggcataggtacagccatgaaaacttcaaacaacgtcagacacagggccatgaatcaaataatttaatgagtttacagaggttaagcttcaaaagggctaagtgaaatatttatttatttaaagaaaaggcaagttctagatcagtctgacagagtctctctctcgctctctctctcgctcgagctctctctctctctctctctctctctctctctctctctctctctc

SEQ ID NO: 635170 - DNA, 206 bp, Homo sapiens
  misc_feature (39)..(39): n is a, c, g, or t
  misc_feature (91)..(91): n is a, c, g, or t
  misc_feature (124)..(124): n is a, c, g, or t
  misc_feature (165)..(165): n is a, c, g, or t
  misc_feature (167)..(167): n is a, c, g, or t
aggcacctgccaccacgcccatctaagttttgcattttnagtagcgacggtttcaccttgttggccaggctggtttttttggccaattgtntctaaactgctgtcaaaaaaaggaatggttcanattgttttgaatagggcagagctaacctgtaatcacctgtntnatgagaaacagctttgactgcatttaactcctgacctgg

SEQ ID NO: 635171 - DNA, 603 bp, Homo sapiens
cggcgggccgccgtgcggtctttgggccctcttgcccggggtcctccttggtcccttcttgcccatcataccccgatgttccatctggtgacaccccccgacagtgccccccgccccctcccgtgcccggaccgggttccctttccgagcttccaccccacccacctggccccaggcccccccggccagcccccccccggtacctctcccggtgccccgtggtccccggacccagcttctctggcccttctggccggcctccccgcggaccccgtgccccgcttcttcccagcctgccaccagcatccgcgccagatcggccggcgccgccagaacccgctccttaccacgccagctgctgtgccgcgcctgctggccgagccgcctgccgccactccagccccggcccgggtttaccactccactattacgacctgaacgccggcccatgtgggctggagaccactcccccttcgcctaagagcccgcccgggacccccgcctgtctgcgctggctccccccgggagaccccccccccgcctgtgttttaggcccccccccccccaccttttggtggggagaaataacccgtttagagacta

SEQ ID NO: 635172 - DNA, 1177 bp, Homo sapiens
tcgtccctaagtataccccctttggtgcctgacttattccccccccaaatatcctgcacatgctcacctccacaagtctattttcacccctgcttctgttttctccgaaccaccaagcatgccctaaataaagaaaaaggtttaaaaaaagagttaaaaaggagactcttgtccaaatttttactccccccccctgttttacccccaaacaccgttcgcccttgcttgagccttgcccccccggtattttaggagggccaccccgcctctgtcccccagggaacaaccaaaagggttttaaccgggccccgcagtgtacccccttgtaccccggtgtccaaaaggtttagcgataagagtcacccggtgtgtccccctttgaattttaggggacaccccgttatttggaaattgggctccccccccgagggggttttccaacctgtgcttccttaaacttttttaaacacccaccggtgagaaatttgaccccctgtgcccccgctggaaagaaggcccggggccactggataccaccacgccccaagaccgatgtaagacccctattggaggcctttaaaatttatttaaaaagcccaaccaccgtatcctatacccaaccccccccacgtgttccttaaaaactatgcccaacacctcggccttaaaaaaatttttcggttgtggggcgagcccctccggaggccacgaacccccacacctcttcgcgagccacgttaccaactcggctataggagacttttcacccacgtccacacaaggcgagaactatcctagtaactccacacttgtgagtccccaataaaacttgagccccaccgggaacacacaagttatccctatagggagataaccacgcgcgcacattcctattttctaagaagtccaataatcaaccacaataaggggtttatcgacacctccagaatgttggaatcacaggaacactcccgaatggtgcaccccgcctattaaagcgctttcgctttgttcacaccgattaaagtcctaacgtgattctgagtttcacgacccgcgagtaatccacggtccggttttctatttaacttcacaattcctccctgtacgaaaggaaccagagaaataaggcctacttcaccaagcgccttcccccctccactgatatcatttcata

SEQ ID NO: 635173 - DNA, 972 bp, Homo sapiens
  misc_feature (686)..(686): n is a, c, g, or t
gagtcaagggcctttgcacgcttggcggcggttctaggttccctgttctcgcctgatgatcggcgatgtgtcctaaaggcagctccaaacagcagtctgaggaggatctgctcgctgaaggattttcgatgcgcggcaatcttctctggccaaagatccttccgggcgtcgtatcttatcggaacacgcgtccattctgtcgtcttcgtcatggccctatcatggttaataagttgggccgaatatgggcaatgatggattctgcatcaggtcgtggctcgtgattggtttaccgtgtagatagaccgctagtaaggacacgattatttggagtaggccattgtggcgttacaagaggacattgtgacgctttgggtgctcggaggcactcaaatgtgagcaccaagatgtgaagggaaggattgctgttttccagataggaatgtgactcgaaaaactttgctgaaggctgataaatagaagaggatgtctcggagagggaggactctgatgccacgaatcttgttggcatacgaagaggtgactgtttgcgtgattatgaaggctaagcaaggatttgttccattgttctagtaacaacagtcgtgttgcctggttcgtggtcatctgtgtgcttccttgcttcatattgaggaactgccaactcccgagcagttgaactatcnttattgtccataaggtgcttcatcagcgacttcatcgccctctgttactggctccaaatagaccatgtttagctttacccgcggtgttggtgtatatgggatggcctgtggttcactggacaaggtccggctggccgggctgggaccaaaaatgttttgttagtcagacctttaaaaaccagggaagtagtcacgttgggagaggggttgagccaggttgccgtcaaattctggaggcgcgcagtaacacagcgtggggtcacgcgcgcacaaaaaaaattgggcc

SEQ ID NO: 635174 - DNA, 364 bp, Homo sapiens
  misc_feature (130)..(130): n is a, c, g, or t
  misc_feature (316)..(316): n is a, c, g, or t
tttcggcacagcagaattattcataatggccaaaagctgaatacaacccaaatgtctatgaactaatgaatagataaaccaaatctggtatatccatacaatggactatattattcagccataaaaaganataaagggccaggcacagtggctcacacctgtaatcccagcactttgggaggctgaggcaggaggattgtttgaggccagaaatttgagaccagcctgggcaacatagcaaaaccctgttctctacaaaaaatacttttccgtacattagtggtttgcctaaggctagaattgggggtgatgaatnggggagtacaggattcatctaatgggtacaggatttctttatgggttc

SEQ ID NO: 635175 - DNA, 741 bp, Homo sapiens
aagggtggctcacacctgttaatcccagaactttaggaggccaaggtgggtggactgcctgagctcaggaattcaagtccagctggggcaacatggcaaaacctagtctttacaaaaaaggcaaaaaattagccaggcatggtgtgcacctgtaccaggtatgcacctgtactcccagcatactcggtaggctgaggtgggagaatcacccgagcccagtaagttgaggttgcagtgagtcaagatcacgcctctgcactccagtctgggcgacagagcaagactccgtctccaaataaataaataaataaataaataaataaatagtttggtaggctgggcgtggtggtttgtccctgataatcctagcactttgggaggctgaggcacggaagattgcttgagcccaggagttcacgaccagcctaggcaacataggagggggaacctgtcttaaacaaaagaacaaaaagggagaggacaagaggcgacgagcagagcagacacgacgaccagcagaccacaggaaccaaacgacatcgggtacaacacgcggcaaccactctaccagaccacggctacgtaaccccattacctagcaatatgtggacaaggtcacatgttacaaacaaaaaaaaaaactatatccgaagaaatataatattatctagtaggcaccgcgaggataaaaagacaaagaagagcagacaggcatatgacaagaggcagttcatgaacaaa

SEQ ID NO: 635176 - DNA, 160 bp, Homo sapiens
  misc_feature (73)..(73): n is a, c, g, or t
gcaatgtcagccttataaaccagatttgccctggctgtcatagatggcagaaccagagctttgttcagtgagntgagctttgtcctcccctcaggtttggggaatgaggtttgctaactttggacaggggactatagctttgtggccctgttttactgtt

SEQ ID NO: 635177 - DNA, 1985 bp, Homo sapiens
  misc_feature (1102)..(1102): n is a, c, g, or t
  misc_feature (1985)..(1985): n is a, c, g, or t
ccaggccgagcgggagctgaccagtgcttgactcgggtacaggaacgatggcaccaagtctcccgttgctgaaccgaatgggcctcgcaagtggatgtgatggagtgcccagccctgagggtcaactgccaaacgcagagctagcctggtcactggtggcctactagtggttgggtaggctgtggctgttgcctgcaaggcacggttccgatgtgtgccgtatctccgttcatgtgtcgccctgggtgccgacgggggtgctcttatccgtctttgctgtgggccctgggcacatcatatgtgtccccgaccttctgtggcccccttctgtggcacccatgatgtcctccatccacagaattcaggaacacgccggaattcccatctctagccaatgtgggcacaactaacggggcacaaaggttagaagcttaaagtgcccctggcgtggccccgtatgggagcaccatacccgccacaatcctggaggggagccccttggagaaccttaatcgtagaacctagactggggcaccacccttgttgtggtgtaagtgtgggccccccccacattggtggccccgttatagccaccgactgggaaaccccaccattataataataccagttccaacaggattgcatccatggaaagcaatgggacgccatagcaccctacgggcggacagaacccgcactttgccgagaacactagggataagaccacacgcattgggacactcaaatggaggtactgcgccacccatgggagccacatatgagcaaagcacataatttggcaggcagcaggggcacccacgaatttatccgttttggcgagaccacacaaggttcatggaccgcgcaacagcaccagcctctggctgactatgccggtcaatttgcaacaaggtcgggaccatttccagtaggcgttgtatttgagccgtaggatgcctgcgtggactaaaccactaaatttctacaccgtatatcagtatcagccacacttgggctcgttccagcatacccacgattataccgagacacccagcgattcggctgtagtacccacacaaagcgcagcgcctatggtacccanctgggtgacacgcggagatcacactaacacggccaccgcagtagggtcgtaccatattaagacgcaacattctccataaatcatccgctcgattaccaccaccagacagatacattcattcagctggggtgcagccttcacatgcgggcatatacccctccttggagcgcccaaacaccacacacattgcggtcgtccctttgtaacattgtagcggaactgcaccacagaccaacaattgagtattgacttggcgaggcaaccaagttgtgcgacaccaatcttcaaacgaccgcatgtgagaactcaaacccagcacgaagcgtgaacgagacattggagacccagagctacgacatgcggtcattaatggcgctaagaagaaatgacgccacgccactatcatcatggatgatggcgacagcacacttatatgcgaaaggacgttcagcctaccaatgccgtatatcagtactcattccaatcccgtaaggcatcagaacagttcggatcggatcaattagtaaaagcggagactatgcgcattggagggagcgaccttatacacgagcagtgatcaactctcccttacgacgcgcataaccctatatgagctataccccgtcacacagccccttcgggtgacacacccattccgtgccaagcaactgcggacatcggaatgtccacaaatagtgattgaccaataatgggacgtcaacccgaataccaggagaggccaatccatatgggctattagcatcactcacatacgacgaagatccatagcggagcgcgacttacagtagatacagcaccattaaaggtaatgtccgccctcaatgtagttagcatgacaatcaatgctagacaacccacatgn

SEQ ID NO: 635178 - DNA, 1360 bp, Homo sapiens
  misc_feature (1165)..(1165): n is a, c, g, or t
tgacacttctgcttgccattacattgatgaatcgtatatagatgggatccacaggatgatgcatgataatgccggcatgccgtgacaaagattcgaaggtcttaggagtgctacacagcgattcaatgggactctgcacgcgaattgtaacgtcagcgtagcagaagtctgtagaattgcgaagtagaacgtccgtgaatctagaagcacgtcctcggtcgaatgtagcgtatttgcagacagagtcagcggtgttcatgtgatccatccatcacaagaagaatatcctgaagtaggtctatggtcaatcgtccacagtcgtagacgcagacgtactagagaacagacatctagatcatcttattgacttataaacagctcccagcttcgttcttaacaggagagaccgccccatgtccgtcgcagcaagtccaatccaggtagacaaatgcagtggatgcattctccatgcgacgaaacctcggcatgaggtgtccgcgcgaagccgatggcaggccccaggacgtgccgtcggtatcgcagaatcacaacgccaaagaaggcttgttcggccattggcggctttttctgccattgtatgccgtgtatacctgacatcatattaagcctgtgtggtaccttcccaaggactagtaaatgcagcacacctggtcgtcaattctgcaagcatcgctctaggagagccatctgagtaccggtcactgtaggatggcatgacgagaatgtctggccacttggggaaacgtcctgtgtcaagccgcggggctcatatggcgaaggcttcccttgaacgtagtgctatcttcgccagctagtctttgcgatcgcacgtttttaaccggccggcccagcgtacatactttcgccgctcgatgagaaagcgtcccgcgaatatccaaagtggcgtgttttaactgtagccgacagcgcaaaagctcttgtgcgtgagaacttccgctcagttcgaggagtaagagcccatttctctggccgcattttacctgctacggccaagttgtcagcggctgggtctggtgaacccccgataagttcgtgcgcaatgagatcctccccttttaccgtgaaaaacacgcttgcctaaacccgttgtgacgggacatagaatttttgcacatgatgtccncttactttgaggcgcgccgaggacacacacgcgcacacaaagtccggttggttgtgttacagcactagcgtaatgggaaaacgcggcaagaaagatcgctatccatatggacctgtttttccgcgcctgggtgagaccaagaggaactcaaacgcagtaatgtctatgcaacgcaaagatttactgacattcgac

SEQ ID NO: 635179 - DNA, 993 bp, Homo sapiens
  misc_feature (22)..(24): n is a, c, g, or t
  misc_feature (757)..(757): n is a, c, g, or t
aacatggcaggctggtactgcnnngggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaatgtgattcaggcaggagctgtgccatcttcatagagttgctcagctcagagttgangatgtccaggaacaggcgtctgggctcttgggcatcattggttgagaatgtactgtgccggactatgcctttaacggaaatccttcccctcttgggcggatttacagcaaccgctgcagaccggaggagatgggttgcaacccggagggaagccccccaatgaaggtccctgagggcccgcggggggaccagtgggcgggcccattaagccgaaaggcggggcagggctaatgagg

SEQ ID NO: 635180 - DNA, 814 bp, Homo sapiens
  misc_feature (22)..(24): n is a, c, g, or t
  misc_feature (758)..(758): n is a, c, g, or t
  misc_feature (807)..(807): n is a, c, g, or t
aacatggcaggctggtactgcnnngggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagcctcctcccaccttcccgcgagcggacgcggaacgcctctgtctcgcttttcttatttttcccctttcccttctttttttttctttcttctcctcccctttacattcctcgagcnttccgcagcaagcgctacccgttccgccgcgcttgaagacctcaccgtnacggggt

SEQ ID NO: 635181 - DNA, 321 bp, Homo sapiens
  misc_feature (73)..(73): n is a, c, g, or t
gggtgggggcgccgctggggcagggccaggtttgtgttttagtcccttgctcctgcttcttttctacacacancatctaaagacggtgcggctcgctctgtcatgggttccgtctctctctgtggagaagcagctccacctctgggggggctcggggcagaggggcggtgtctcgtagcgggcggcacgccagcgcccctctgtcaggctggggcaatcttggttttgtgtccaaaggtgaaggggtaggaggaggccctcagctggccctccccacacacaggacggcaggggcactgtgaggcttttcttattaaaatg

SEQ ID NO: 635182 - DNA, 763 bp, Homo sapiens
  misc_feature (22)..(24): n is a, c, g, or t
aacatggcaggctggtactgcnnngggcacgagggccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcaggtgagcctggcatttgctaggaaccagagtggaaccggcaaagtggccagcaacagagtcctgatccaaatggagaaagggaaccaggcgtacctcaactggagtgggaaacttgatagg

SEQ ID NO: 635183 - DNA, 749 bp, Homo sapiens
  misc_feature (513)..(513): n is a, c, g, or t
gtacctttcaaagcgtagtacccaaatcccgatgagatgcgcaggaggagggaggaagaaggactgcagttacgaaagcagaaaagagaagagcagttattcaagcggagaaatgttgctacagcagaagaagaaacagaagaagaagttatgtcagatggaggctttcatgaggctcagattaataacatggagatggcaccaggtggtgtcatcacttctgacatgattgaaatgatattttccaaaagcccagagcaacagctttcagcaacacagaaattcaggaagctgctttcaaaagaacctaaccctcctattgatgaagttatcagcacaccaggagtagtggccaggtttgtggagttcctcaaacgaaaagagaattgtacactgcagtttgaatcagcttgggtactgacaaatattgcttcaggaaattctcttcagacccgaatgtgattcaggcaggagctgtgccatcttcatagagttgctcagctcagagttgangatgtccaggaacaggcgtctgggctcttgggcatcattggttgagaatgtactgtgccggactatgcctttaacggaaatccttcccctcttgggcggatttacagcaaccgctgcagaccggaggagatgggttgcaacccggagggaagccccccaatgaaggtccctgagggcccgcggggggaccagtgggcgggcccattaagccgaaaggcggggcagggctaatgagg

SEQ ID NO: 635184 - DNA, 206 bp, Homo sapiens
cccgggaaaggttgaagactagtctgcattggtgctggtcacagcccaaactggtctcatcatctcccagtgacacagcttgtcccagatgacggacatcgtcctcagtgcattggtgcctccggaatcagggtgaagttgtcctttcctacagccttctgggcagtgttcaacgttgcaatgggcaactgcccgtgaccctggag

SEQ ID NO: 635185 - DNA, 455 bp, Homo sapiens
tggatgccctgtggcccctgccccattcctccagggggcccagggggcctgccttttactgtggcagccaaattggggggtagtgggaggttgtgcatggaggccccttaaactttccatttgttaaaggccttcaaggaaaaaaaacccggccccgcgtccggcagtgtgagtttcccgtttggccctaacttttttttttttttttaaaaaaaagaaaactttaaaaaaactccccttaaaaaccaaacatttttgtgttttgaacaaaggaattttcaaaatttgattgggattttgttttgaagtttaaaaaatttttcagcccataaagccccctgttttaagcccttttaattttaaagtttggggattgggggagggcaagggtttttttttttttttttaaagggggtgtgaacaaatggaaataaagcaggggctgtgaacattta

SEQ ID NO: 635186 - DNA, 155 bp, Homo sapiens
tagaactcttgttctatgagttgatgttttagatcacatataagtgagagcatgcagtattgtctttctgtatttggctaatttcacttaataagcatagtatggtctaattccattcatgttgtcacaaatgacagaatctctctctgttttaa

SEQ ID NO: 635187 - DNA, 131 bp, Homo sapiens
gctcactgaggaaggtcaaccaaagttgtctgagaaccagacgactgtttcgctcacgcagtctccctcatagctgccttggatcaaatctgcggcgactgtccagtttctcctgtattatgagctcatcc

SEQ ID NO: 635188 - DNA, 349 bp, Homo sapiens
caagtggtgctccattctctgataataccaatttgtcttgattgggttctgtggcttgcattcctcacctggaagttgtttgcttagctcagaaatctctgagctagtgattcagctaggcacacaggtcaagggtaaaagccatctggtgtctcaggaagagttaacccttgagaagccctccagaccagcacgaccttcctctgggttgtagttccaaggcacatattcaccctgtgtagaggatcctgccctctgtggattatgtagagcctctcagacagttctgcgtagagctgtccgctgtggctgtgcattgtgtccaccaccacagcgctctgggcgctcc

SEQ ID NO: 635189 - DNA, 253 bp, Homo sapiens
gtatgtgaagtgtgttgcagaggagtgggacacctatttcctgagctttgtgcagtgcaaagtgagagagggtttgtgcaaatcccactccattctctccctcttgccctgtgggagggatgggatctggctggagaatgagtgggtgttcccagcagctcagctgtgacaatggacgatgtaacagcccgtcatcatcccgtcatgtctgttttcctccgctgctatgccatccaaccttttgcaccagggt

SEQ ID NO: 635190 - DNA, 339 bp, Homo sapiens
aggatcacagctttctaactcacataagaaggctgactgcacaatcacaagggctgacttagacttcctggctttaatgactggtcaaaggaatcctcagtcagtcttctttcaaggcaaattgaaaatcactggcaccatgggtctcgctatgaagatacaaaatcttcagcttgaatcacgcaacgctaatctctgaacaactccctttggctacttttgaaaatcaagatgagatatatatatatatatccctaccttttattgtcagaatttagactgaagactacacattggcagatagcgtgggatagatttgtttcttaatgggtgtgacca

SEQ ID NO: 635191 - DNA, 169 bp, Homo sapiens
taccgcttctcctcgtactcctctaactacccctctccccacccatgaagactgaagaaagaggttacctgaagacttagccattagattggcgtgttcattgatcgagccttgtgtagggccatgggtgaggtcagagcgtggtaagagacaccactattggctttca

SEQ ID NO: 635192 - DNA, 196 bp, Homo sapiens
tcccccgtgtaactctgacagaagatatggtttcatccaaattgtcatgtactctaccccatccctaagccatttgtatggaacgaaaaagaggatgaagccagtactgtgactgcgtaagcttcccccagcatcacccgctatgagatgtgtggcagctgagacccgggaactgctcaagggcaccaggccccat

SEQ ID NO: 635193 - DNA, 136 bp, Homo sapiens
atctgtgacaagtacctgcagcagatctttgagtctcaacgtatgaagttttcagagatgtgtttaagatgatgcaggctgaagagacacctaaaactccttcgcagaaaagcatggacaggctaggaaagcaact

SEQ ID NO: 635194 - DNA, 336 bp, Homo sapiens
aaggatccccgacgccctccgtggggagccggagacagaaaaccatgaggcaatgagtgcatgaccagcttttatgatattgtccagcactgtcctctcatgccctacgtaccaggacatcatctggttatcttcaagggctaaactcttgaactcctgacctcagatgatccaccctcctcggcctcccaaagtgctgggattataggcgtgagccaccgcaccccagccccactgctgtttcggataaagtgtgagcgcctttgtgtagctgaggtggtctggtctctgctgatttctcccaccttccctcctcccagccccacagagagacgt

SEQ ID NO: 635195 - DNA, 234 bp, Homo sapiens
catctgctgtgtgtataggagaatgccagagcatgatgtcctcttcgagtcacactcggtaatgacatcataccagactccaggtaaccccagatgcacctgctacctaggtgccataccacgaggaagaatccagaaatgtatgaccttcctctgttgagaactcatagctgtgttgggtacatccttccacacccattacctgagcgttgcgagctatgggactctgtagtc

SEQ ID NO: 635196 - DNA, 401 bp, Homo sapiens
  misc_feature (159)..(159): n is a, c, g, or t
tgctgacagttaagtttctgtggctgacactcatcttcctttatcagaaagatgcggaacaatctgcttcaatgtatttaacttagcagcccagaatctttgctctttttgatttgcactgattaaaaaactttatagattaatcagaccatacctgtnctattacacagaaatttacacgagtcacaatgtgggcaggcacgcgggtcacacctgtaatctctgcactttgggagggcgaggcaggctgatcagcaggtcaggagttccgagacagcttgaccaacatggctgaacatccatctctcctaactatacacaacaaattaccgcaggtgtggtggaccatcgccgcaatcgcagctactcaggcggccgaggcaggcagacccgcttgaacc

SEQ ID NO: 635197 - DNA, 151 bp, Homo sapiens
cggaaataattttccaaacgttggagtaacttactttagggcgacaacttggatgaagcccattggcgtattcccagtatctgtagagccacgtttgacgtcataataatcacgttactgtagactacgcataccctagctacgggcaacg

SEQ ID NO: 635198 - DNA, 103 bp, Homo sapiens
tgtgaggagtgagtgtgagacttctgcatgataaccagacctgctgccgagacaaccgacagtgctgggcctgctgtccctaccgccaggcgtctgttgtgct

SEQ ID NO: 635199 - DNA, 624 bp, Homo sapiens
aagcatgatcgaatcgagctcggtaccggtgtcgtgtacatgcgcccggagggcccttcgtttggcactggacggcggtgatagatcgccagttgcgggggcagcatggaacataggggtgaccaaagctggttgctgtaaaccgctccacttcacattttgtggggcatcggaatctgccagagatgactgattgaactgcgaggaaccgtctctgcagtatccggtacagggtggtttcagtgaaggtggaaggaaggtccaggccagcaaaaatggtgtcataaatttcatccagtaacaactccaaacctgtctcagccagttcccgcccttggctgtcagcacagtggcaatacccagatacctcagggaacctcctctggaaggaactgaaggtcacaaatgcatctggaaacctgttgtagctgtgggccagatcaaaaatcatcatgtctgtggtgttgacaaatttgcactggacaggcataaactctccctccgcagaacactggggtggtgacttatctcccaccccgtggagaagacgacgatttcttatttcacagctccttggacatcgctttggactccccagctggagggtccatacacctccatccc

SEQ ID NO: 635200 - DNA, 500 bp, Homo sapiens
tagtggaacggattaaggaacattaaatcctttgaaaaaatgaatcagattgtaagaatattgtgggcctcatcacgaatatctttgtgagggtgatcagatacagtcttatttccctctgtgagatgaagaggtcaatactatggtttgctcttcagagttagagaaattgagattcaaaaaaagatagacctatcaaagattctctattcttgtcaaatcactgaagtggatggtaggggaaaagtcatgaagtatcagaatcatactctctctgaagcactgtgaccttaacatgttcagtctcaacatttggccttgaattacttgaggaaaccacttgcagtgttttttttaaagagcaggctagggacacgaaggcataggccacaagctctatggccggtacagggcatagaagttagagatgtgcttgtttccagcaaacatgaaggttcatgtggcatccctggggaaaaccctaaattaggtcacattag

SEQ ID NO: 635201 - DNA, 301 bp, Homo sapiens
cacgaggccagagtacagtggcacgatctcggctcactgcaacctccacctcccaggcatggtggcgggtgcctataatcccagctactctggaggctgaggcaggagaattgcttgaacctgggaggtggaggttgcagtgagctgagattgtgccattgcactccaacctgggcaacaagagcaaaactctgtcaaaaagaaaaaggaaaaggaaaaggaaaaacgagagaaaggagacaaagaaaggagagacaagagagaatcaaaggagagacaggagagaatgaattgagagaca

SEQ ID NO: 635202 - DNA, 1332 bp, Homo sapiens
ggaccagaagtccaaatgacttagtatatatttcttttcctctgtccctatcccccatagagcctccactttaggttctttggttactttcttggtgtcattccaacagcacattgacaagagaaccaggtttcaggctgttctagtgtgcacgactcagtatctgctcagacctttaacagcagctaactactgcctgccaagacttcttgggcgcaaacgctgtctaactcgttagggcgacgcagcttctctgctccctttgtggtcacctgcagactacttctacttcggtttacttctagtcacgtgaccacgcagcttccacctacctacacactgggtgctctgtgtctgtctaaattacgacactattaacttactccgggcagacgacacgttgcccctctcgccagtacactctattgcaccacgggtctatatactgggtccggctctgtatctctctctacaaagtacacagaggccaaggccaacttcgtgccctcaaagttaagagacctcgcaaagcaacgcaattatcttggcaacagcttatagaggccactttctactgcgtttctatagcactttttaaccgagggcctctctacaacgaaacacatccatgacccggctcatggctctaaacaggttggttcacactcgcggcacaactttacaacggctctggaccacggccttaaacgaactttcctaccgaacgcacttgcaccagtttttaaccacttgttcaaattctcagccggcgggctactgcgcctcacaggcacaagccccgctagccaaccttgggatccccacggaacttacaggcaaaatggacttgggggtctcctcccccttaacaacttggccacattggacaacttctgggtgagatcccccaaaggttgttacttagacacttcccatcgctggtctccaccctttcaatatcgggccttggtagacgattacgctataccttcaccttgggccataacaagtctctttattaaggccctccaacgcttttatttcccaaagggttggataaacctcctttataccttcccccaaactctttggccaaaacacgttttgcccaagttacacccttcaggggttacaacaagaatctgccctttaaaacaccattttagtcccgggcacaaggccaagtgggttcctttcccccatcagatgggctttagcccatgacaatcaacgcgttaacttttctgacaccttaacccgcatcgacgtgcgcctcggtctcacgcgcacacacatacgcaactcctcgccgtatagtattcacatagctag

SEQ ID NO: 635203 - DNA, 261 bp, Homo sapiens
  misc_feature (5)..(5): n is a, c, g, or t
  misc_feature (66)..(66): n is a, c, g, or t
  misc_feature (133)..(133): n is a, c, g, or t
  misc_feature (160)..(160): n is a, c, g, or t
  misc_feature (166)..(166): n is a, c, g, or t
  misc_feature (192)..(192): n is a, c, g, or t
  misc_feature (215)..(215): n is a, c, g, or t
ctcanatgtgggagggccctggtaggaaatgactgaatcatggggatgggtctttcctatgctgtnctcatgatagtgaatgggtctcatgagatctgatgattttaaaaaaagggagtttctctgtaaaagnctcttttgttttgcctgccaccattcncgtaanatgtgacttgctcctcctgccttccnccatgattgtgaaccctctccanccatgtggaactgtaagtcccaattaaacctttccttttgtaaata

SEQ ID NO: 635204 - DNA, 173 bp, Homo sapiens
  misc_feature (132)..(132): n is a, c, g, or t
acaggaggatctctagaagaacactcatctatgcagagactaacaccgtaaccaaagaatgtctatacaggaaaacaattagtctgttttttaaaaaccatataatttatatcccattcaacgtatagcctncatttggcagttattaatctccgcttactttatttctcttc

SEQ ID NO: 635205 - DNA, 239 bp, Homo sapiens
gtacaaaatcattatgagatactgatgattgtgctatattcatgtctcgtatggtgcgccatatgtagattcagcttgtatccatgattcatcatgcgcagacaacctctcatacagtactcgaatatctcatccagtgtctccttgagaccagcatcaaaagcagagggagcagaaggaggactgtctgggcttggagactcggcgcacccccacactcccttgcatactcctcagga

SEQ ID NO: 635206 - DNA, 141 bp, Homo sapiens
cgagattactacccgtttggctcgatattattagacctagcgagtctcctcccaattggaaatatgaatcatcttcagcctctgtccctggtcgcataaatttgtctgtgtactctagcaataaaatgattgtttaacttt

SEQ ID NO: 635207 - DNA, 678 bp, Homo sapiens
cccctgtgtttgtttcactgtgtgtctcagcccttcgtcctacgggtgcatctgggcgttcattcctcatgatcggggatgggtaactatccaaggatactggacagtagatgtcctgctatgtaaactctatgtaagctgcactgccttgaaagcgtcatggactatcatctcctatgagtgtaaaggatggagttactcactgcttagcatgcgctctgacagatcacctgattcacgtgaatttcactgacctttcacgttcgtgccataacagagccttctatcgccagctgtactagccacttatggacaccacatgtacttaactgtcagaggggtaagtgtggataatctctgagcgataaggccagcccctgacgctgtcattgtgaactactatcatatgaccatatgtgcatagctgactgtagcaagtctgtattgttatgacgcgatcacactcacttgcatgcatatagtaagcactttgtaatagcctatcgggtcctggatgaagagatgcctcatctgccataggggccacagaagcaagcaggtatattcactggcgcttgacagtacacggtgtcaactctcgcgatgcagatgcggagtggcttcgtctacaccatctggtgacacggccagcctgccacctttatacttgctttgagt

SEQ ID NO: 635208 - DNA, 291 bp, Homo sapiens
ggatgtcctgactggctttcgtgccggtgcagcgggatcacagtaatgagttgcttctggactacctgcatcgctgcatgacggatggatgttccgaattcaaaatgatggcaggtcgcacccagttcgtgatcagtccaaacacccgggttattgccatcgatttgaacaacatcatgggcgatgacagcaatgctggccacctgaagaccggaattatgttcctgtttgcaggcgaagtagctggaggacattttgtcctgccccagtacaaagattacttgatgaagg

SEQ ID NO: 635209 - DNA, 304 bp, Homo sapiens
  misc_feature (189)..(189): n is a, c, g, or t
  misc_feature (278)..(278): n is a, c, g, or t
  misc_feature (289)..(289): n is a, c, g, or t
gcacttaccgtgaatggagcttgcaagactagaagttgctctggaagaatcagtgaatgagtgaatgcttaggacatcactatacactactgtagactttataaacactgcacacttaggctacactaaatttatttttaaaataaagtaattgcaatatgatgttatgacagctatcatgccactagnagcagaaattcctgagctccattataatcttataagaccacccgttgtatatgtgatccttccgttatgtgggacatgaccccgatatnaaatggattgntatattgacctttta

SEQ ID NO: 635210 - DNA, 994 bp, Homo sapiens
  misc_feature (993)..(993): n is a, c, g, or t
cgttgtgacgtcgctcgtcgtataggagcttgactacattgtattgagagatagtgccaggatctctcggggaatcgagtgtctcactaatggacgaatagcctccatatgattattaggagtactcaaatcttgacctaaaagatgtatccagtggaaccagtattgagagacgtgagtgcattctctgatcgtaacatgccttctcacaatgtcatacagcgtatcgtcactcccagtatctcggaataatgaccaagtggaagtacagatggagatcgtataagtagtgaactggcaccatggtcttgcccagtatgtactcaggtcctgctgcatttggccgacctcgaggcaaacttaatctactgcagaggcgcaggtcatcgcccgaggccgatgttagctgggacaggattatgtcactgatgaactaaaaattgtcattgtgttcaaagacgtactcccgagtggtgtccagggacctgggcattggaggttattgcccaaacggaggatgaattggttgatgtccctggacgtatggacatgactggtggtggatggttggtgccaggatgcaggaggaggtcggggtcattcttctaactgtagactgaggggcttgaaattccatatctcaggtctgtgtacgaaatggagtccggtatgaaagcgcgcgatgcaagttggttcgggacttccgtcgagccctcctgaatgtccgggcaggcagggcaggcaaggactgagctccgttgacgtggatcactgggccggactgcgccgccatgttttctctccggccagtaaagttgcttgctcaggccgtgcacgtagcttggactgtccgctcacttgaggcacgggtgtcgcgcccatgcgcgcacgctcttgcgtgacctggctaccaccgacgggccaccccgcgcgtctcgcggcatacgccttcgccctcctttctccctccccgtctccccccctctcgtcttng

SEQ ID NO: 635211 - DNA, 446 bp, Homo sapiens
  misc_feature (19)..(19): n is a, c, g, or t
  misc_feature (444)..(444): n is a, c, g, or t
acaaccttgaccctcatancccaggtttaaaggaggtgaacacactggtccttaaaagcttcccctcctatcacagacgctccctaaataagctatctgtggtaatcctagccctgttccatcttgcaaactgagttgctgtataattgtatcccaatgtttgtgtttaaaaaaatatgactcttacaccgggcgcagtgctcatgcctgtaatcctagcactttgggaggctgaggtgggcggattgccggagctcaggagtttgagaccggcctgggcaaacagggtgaaaccctgtctctactaaaatacaaaaaattagctgggcatggcagcgtgcacctgtagtcccagttacttgggaggctgaggcaggagaattgcctgaacccaggtggtggaggttgtagtgagctgagattacgccactgcactccatccancc

SEQ ID NO: 635212 - DNA, 325 bp, Homo sapiens
gactatccagacctcacaaatctaagtggatgtgatccccagataacaatgtagttttctacaaactaaatgtgtaagaaacagtatctcttacaataatacagagtatgtgtcatatatctctaaatctccaaaagtggccctccaagtcgtgtgaaatgtatacacagctcagtgtcttacaagctcaactctaaaaataagagatattctccctaagcacctcaccccattctataccaacacctattctgattttgcggccaccctgaagttcatattcttatcctcacaggctgcgggataatctccctaagaggggcat

SEQ ID NO: 635213 - DNA, 883 bp, Homo sapiens
gcagtaaatgcgcactttacagccctcgacactgcagactggcagtcgctccgttggcaacctgacggctctgttgctttgtttcgtccccagcgcacatgtcaggtacgcgactcgagggtgacgctcggtccgtctcgtcccgctcgtcgtggccgtacccgggatcacggtccgagggtttggagattttagccttcaggtgcctggaatgcagatgggacagccatgtgctcatgaaacatggcccagcatatactccgtcgatggatacctctggagtccagcatagttcacgacagcgttagttcctcagactggtgactcctgtgtgtacttacttcagtgctgttgctggtacaggatggtgaacgtggatgctgaatgaacttcagaagtatgtttgacatcgagttctggacacttacatggcaacttactctcccttcagttttggaatacctgcagaaattatcattgccactgttcggatagagatcacacaggataaatgggatttaatgcattcaaatgagctatgggcagctcttaatgcctggaatgacaaacttcatgactgttgatcacgatggaacgtggctcagtagaacatcatgacgttgcgtcaagccattgtgtcttatgggttataggtagagtcctcaatagcattaagtacctattgttaaaccgttataggcagaatggcagaattttctttgatgattatgttggcttgctgtgtgaagcttcgagcattgacagatttctttaaggaaaaagagaccagttgcaacaagggtctgggaatttcatattgtgacgatgttagcagggcactaatgggcatgtgaatgcttggaatttaaagcctgaaggggac

SEQ ID NO: 635214 - DNA, 1326 bp, Homo sapiens
  misc_feature (77)..(77): n is a, c, g, or t
  misc_feature (172)..(172): n is a, c, g, or t
gatgggaagaggggaaagcccaggtctacaggaggcctctgggtgaaggcagaggctcaagcatggggttcgcgagncgaggcttggtacgatttgtgggcctgaccctgtcgtttgttgcgtgtctggtcgtacgaggatatcatcaagtcgtgcgttcaccctgcgtccntgtctcttcgtgcctgtagtgtgtggcttcctctgcagtgctcgacaagggtgcgggagagcgaattcctttgtccatgatgtgggctgggagcctagcattttgttctcgttcgctcgacctaggaattatgcgttcacgtacaatcatcgaatggcgcgagatacgtcaatagacgaatggagtgtggtaggggggctacccatgtgagagtggcccgctgtagaagggtggggagccctcgtctcatgggcactatcgtggagtttctctcgtcgcaggctttaccgcgtagggtgcaccggaagtttagggcctgtctacacgcaaaggggtggatggcaacgcgtttcctgatgatgcactgcgagcattgctgctctcattgggcttgtccgcgggagcggtcagcccggagccttgcgtggcgttggagggcgcatgggccgttcggttccccccccgggtacggctttgggcgcggtgtttagcgccccggtttggctacctatgtcccatggggcacgcaattagtagttggcgaggcggctgaccattgtccttttggggggaattcttggggccccaagggtggtgggcagcgttgtctggaaattccccgttttctgggcgccacggatttggttccccccatcttgtggctcccggttgggaagccgccatggttcgatgtcgcccattgtttgagggtagaactccacaggccaaagggcacttctcgtgaatttggaccaagaaaagcaacctatcaaggggcaaagaaggcacccattaacgtacaaggcattgtatagcccataggtccttgggctcttggggaacgtgggtcccccccgtatgtatccccccccggaaagtacttgcgccccttgggggcggtaaccccaaggctttgggcaagggtgggcgcaacgaattggccaacaaaccacgaaaggggccgttaaagcatttggccccctcccaatgtgagtaaaggactttcctaggaattgggcaccttttggcctttgggcccccctttgggacccactatccgcccaacaaccagtggttgacaagacgaggggggacttccaccttggttcccaacacacaaggcagccacatgacaagggtttcctctgttccca

SEQ ID NO: 635215 - DNA, 213 bp, Homo sapiens
aagaattcggcacgaggcgtgatcttgctgggtcggcacagcctgtttcatcctgaagacacaggccaggtatttcaggtcagccacagcttccctcctcctcgcgtctcctcgttcggtctctcgctctcccacccgatgtcgctcgctatcctggatgattccccacctgttgaaaaacggaaccaagtaaaggcagcccagtttgcttga

SEQ ID NO: 635216 - DNA, 304 bp, Homo sapiens
  misc_feature (8)..(8): n is a, c, g, or t
  misc_feature (12)..(13): n is a, c, g, or t
  misc_feature (19)..(19): n is a, c, g, or t
  misc_feature (21)..(22): n is a, c, g, or t
  misc_feature (24)..(25): n is a, c, g, or t
  misc_feature (30)..(30): n is a, c, g, or t
  misc_feature (35)..(37): n is a, c, g, or t
  misc_feature (41)..(41): n is a, c, g, or t
  misc_feature (43)..(44): n is a, c, g, or t
  misc_feature (52)..(52): n is a, c, g, or t
  misc_feature (56)..(56): n is a, c, g, or t
  misc_feature (90)..(90): n is a, c, g, or t
  misc_feature (120)..(120): n is a, c, g, or t
  misc_feature (128)..(128): n is a, c, g, or t
  misc_feature (130)..(130): n is a, c, g, or t
gactctancggnnccctgngnncnngtgangcacnnngtgnannactgggcngtcnttaaaaagctaaggtaactataaatatattgtcnaagatttaaaatattaagtttaaaaaagcntgttaccnantaatgtgtatggccttatgttgtttttatttaaaagtttatagcgggtgaagtctggatggctaaaatattaagcctgttactcttgagaatgtaattccaacacctggtgttcttatattttaattccataatttcacttgtaggaatcccttctaaagaaataatacgacct

SEQ ID NO: 635217 - DNA, 146 bp, Homo sapiens
gtgaatcaggcgccggtagtgtttcctgtctggcttctaagtagagcaacccaagaagagcctttccgctggtcgggattgtatttcgtagacacaatttcgtcgtccccttccgtaagttgtactgaataataatacgtataaca

SEQ ID NO: 635218 - DNA, 959 bp, Homo sapiens
ggcctgtctagacctgtttctgcttggttcatcgttcttttgtcggtgattccaccctgaggccggccgtggtccccaagtcaaaatggtgcagagggttttctttgccggccgtgcccagacatttgggccgggttaagggcttatccagggccgtccgctgggtcatattgcctttgaccaaagggcaccatccctggggcgtgcaccgcccttccgcacgttccagattgactatgaccggcgctgttgggccgaccaaacgatttcttgggcttggtacatcggcggggaagctttaccatcgaagcaaggcccgagcccccccagtatcccacgggaactcaaggtgagcactggaggtccacagaaactctggttggttctggacaatggaggagggaactcttggcctacgcttattgggggcacctaacctggggcccaaccttccccggactgtaaggggcaggaccctctatccgggcctttagcgccttttcttggggcccaatcccgagtccgcatccgcctacctgggcggaaaggagtagcggagcccacaatccccttttctgcaccctgaaccgcctgtgtgtgcgccaccaacctgggggattacccggctcggccacggtgttctggccctgcccttgccccccctgcccactgatagcgctacctgctctaccacgtgaggccgctcgtgatacccaccacgactgtgctgaggtcttgccaccccccccctccccctctggggaggtggggaggcacctgctggcctagaccacgctctgaaaactggtgaggctgagcccctacccccaccccagctttcggaatccaccgcccccgagccacttggagggaggaagaaagggaccggcgttcaaggctatgacaatttgctaccccaaacaatttttccagtaaaaatagtaagaaatgctgttata

SEQ ID NO: 635219 - DNA, 123 bp, Homo sapiens
gaggatcctggaatcgtcgtggtggttagataaggtcatggcttgttatcatgagggagagattggaacactcgcaggtgtacgaagtcctcgtcgtcgtcgtgccggaattcgactggtcgt

SEQ ID NO: 635220 - DNA, 155 bp, Homo sapiens
  misc_feature (6)..(6): n is a, c, g, or t
acaggnagtgtggatatacttgctgttctgggggtgtacatgtgtgtgcacacagatgaccctgtacagtgattgcatgcgtgcaccagggagtgtggatatacttgcctgttctgggggtgtacatgtgtgtgcacaaagaatgaccctgtaca

SEQ ID NO: 635221 - DNA, 739 bp, Homo sapiens
tgggtggatggaaggtctcgctctggtcgcccaggctggttttggaactccggggctcaggtggatatatcccacctaagcctcctaaagtagtgtaggcctatatggcacttggagccatctataacccagttaaattttctcaaaccttttgggtgaagaagacgggggtctggctggtgtgttgcgcccaaggcgggggtctcaaatatatttccctggcgctaagtttccacaaaggcatcgggggtattacaagtgtgtgtggagcgccatacatggcctgggctctcttaaatttgtaacacaacgcattttttggaacccctttaactctttgttcgctctaaaagagacctcttattacgctagtgtagacacctatatcatctcatagtggttgtcgtcctctgtgccagaaaaacaaagagcaggttttctcgagtgtgttggaacccacatgtgtttgtgcgccgggctcttcaaggtgtgcccccatttttgtgggggcccacagtgttggagaaacagcttctcccatcttaaagggggattttttaagggtcacccgtgggcaattgggggagcgatttatataaactatcggggggagactagtcaacacttgagacctcataagggggggcgttatggagaggtctattagagggtctgcagagagtttatcagttgtttcgccctttctcaacaaaagtttttggaggaacgagttttgttg

SEQ ID NO: 635222 - DNA, 346 bp, Homo sapiens
gacccctgcaaccccagtttcccccacttcaggattttgggtcagaaggaaactatcccgacagctatgtgtactcctgcagacttctgggtttggccatggttcccgtcagcccccagacccccgacaagtgtctgaggggatgtggaacccagcccactcccaccaacttctgccctgcagctgcatggagggcgggttggacaggtgagccacagcccctgccttcaggcagctcacacagtgagggaagcagccctgcaaaggtggccgcagctggaaaggcgtgtgtgtgccgcagaggttcagacccagtccaggggagagggataggatgcccaaaaaa

SEQ ID NO: 635223 - DNA, 669 bp, Homo sapiens
ggccgcgcgcgagcgcagcggtgggaggctgggaccagccggttgaggccccaggcttggggtcaccactaattgtggctacgaggctctggaagctatgagcggaagcttcgaggcatgatggtcgactacaaggaagagggcggagcggtagacgggatgtattatgagaagagatcaatgaaggacccatgcccagttcctgcaggtacattggcctgagcttgcagaggtgcaccatggattcgtgcagtaggccgctggcccgctgtagagccactgttaataatgaatgccctaggcaggggggacaccgaacaacattgattgacgcgattcagatgtcctgtgccacaccatgtgaccagcatccccggactacaacacgccccgatctgcgtcaccgagcgatcgtccccaagaaacagggagtcgggaacgaactggaaggtggtaacgtactgaggctgctacgagagcgcctggatgcaggaagcgacttttgccggacatctacaggaggacgcagttgccatgtacgcagatctaggattgagtgagtatgtagcggagggacgtccaggagagcccagacgaaggatgacgacagaacgaaagcgtggcaggagagagacaggcttaccatacggttaatacactacgaggaac

SEQ ID NO: 635224 - DNA, 173 bp, Homo sapiens
ggtcagtgatgttcccaacactatgatttatattaatagttactgcatattatgaaacgtgagtcatcatgtaagtattccctgtcaaccattttatagcctgtgaatttcagatatttaggtgagtagaaaccttaagattaaatatatggttatttttaactaaaataatt

SEQ ID NO: 635225 - DNA, 270 bp, Homo sapiens
gcacccagtatagacctaactcagagctaaggcttggtgatattagccaattagactcagcttgaagtgtagagctggttagactgagttcatcctctaaagtgcacctgatcacatgcagccttggcgatgtgctgctgagttgaaagttcgtgccaggaaatttgacgtgggttttatttttcacctgctgaaagaacaggatcctacagcaattaaaaaacaatcacataacaactatagctacagtgtgctgttaggtctacctgg

SEQ ID NO: 635226 - DNA, 181 bp, Homo sapiens
agtatgcactaggtcctcgtgtttcacccacagagctgtctgtgggtgcttctcaatctcagggcaaaacgccctggagaatattccagccagcagagaattttgacttgcagtaggattttggtttgattttcctacgatctgggtggatgccttgcttgtgacagatgcagttcctatt

SEQ ID NO: 635227 - DNA, 804 bp, Homo sapiens
ggcagacatggcgacattgacagtggtccagccgcttactctggacagagatgttgcaagagcaatcgaactactggaaaagctacaagaatctggagaagtaccagtgcacaagctccagtctctcaaaaaggtgcttcagagtgagttttgtacagcaatccgagaggtgtatcaatacatgcatgaaacgattactgttaatggctgccctgaattccgtgcgagggccacagcaaaggcaacagttgcagcttttgcagccagcgaaggccactcccaccctcgggtagttgaactgccaaagactgatgaaggcctgggttttaatgtgatgggagggaaggaacagaattccccgatttacatctcccgcatcatccctggaggggtggctgaaagacatggaggcctcaaaagaggggaccagctgctatcagtgaacggagtgagtgtggaaggggagcaccatgagaaagctgtggaacttctcaaggctgctaaggacagtgtgaagctggtggtcagatacaccccaaaagtcctggaagagatggaggctcgtttcgagaagctgcggacagctcggcgtcgacagcagcagcagttgctcattcagcagcagcaacagcagcagcaacaacaaccagaataaaaaccacatgtcataaggcgctcgaagggaaagctagcaggtcaatcatccgccagtcacaatttgggaaacccgggctccggaatcccagcccgaaaaggggaagaaacccccgtatgaacccggtcaaagtggggaccctggggttc

SEQ ID NO: 635228 - DNA, 180 bp, Homo sapiens
cctaaaaactttttaatttggtttaatttggaatgatgagcctcctggccccccttcccccttttttttcccccaaattgagatgtatgaaggcttttggtctcccttggaattggttgaagcaaccaaggccttacctgtacactgacttgagaccagttgaataaaagtgcacacctt

SEQ ID NO: 635229 - DNA, 107 bp, Homo sapiens
tggaattcgtcaggctgctggcgcctctgcaagggcagaacactagcctgaccgtgggcggggccttgcggtatccgcccccaataaaagcggttccaaccttaaaa

SEQ ID NO: 635230 - DNA, 134 bp, Homo sapiens
ccactttggcgaggcagtctcgaactgacctcgtgatccacctgcctcagcctcccaaaatgctgggattacaggcttgagccactgctcccggctgatttttgtattagtggagactgcctcgccaaatggtg

SEQ ID NO: 635231 - DNA, 311 bp, Homo sapiens
tgcacagtgcgtcggccatgactgtgtatgccctggtgggtggtgtcttacttcctcatcaccggaggaataatctatgatgttattgttgaacccccaagtgtcggttctatgactgatgaacatgggcatcagaggccagtagctttcttggactacagagtaaatggacaatatattatggaaggacttgcatccagcttcctatttacaatgggaggtttaggtttcataatcctggaccgatcgaatgcaccaaatatcccaaaactcaatagattccttcttctgttctacggcttcgtcggtca

SEQ ID NO: 635232 - DNA, 365 bp, Homo sapiens
tttggtccattatcagattgtctctgtaaatatattcctctaatctgtggcttttcttttcttttcttttctttctttttttagatggagtctcactctgttgcccaggctggagtgccatggtgcgatctcagcttgctgcagcctccgcctcccgggttcaagcgattctcctgcctcagcctcccaagtagctgggattacaggcacccaccaccatgtccagctaatttttgtatttttagtagagatggggttatgccatgttggccaggctggtctccaacccctgacaacaggtgattcgcctgtcttggcctcccaaagtgctgggattacagatgtcggccactgcacccagccct

SEQ ID NO: 635233 - DNA, 121 bp, Homo sapiens
cccagcctcagactgcaactctcagcaccacacatcatgccaggggtcggcttacccagaacttggtaaacccaggtctgccacctcttccttccatgcctacccgaaacttacctagcat

SEQ ID NO: 635234 - DNA, 86 bp, Homo sapiens
gtgactacttctacacatgaaccataatgctgcttttgtgctgtctgctctgatatacgttgaacaatgtagcagcactgtcattt

SEQ ID NO: 635235 - DNA, 517 bp, Homo sapiens
  misc_feature (157)..(157): n is a, c, g, or t
  misc_feature (170)..(170): n is a, c, g, or t
  misc_feature (507)..(508): n is a, c, g, or t
atagcagctgaaggtcccacgtgctcctcaaaagaaattagctcatctccagataatcatcagagtccagctaagcggctaatagaacagaacaggacgtgatagcaaacagcccttcaaacccacaggcctgtacatcaaaggagtggtcaacgcntgagcaccgtcancagagcagctgctttgcctctgggaacatgcgggagataggaggcttcctccttaaccctactgcagaggacttctcctcttttaccagcagcctcctgcagtaccctcccgggtaatggagcaggggtcgcttcccttcccatgagacctttgttcaggcactcaagtggaaggttgagcaataagccaactttcttgctcagaggctccgcagacttcctgtggttgtttgttccactctgtggtcagtcaagcaagctcaccgcctgattctcttattgttgtactaagcacaagctattatacttatgattcataatcatatagtaaagcacnnttctaagca

SEQ ID NO: 635236 - DNA, 983 bp, Homo sapiens
  misc_feature (7)..(7): n is a, c, g, or t
  misc_feature (64)..(64): n is a, c, g, or t
  misc_feature (84)..(84): n is a, c, g, or t
  misc_feature (88)..(88): n is a, c, g, or t
  misc_feature (123)..(123): n is a, c, g, or t
  misc_feature (135)..(136): n is a, c, g, or t
  misc_feature (145)..(145): n is a, c, g, or t
  misc_feature (185)..(185): n is a, c, g, or t
  misc_feature (211)..(211): n is a, c, g, or t
  misc_feature (309)..(309): n is a, c, g, or t
  misc_feature (375)..(375): n is a, c, g, or t
  misc_feature (446)..(446): n is a, c, g, or t
  misc_feature (450)..(450): n is a, c, g, or t
  misc_feature (468)..(468): n is a, c, g, or t
  misc_feature (470)..(470): n is a, c, g, or t
  misc_feature (477)..(477): n is a, c, g, or t
  misc_feature (481)..(485): n is a, c, g, or t
  misc_feature (487)..(487): n is a, c, g, or t
  misc_feature (493)..(493): n is a, c, g, or t
  misc_feature (577)..(577): n is a, c, g, or t
  misc_feature (715)..(715): n is a, c, g, or t
  misc_feature (805)..(806): n is a, c, g, or t
  misc_feature (821)..(821): n is a, c, g, or t
  misc_feature (897)..(897): n is a, c, g, or t
  misc_feature (921)..(921): n is a, c, g, or t
  misc_feature (976)..(976): n is a, c, g, or t
gggaggngtgagggagagaggacagagctggacgtctcctcctatttctccctccccaagtcantctgaggggaagaacactgntgcntgctccctgggcctgcccgcatacaaggttagagnctgggtctgggnnatccttagnctgaaatttgttgacatggggcaggagagcaggagggaanattgagggttttgactcttcgggctntaaaaggattactcaggatctggagttccgtatgaaacaaaggagctgaaagaatttgattgccattggctaaaaatatagaggatttgagccacaantggcccacatttgaagaatgaggaacaagaaatttagtggggatataatataaatgtatgggagtnagaaagatgcaaaaaacaaggctagctcctcaaacctcctcctctttcttcctcatctccagcttataganaatntggtagccatcatcccangnatagagntggnnnnntngggggnatagcggaggctggcatgggcaccatatctgcggggaaaataagggagtgctgcccgttcaggggtcagggtgccgctggcatnaaaggagcactggatgcgggcccgactggcaggacgggtgttatagacgacatagagggtcccacagatgacaaaggcagcctcagcattctctctggacatggtgttcccactgctgctctgtgtcagtgtctgtgnatctaacttggccagacacaagtgcctgtcatcctcccgggtggcatagacagcccaaagaccttcctcatcagctgccaggtcgatgtnngtgtctgctgtcaanccgtagggggggatcagccctctgctgggaatactgagctgtccacactgtccggtttgcaggtggatttgatagngcaagtgtctcatctcacactccncaggcttcaggaggctcgagcaaataagaagcacataacagcggctgtgctaccngggaggg

SEQ ID NO: 635237 - DNA, 744 bp, Homo sapiens
acccactccaactccaactccaactccaaccgttggaaactacagcattagaaatggcaatactacctgtctgctggctaccatggggctgcagctgaacatcactgaggagaaggtgcctttcatttttaacatcaaccctgccacaaccaacttcaccggcagctgtcaacctcaaagtgctcaacttaggctgaacaacagccaaattaagtatcttgactttatctttgctgtgaaaaatgaaaaacggttctatctgaaggaagtgaatgtctacatgtatttggctaatggctcagctttcaacatttccaacaagaaccttagcttctgggatgcccctctgggaagttcttatatgtgcaacaaagagcaggtgctttctgtgtctagagcgtttcagatcaacacctttaacctaaaggtgcaaccttttaatgtgacaaaaggacagtattctacagctgaggaatgtgctgctgactctgacctcaactttcttattcctgttgcagtgggtgtggccttgggcttccttataattgctgtgtttatatcttacatgattggaagacggaaaagtcgtactggttatcagtctgtctaatcaagccagtctcgtgcttccattggccaaaagccaggaattgctgtgcgataaaatcggatccacagactgacttcagtgagttgcaagctggcttgggctgaagtagaactttccattgccttaggaccagt

SEQ ID NO: 635238 - DNA, 788 bp, Homo sapiens
acccactccaactccaactccaactccaaccgttggaaactacagcattagaaatggcaatactacctgtctgctggctaccatggggctgcagctgaacatcactgaggagaaggtgcctttcatttttaacatcaaccctgccacaaccaacttcaccggcagctgtcaacctcaaagtgctcaacttaggctgaacaacagccaaattaagtatcttgactttatctttgctgtgaaaaatgaaaaacggttctatctgaaggaagtgaatgtctacatgtatttggctaatggctcagctttcaacatttccaacaagaaccttagcttctgggatgcccctctgggaagttcttatatgtgcaacaaagagcaggtgctttctgtgtctagagcgtttcagatcaacacctttaacctaaaggtgcaaccttttaatgtgacaaaaggacagtattctacagctcaagactgcagtgcagatgaagacaacttccttgtgcccatagcggtgggagcagctctgggaggagtacttattctagtgttgctggcttattttattggtctcaagcgccatcatactggatatgagcaattttagtaactgcaatctgattgattatattacagaatacatacaaaaaaacaaagttgtcttacctgtcagtgtatgaagcactttgctccttaagacagacaccttggaactttcattcggaaattagtccccgaagtttgagataagtctttttttgaatttttttttctctgatctgcttaaa

SEQ ID NO: 635239 - DNA, 936 bp, Homo sapiens
ggccgccgctgtctgagtcgactctgcgccggccggcgcgatggaggccgccgcccagattcttcgtctatagcccggacgtggtctacggaccctgaggccatcgaggcgcaatacgagtgccggacgacgcgcgtctagccgcgagggtggcgttctctaggtgcaccccatgtccacgcgcttcaccttccggagcggccggcaggtgccccggtctcggggtcatgcttgttcggcttggggctgggaacaacggctccacactcaccgccgcggtgctggccaatcgactgcgtttgtcctgagcaccactgcagtcagcgggcgcaaggaggccaaatactagggtctcgatggactcaggcggagcagccgtgagcctgggcctggacgccgagggccaggtaggtgttcgtacccttcagcggctggtgctggccatggtggcgcccaacgcactcgtgttcgatggctgggacatctcgtcgctgaacctggccgaggcgatgcggcgcgcgaaggtgctggactgggggctgcaggagcaactgtggccgcacattggaggccctgcggccccgggccttcatggtgtacatccccgaattcatcgcgggcaaccagagcgcagcgctggcggacaaacctcatccagggctccgagttgccgcacgcagcctggcagcaagaatccggcagtgaacatcccgagaacttccggggttcataagccgcagggggcctggacacacaagtcacatacagtggccggtagacacgggcgaaaacaaccgggaagcgcacatacatggcagcaaagagcgaaattcccaggggcactacaaccggcacactaggcagaaagaaacacttggcttgccagacaacccaatggaagaccacggacacgggacaggtgtgtaaagcccttga

SEQ ID NO: 635240 - DNA, 231 bp, Homo sapiens
agctaaaagcagcacacccgtctcatgtagcagcaatcgatgggaaagcattaatcaggtagaggagacaacaactatcgagactgggtgatagctggttgtcccaagataaggaatcacagttcacgtttaaatttgccacagaaccctctaaatccccttgtaaatttaactgttagtccaaagaggaccagctctttggacactcggaaaaaaccttgtagagagagt

SEQ ID NO: 635241 - DNA, 665 bp, Homo sapiens
agcggaatcgcaggctacgggagccagcagtggcaacacgctcgggtccccttccacactgtggaagctttgttatttcactctttgggtccacactgcttttatgagctgtaacactcaccgcaaaagtctgcagcttcactcctgaagccaggagaccacgagcccaccgggaggaacgaacaactccagacgcgccaccttaagagctgcaacactcgccgcgagggtccgcggcttcattcttgaagtcagtgagaccaagaacccaccaattccggacgcagcaccagtgatggaggctgacatgatgtaacagtcagaaaagaagacttgacaatcaaatgaaacatatgaagatgctaggttgctggctttgaagatggaagaaaggaccgcaaggcaaggctgcaggcaacccctagaaactgaaaaatgaaaggcagctgtttgtcgactttcacctccagaaggaacgcagcctccctgacacagagtagaggatttctgacctctagaactgtaaaataataaatttgtcggtttagaccactaaatttgtactatttttctaagcagtaattagagactggtaaaaattgtagtacttgaacaatgtgatgctgctataacaaaataaaaatttgaaattggctttaggattg

SEQ ID NO: 635242 - DNA, 246 bp, Homo sapiens
cattgttccttcaccgtaaggatcatctcactgtggcaggagagctcatgtatgggttactcctgaccatgagctctgtagcgtccggcggcgcatcttaggtgcataagtacacttggatctgctcactgaccagagaatctacatctaaacccttaagtacagcattactctctgcgtatgtaagcatgtgcagcaaaaattcagcactcttcatgggacaccgaccttgatgtccagccccat

SEQ ID NO: 635243 - DNA, 132 bp, Homo sapiens
ttcaatgcagaattaccacatgtcacaaggttatcgtgtacaacttcaacatgactcagtgacggatcacacaattatacagtgcatggaatctataaataataaacagaaacacaagatacgtggaacaat

SEQ ID NO: 635244 - DNA, 222 bp, Homo sapiens
  misc_feature (25)..(25): n is a, c, g, or t
  misc_feature (133)..(133): n is a, c, g, or t
  misc_feature (151)..(151): n is a, c, g, or t
  misc_feature (183)..(183): n is a, c, g, or t
  misc_feature (210)..(210): n is a, c, g, or t
ggagcaaatcatatccttctccacnttgtgtctatatatgcgcccggacagaggttttgggcagaggggaaagcagcttcccaggccttactcaaggcctcaggtccatgggttgggcagccagttctgggcnccttcttcaggatccttncattccatcctcatcctcttccttcacagcantttacttggagctctttgtgacacacncatgtcagtcat

SEQ ID NO: 635245 - DNA, 620 bp, Homo sapiens
  misc_feature (43)..(43): n is a, c, g, or t
  misc_feature (72)..(72): n is a, c, g, or t
  misc_feature (114)..(114): n is a, c, g, or t
  misc_feature (125)..(125): n is a, c, g, or t
  misc_feature (127)..(127): n is a, c, g, or t
  misc_feature (195)..(195): n is a, c, g, or t
  misc_feature (200)..(200): n is a, c, g, or t
  misc_feature (204)..(205): n is a, c, g, or t
  misc_feature (243)..(243): n is a, c, g, or t
  misc_feature (245)..(245): n is a, c, g, or t
  misc_feature (251)..(251): n is a, c, g, or t
  misc_feature (258)..(258): n is a, c, g, or t
  misc_feature (267)..(267): n is a, c, g, or t
  misc_feature (288)..(288): n is a, c, g, or t
  misc_feature (291)..(291): n is a, c, g, or t
  misc_feature (293)..(293): n is a, c, g, or t
  misc_feature (297)..(297): n is a, c, g, or t
  misc_feature (311)..(312): n is a, c, g, or t
  misc_feature (315)..(315): n is a, c, g, or t
  misc_feature (317)..(317): n is a, c, g, or t
  misc_feature (321)..(321): n is a, c, g, or t
  misc_feature (325)..(325): n is a, c, g, or t
  misc_feature (331)..(331): n is a, c, g, or t
  misc_feature (345)..(345): n is a, c, g, or t
  misc_feature (349)..(349): n is a, c, g, or t
  misc_feature (353)..(354): n is a, c, g, or t
  misc_feature (365)..(365): n is a, c, g, or t
  misc_feature (367)..(367): n is a, c, g, or t
  misc_feature (369)..(369): n is a, c, g, or t
  misc_feature (376)..(376): n is a, c, g, or t
  misc_feature (380)..(380): n is a, c, g, or t
  misc_feature (395)..(395): n is a, c, g, or t
  misc_feature (397)..(397): n is a, c, g, or t
  misc_feature (404)..(404): n is a, c, g, or t
  misc_feature (410)..(410): n is a, c, g, or t
  misc_feature (413)..(413): n is a, c, g, or t
  misc_feature (416)..(416): n is a, c, g, or t
  misc_feature (420)..(420): n is a, c, g, or t
  misc_feature (423)..(423): n is a, c, g, or t
  misc_feature (440)..(440): n is a, c, g, or t
  misc_feature (444)..(445): n is a, c, g, or t
  misc_feature (454)..(455): n is a, c, g, or t
  misc_feature (462)..(462): n is a, c, g, or t
  misc_feature (464)..(464): n is a, c, g, or t
  misc_feature (467)..(467): n is a, c, g, or t
  misc_feature (473)..(473): n is a, c, g, or t
  misc_feature (486)..(486): n is a, c, g, or t
  misc_feature (489)..(489): n is a, c, g, or t
  misc_feature (491)..(491): n is a, c, g, or t
  misc_feature (505)..(505): n is a, c, g, or t
  misc_feature (509)..(509): n is a, c, g, or t
  misc_feature (511)..(511): n is a, c, g, or t
  misc_feature (513)..(513): n is a, c, g, or t
  misc_feature (517)..(517): n is a, c, g, or t
  misc_feature (521)..(522): n is a, c, g, or t
  misc_feature (528)..(528): n is a, c, g, or t
  misc_feature (543)..(543): n is a, c, g, or t
ggctaaaaaacatcctttattgtacataaacaggggattctgnaaatgatcaagtaaatggaattttgaacnggtaaaggggaaacaagaattaaggtttccctggggaatagngcaaaaaaggngngccccacccatagggttatttacaataggtcctccggggaaaggaccccaaggggttaaccacaaatntttgnccannccaattttttgatcaaactttacctttagcaaggggtntnaacaanaaagttntatttaaanaattcgctcgggttttttttnagncntgangaaataatgggaannttntnaggnacanaaggtnatccctggtcaccncccntggnnaggctgggggnantntttggantaanccccacggggggggntnttttctngatagnttnatnttcnagnaaaatatttttttcccngtgnnaaagcccanntggtccnanatngggccnccaagaaccaggncantngggaaaaatgggcnttgnantngggnaccnntaaaanaaaaggccccacacntggcccttttaaaatttttcatagccccccgggatatatgggcgaaattcccggtacccaaaaaatttgggtgtttg

SEQ ID NO: 635246 - DNA, 619 bp, Homo sapiens
  misc_feature (43)..(43): n is a, c, g, or t
  misc_feature (72)..(72): n is a, c, g, or t
  misc_feature (114)..(114): n is a, c, g, or t
  misc_feature (125)..(125): n is a, c, g, or t
  misc_feature (127)..(127): n is a, c, g, or t
  misc_feature (195)..(195): n is a, c, g, or t
  misc_feature (200)..(200): n is a, c, g, or t
  misc_feature (204)..(205): n is a, c, g, or t
  misc_feature (243)..(243): n is a, c, g, or t
  misc_feature (245)..(245): n is a, c, g, or t
  misc_feature (251)..(251): n is a, c, g, or t
  misc_feature (258)..(258): n is a, c, g, or t
  misc_feature (267)..(267): n is a, c, g, or t
  misc_feature (288)..(288): n is a, c, g, or t
  misc_feature (291)..(291): n is a, c, g, or t
  misc_feature (293)..(293): n is a, c, g, or t
  misc_feature (297)..(297): n is a, c, g, or t
  misc_feature (311)..(312): n is a, c, g, or t
  misc_feature (315)..(315): n is a, c, g, or t
  misc_feature (317)..(317): n is a, c, g, or t
  misc_feature (321)..(321): n is a, c, g, or t
  misc_feature (325)..(325): n is a, c, g, or t
  misc_feature (331)..(331): n is a, c, g, or t
  misc_feature (345)..(345): n is a, c, g, or t
  misc_feature (349)..(349): n is a, c, g, or t
  misc_feature (353)..(354): n is a, c, g, or t
  misc_feature (365)..(365): n is a, c, g, or t
  misc_feature (367)..(367): n is a, c, g, or t
  misc_feature (369)..(369): n is a, c, g, or t
  misc_feature (376)..(376): n is a, c, g, or t
  misc_feature (380)..(380): n is a, c, g, or t
  misc_feature (395)..(395): n is a, c, g, or t
  misc_feature (397)..(397): n is a, c, g, or t
  misc_feature (404)..(404): n is a, c, g, or t
  misc_feature (410)..(410): n is a, c, g, or t
  misc_feature (413)..(413): n is a, c, g, or t
  misc_feature (416)..(416): n is a, c, g, or t
  misc_feature (420)..(420): n is a, c, g, or t
  misc_feature (423)..(423): n is a, c, g, or t
  misc_feature (440)..(440): n is a, c, g, or t
  misc_feature (444)..(445): n is a, c, g, or t
  misc_feature (454)..(455): n is a, c, g, or t
  misc_feature (462)..(462): n is a, c, g, or t
  misc_feature (464)..(464): n is a, c, g, or t
  misc_feature (467)..(467): n is a, c, g, or t
  misc_feature (473)..(473): n is a, c, g, or t
  misc_feature (486)..(486): n is a, c, g, or t
  misc_feature (489)..(489): n is a, c, g, or t
  misc_feature (491)..(491): n is a, c, g, or t
  misc_feature (505)..(505): n is a, c, g, or t
  misc_feature (509)..(509): n is a, c, g, or t
  misc_feature (511)..(511): n is a, c, g, or t
  misc_feature (513)..(513): n is a, c, g, or t
  misc_feature (517)..(517): n is a, c, g, or t
  misc_feature (521)..(522): n is a, c, g, or t
  misc_feature (528)..(528): n is a, c, g, or t
  misc_feature (543)..(543): n is a, c, g, or t
ggctaaaaaacatcctttattgtacataaacaggggattctgnaaatgatcaagtaaatggaattttgaacnggtaaaggggaaacaagaattaaggtttccctggggaatagngcaaaaaaggngngccccacccatagggttatttacaataggtcctccggggaaaggaccccaaggggttaaccacaaatntttgnccannccaattttttgatcaaactttacctttagcaaggggtntnaacaanaaagttntatttaaanaattcgctcgggttttttttnagncntgangaaataatgggaannttntnaggnacanaaggtnatccctggtcaccncccntggnnaggctgggggnantntttggantaanccccacggggggggntnttttctngatagnttnatnttcnagnaaaatatttttttcccngtgnnaaagcccanntggtccnanatngggccnccaagaaccaggncantngggaaaaatgggcnttgnantngggnaccnntaaaanaaaaggccccacacntggccctttacagatattcatgccccggcgcattaaaggccgattcccgggaccacaacaaaggggggttttcgag

SEQ ID NO: 635247 - DNA, 276 bp, Homo sapiens
aaggattgttattttgaaagattgcctgggctgggtgtggcggctcatgcctatagtcccagcactttgggaggctgaggtgggtaggttgcttgagcccagaagtttgagaccagcgctggcaacatggggagaccctgtcttgacaaaaaataaaaataaaaaaattagccaggcatggtggctcatgcctgtggtcccagctactcgggaggcagaggtgggaggatcactggagccccactgtgctccatcctgggtgagaggcactctctc

SEQ ID NO: 635248 - DNA, 417 bp, Homo sapiens
  misc_feature (85)..(85): n is a, c, g, or t
aaacttcccggggcctaccttcaaaatacaggcaatcgccacatgatattttctgtcagcaacagatacgatagtggtcccatanagtaacacctatttttactataccttttctatatttagatatgtttagatacacaaatacttcctattgtattgtctatagtattcagtagagtaaaatgccaggttgttcgtggcctgtaaacaataggctataccatatagcctaggtatatattaagttctaccatctagatttatgtaaatgcactcgatgatgctgaaacaacaatgaaatcacctaacaataaatttctcagagtgtaaatgacataccactgtatatccagagaagcccacttcttactacttccactgccaaaggccaacacctggttcaagctatctgtgtct

SEQ ID NO: 635249 - DNA, 438 bp, Homo sapiens
  misc_feature (214)..(214): n is a, c, g, or t
  misc_feature (389)..(389): n is a, c, g, or t
attcgcggccgcgtcgacgaaactggcaagctggaagctagtttcttctacaagccccaagaagactgattttttcgtctataaaattgagacagttttactgctttgctcatctttatagggatgttatgaggatcacataagatataatgtatgtaaaggctgggagtgatgctcatgcctgtggtcctggcactttgggaggttgaggcgngcggatcgcctgaggtcgggagttcgagccagtctggccaacatggtgaaaccccgtctctactaaaaatacaaacattagccaggtgtggtggcacatgcttgtaatcccagctactcgggaggctgaggcaggagaatcacttgaacccggtgggcggaggttgcagtgagtnaagatggcaccactgcactccagcttgggaaacagagcgggactccatc

SEQ ID NO: 635250 - DNA, 127 bp, Homo sapiens
gattctctgaagtagcaggtgatgtaggtatatactgctcgcactactgattttggctctcatttcactcttcagtgttcctgttatttatgaacggcatcaggcaccagatagatcataaatctag

SEQ ID NO: 635251 - DNA, 469 bp, Homo sapiens
tcgtgttggccagaggttgtcacaggataacatgtagcaaggtctctgtgtcataaatagtttagaggaaaggtgctgcgctgtgatgtgcacgtaggccagatttatgtctgactttacacaaacatctcagtgcagtaaagagcggtattgccgccagcttgtctcacctccagccataaggcagttttctcgtatcccagtaaatagaatgtacaatcgggtcttacaccgagacattccattcccagggaggagcaggagatagatgctttcctcctatctcaactgccaagaggccttcctctttcactaatcctcctcagcacagaccctttacgggtgtagggctgggggatggtcaggtttttcccttgtcacgaggccatatctcaagctgtctcaatcgggggaaaccttggacaacaaccaggctttcttgggcagaggtccctacggccttccgcaa

SEQ ID NO: 635252 - DNA, 480 bp, Homo sapiens
  misc_feature (184)..(184): n is a, c, g, or t
gcaaatagtttcttcctttccatatttcaaaagtacttgggagatgaggtgggaggaatcacgagcccgagacggaggttgcagggagctgaaatcgcaccactgcactgcagcctgggtggcagagcgagaccctatctcaaaaaacaaacaaaaaaaccccatgaatttactaactgaattntcttactgactcaaaggcatgtacagagtaataaaaggggggtgggatagcgcgagtgtgtacactacagtttttatctgcttcatcatggaaggaaaaaattaacttgcttcagaatgctgcctgccaactctagatcaggaagacatcttaagaaaatgatagcaagaaaaatccaagactgggcgcagtggctcactcctgtaatcccagcactatgggaagccaaggcaggaggatcactggagcccagcagtttgagaccagccaggacaatagtcaaaaccctatctctt

SEQ ID NO: 635253 - DNA, 1134 bp, Homo sapiens
ggtgactttagagaatgtacattggccgggtgcggtggctcacgcctgtaatcccagcactttgggaggccgaggcgggcggatcatgaggtcaggagattgagaccatctcctggctaacacggtgaaaccccgtctctactaaaaatacaaaaaaaaaaaaaatttagcccaggcgtgggtgggcggtgtggcctggtagtcccaagataactcaggcaggctgaggcaggagaatgggcatggaacctggggcaggcagacgctggcaagtggagccacagatcggcgccattggcaactccgagcgcggggcaacgagaccggaagaactcccgcgcctcgaaacacaaaaaaaacaggaggcaagaacatggcgtacacttgcacagggcgaaccaacttgggcgcctcccagaaaagagaagagcgcccagaggcaacacggggccccttggggacgccccctaataggggggagaacccactggctggcgagcggtggtgaaagacacagcagcgcaagagaatcccccctttgggcgcccgcgaagggtgtcaacccgggggggggataaccccctgtggaaacagcgggtcgatggaggaccacacacacaacccccgtggtaaacggcggagcagaaaggggggacactccggggacatcaccagttacacagcgcgaaaaagcactaaaaaaagcagagcacgcggggcaaaaacgcagagcgcgagggttatgcctagaaaatacactcccaaagaagttggggtcaaacggacccccggggaggggctacaaccccgcccaacatgaattaggggtagttagggagcacccccccgggggcaaggcgaacgaagacaatggggggacaacttggggggtcacacacaaattgttggggccaccacgtgtgggtgagacgacaacagtggtgtgtctcccttgttaatataagcaccttcaacgggggggtagtgggccgcggataaacgcagaatctatcggaggaggagcacttgttccagtagccgcagttgtgtccgccgacgttgtagatcgttcccgattgtaaacagattatgtcaccgcctgtgcggggtaaggacacctggggtgtggccacc

SEQ ID NO: 635254 - DNA, 358 bp, Homo sapiens
ctatgagatgttaggctgtattttaggtgcagagacagacctctaggtgtgtcagttcaacatggcaacattggagactcccatagtatatagtgggggtgccaaggctcaaaggcaggctgagaacatagtggcccaagtccgaaattggggtggctggtcccagagcggtatgaaaagctcaggactggaagtcgcctccacaatggggtaggcgtggctacaatatgtgaactgcgtttatctagggcagagtaggaggaacggtgaggttgtcaccactccccagctccgagcacttcggggacgtcctggggcttacccaggcgctcggagcacagctgacagtcgtgaacgc

SEQ ID NO: 635255 - DNA, 384 bp, Homo sapiens
  misc_feature (2)..(2): n is a, c, g, or t
  misc_feature (6)..(6): n is a, c, g, or t
  misc_feature (297)..(297): n is a, c, g, or t
gnctgnccagtcatgggtcacataacgatggggatacattctgagaaatgtggtgttaggtggtttcatcactgtgtgaacctcagtgttcagacaaatccagatggtatagcctactacacacatgggctctatggtatagtctattgctcttaggctacaaacctgtatagcatgtactatagtactgaatactgtagggcagttataacacaaaggtaagtatttgtgcatctaaacatagggaaaggtacagtaaaaatacaggcacaaaaggataaaaaaatgggtatgccntttttatggccttaggctcctgcttttcgagtgagtccagtgagtgagtgggtgagttaatgggggaggggcttggggccattccgg

SEQ ID NO: 635256 - DNA, 362 bp, Homo sapiens
cgatcggccggtcccctagtttagaagttccaatagcattcattatctaacataacatagaattctagttgtacatacaatgtaataaactatgacaccagctgttaaggagaaagtcgtgcatgtaagtgcatatatattaccgtaaggccaagaggacaagcacgggcgagctcccgttgggatgtaggtaacatgcatgcagctgcctcttgatctaggacgagtaatgacacattgagtgagatcatcatatgggaaatacacaagatctaggtgagcagtatcccgtcgtcgaaagctgtctgtaagagccctcagttagacgcaggaggcgctgtcattcgtcgaaggtgctctta

SEQ ID NO: 635257 - DNA, 110 bp, Homo sapiens
ccaggaaaggataattggaagtttttttggcccttcccttatgggccttttttcattggggattttaatctgtatcctttccctgtaataaactggaactatgggggcca

SEQ ID NO: 635258 - DNA, 183 bp, Homo sapiens
  misc_feature (47)..(47): n is a, c, g, or t
  misc_feature (68)..(68): n is a, c, g, or t
  misc_feature (108)..(108): n is a, c, g, or t
  misc_feature (167)..(167): n is a, c, g, or t
  misc_feature (172)..(172): n is a, c, g, or t
caatgcccaatctgagtgtatacacatcttaggaaaaataatctaangtaacttttgagggtgagagnggaaataagagatcacatttattcaagactgatccctatnaggaaggagaggcccaggcacagataccacaaaagagcacagtacccagctgtcctggnattgnttgagtgtaag

SEQ ID NO: 635259 - DNA, 450 bp, Homo sapiens
  misc_feature (267)..(267): n is a, c, g, or t
cgttgcacgacctcaccgaacagcggctgcacggcgttgacgaagttctcggcgtagtcgcccaccggcggtctggccttcgcggacgagtgttagaccaaccggtattcgcgtagatcgaccggcatcagcagaacaacggccggtactttgcgctgtagcccaatgcatccggattacgcttggcgaacactttggcggggttgccgaccacgtcagcgggccacgtccttgaccacgagcgcctgcggcggacgacggcgctcngtatcagggcgggcacaccatggcccggctcgcgatccagacgtatcctcgatcacggtcgggatcgggatcggcaggaagtccgggtggttgatgtcgtgcccaccgccgagcaggtggacgtcgctggcgatggtcacgttgtcgccgatccacaggccggcgcgcgcgtcgagcaggcag

SEQ ID NO: 635260 - DNA, 299 bp, Homo sapiens
cccactcaggcttttttcaaagaccaaaaggtccaggtgcaagggaaaaaaaaagggcatggccaaaaggcaacccccccaaaaggcagcttaacggtacttggaggtcagcacggggctcacaaaggcaaggaatttgtccaaaaaggcatgccccgggggggtgaaatcggcaggggggtggctagccaaggtcaccagcaggcaggggctcaggaccttgaagttgacgggatccacccccaccttgtgggcatgcaggtcgctcaaagcaaacaaggcaccgggcaggtcattga

SEQ ID NO: 635261 - DNA, 711 bp, Homo sapiens
gaaggaatgaaaggaaccagggggaaaaaaagggcccaatgctgagatttctgagaatggatttggcaagtctgtccccacagttcaggttcaaaagaggcaatgttgtgagatttattgaaaacgaagatggtgacaccacgattggtcaaagatgtgctttggttatttgcgaccaactgtggtgaacccagattactgggtaaaatcccgaccagtaccaccatttattaaagtgacaaagattttataagggaacccaatataataacccgtggctgtgaaaagccagaagaaaggcttgttttggtctgtttttcttttttagggaaacgctgccttaaatgttaatcttgtaaaaagtatgtatttgggattttcttcggtgttaataggatattatgactccaaatataaatttttttcacaatttggagtttaagatatagctgtagaggtggttttaattcccttagatgtctcataaaatgagactttttataatggtaatgtataataaaatctggaaccagattattttccactttgaaatttttgtatagtttaaaaaggcttccgtattctttgttggtattgtgcccctgcagaactttagtgcagagtttatatttagctaactgttatgttaattaagaaatgcataaatcttctattcttaatatttgtaattctaaataaattgatctatga

SEQ ID NO: 635262 - DNA, 376 bp, Homo sapiens
  misc_feature (1)..(1): n is a, c, g, or t
nctaggggaccgcatcatgcgtagttaggttgtctgggcgagggcagaacccaaggactactgcactcgggaatctaacgcgcactgtggttcttatgtgcacagcacatatggcaataagtgcgccttatgtgaggcgcatagggaaaagtgagtggaaagattagacctaaagcatccctggaaaatgctctgttaaagccaatgtttcttggtgacttgccagcttttgcagccttctttactcacttgtgcttatactttagctggtggattcctttaattcataaagacatacctactctgcctgggtcttgaggagttcaatgtatgtctatttctcttgatacacttgaccataaagtacattctagac

SEQ ID NO: 635263 - DNA, 115 bp, Homo sapiens
tgattggccgactctccgcgcccgtaccgtgagtgccatgcggggccacattgcgagtgctggctctctggcctggaggaacttctcctcgccacgttgttggaactgacacaac

SEQ ID NO: 635264 - DNA, 309 bp, Homo sapiens
taagcttctcaagtgtgggattacaggtgtgagccactacgccagcgaactattttttttcttaataagtttatcgagacggagtcttgctctgtcgcctaggctggagtgcagtggcgtgatcatagctcactgcagccttgaactccggtgggctcacatgattctctgcctcagcctcctgagtagctgggaccacaagtgcccaactaattctttttctttttctttttcttttttttggagacagggtcttgccgtgttgcccgggctggtctcgaactcctggccttaagctgttctcctgcc

SEQ ID NO: 635265 - DNA, 466 bp, Homo sapiens
ttttcatagagtgttaatggttttagctcttacatttgggtctttgtatattttgacttaatttttgtacattatgaggtaggagttaggcttcattcttttgcatatggctattcagtgttcccagcaccgtttattgatgaagactattcttcattgaattgtcttggcacccttgttgcaaatttgctgactgtacatgtgagagtttatttctggcctgaaattctattccattgatctgtataggtctatccttatgccagcaccacactgtcttgattactgtagctttgtagtaatggcacagctctttgatgattggtttctataagtgtgttttttataaagtactttcaatgacaaactaattgttttgggatttttaatcagcaaatccttaacatatatgtaatgactctgtccaggcaaaacttgttcagtttaaaatttgtcttcagtaatt

SEQ ID NO: 635266 - DNA, 328 bp, Homo sapiens
tatgcatggatctatcagacaaattagatgatgatgcagactgccataagacaaatactacataagtcaccttatacttcctctgagatccactaaaaggaggatgatgaagttgagaaatcaccactatcggtgactataatccataagattactaatagaggaatctgttcttctctccaaatctctcctctctctcattaagtctgttccaaatgatccaagtaccattgatgaagatctaggaacttgactatgcctccaagatgaatctgataatgtgtttaaaccatttccaacatttctcccagctgaggtagtacagtta

SEQ ID NO: 635267 - DNA, 878 bp, Homo sapiens
caactgtacaggagagtggcctttctacagcacattttcagtaatcctatatttagtcaaaatggatgagaaatcatgtattaatgctttgtatgggaattttgggtccagtgctaactatttttatccatttaacaaagcaactcctatttggtcaaaacacatttatttacatgcatggcatattggacgcacattaaatttgtgggcatttggtatcatggtacaaacaaaaaacacacacacaaaaaaaaccccaaaaacaccctcgtgtgtctcccctcaaaatgaaggttggtcgctgtggttccacccggggtttccaaccctatattgcgagtgtgttcactactaatacccccacacgtggtgtgttttgttcccccttctacaaattatttgtgttacccctgatgggcatgtgtcacatctgtgttcacccagtgtgggcccatggttttgttcgccccttgttacaaactggccaaagcaatctcgaccggggaacaccactaccttcgtggtgcgcatacctaaagcaccacttcttaatcttactgtaacatgcaccacatcacgatgactgctcttcaaccagtgcgctacacaagctcttacaacttagtcgagtcaatcttgggacacacaactcgtgtgggtctagcaccaatcaattgcaaggaacacactgtatacgccgagatatatcatatatccgggtaactttcaattggaattgcgtccacaatcatggaccagaaggcgccagtgctcaatggtcgagcaacataatatctaggcttaatggaccctctaaacatcagacgacacacacaaaaatgtaccagccgcgcgaccacacaaaagattttacagcg

SEQ ID NO: 635268 - DNA, 208 bp, Homo sapiens
taaattaaacttaaggtctcaaacctccgggcctcaagttgatcagtctgcctctgccccccaaagtgttgaaattatgggcttgacccaccaaacccagccataatttcttagcttgatttccccatttgtgttttgatttcaattggtgccctccccattaaaaaatatgctgaaggcctaaccctcggcgccctccttaacgtga

SEQ ID NO: 635269 - DNA, 167 bp, Homo sapiens
ggcgaggggtgtgcgcgtctttgtgtgaggttggagagctgagacgagaagaggggctactttgactctggaccctgtagtttcctggccgtacctgcttgggaatctgactaccagtaccagagcgcagtgcggcagtggcgccttcttttgtgtataagactgag

SEQ ID NO: 635270 - DNA, 359 bp, Homo sapiens
  misc_feature (116)..(117): n is a, c, g, or t
  misc_feature (140)..(140): n is a, c, g, or t
  misc_feature (156)..(156): n is a, c, g, or t
catgtgcctctgtgtgtcctgcctgggtcagaccaaggtgcagtttcagaaatgagaaagagaaacagcaacctgagacctgggacctgagagcagagccgagagcgcccacaccnntggacagactgctttgactctcnacccagcacgtctgcnacctttaattacagcggggaagttacaccaggaaggaattgttttttctggaagaaatgagtgaacttcaaaaataccctcataggccaggtacagtggctctctcctgcgatcccagcactttgagaggccaagatgggaggattgcttgagcccaggagttggagaccaggttggacaaaagagcaagaccccatttctac

SEQ ID NO: 635271 - DNA, 132 bp, Homo sapiens
ggtggtagttgcagcagtcctgttgctggccagtagatgcctggtctgccagcgctcaccatgggtgccaggatgcttccgcagaggcactgtgctcacggttggacttggttgtcagtgggaaaggagggg

SEQ ID NO: 635272 - DNA, 445 bp, Homo sapiens
  misc_feature (364)..(364): n is a, c, g, or t
  misc_feature (377)..(377): n is a, c, g, or t
cgcgcgcccgcaccggcgcgccatctcgcgccgcgcccacccaaatccccgggccacccctcccccatccacagggcggggtgcgctagcccaggaacgttttcggctccggagccgccccgaactctccagggcccagcggtagtggcccgcccgcccccgcccgccgttgtgtggggtgggccccccgtctcaggcctacagcttcgccgcatccccacccgcactggagccctcacccggcgacgtcactgccgccgccgccgccgcctccgctgcacccgccggccccgccgcaccgccagggaacctggttctgccgtcgtcgctccaagaccgacagggttttctcctcacagctccntgggcgccatctnacattcaaccctcacagccaataggagccgattgctcctctcgcgataattacggcgtcggtcccgca

SEQ ID NO: 635273 - DNA, 119 bp, Homo sapiens
ccaacgctgaggaccagacaacctacggatgttatggacgaagttgttgcgcaacaacttcgtccatacagatttgtctggatcctcggcgtgtgcagtatggtggttcggcgtgtgca

SEQ ID NO: 635274 - DNA, 145 bp, Homo sapiens
agtgtcctcagaggcgtgctaggtcccctcctcagtgacatcacagcctggactaattgttcctcttggggatgagggtggccatgcaggcaggtcccactagcaacttctttctgttgcgcagcaacctcaggtcacggagcag

SEQ ID NO: 635275 - DNA, 296 bp, Homo sapiens
gagaccgggcgttcaatccagtgcccggacctcggtctcgacgcgcctgttaggttccaggcactgaatcagttcggtgcgcggcgcttgcatgttgcagcgcaccaggggtttgttgctaccttcgcccacggcatcgaccagttccgccggcaggcccttgcccaccaggtaggtcttgatggtctgcgcacgttgccgcgaaacctgcaggttgctctggcggtcgccaatctggtcggcatggcggtgatcacgatcttgccgacgttgggggtgttaagcaagttggttgc

SEQ ID NO: 635276 - DNA, 215 bp, Homo sapiens
acgcttccccacagtgagcatatttattaaatagaaacaagttgttgattccgataattacaagacttgtacaaaaattcacagcgcctgtaaggagccttatggttgtgaactaggtgacacgtgtacctctccggacagaggaaggaagtctcaccccggcttccagcagcagcaagcctgtgtctggcataccctgttccgatgctcccacc

SEQ ID NO: 635277 - DNA, 290 bp, Homo sapiens
agttcacggagactctcaagttgcagtgcctgttattccagctacttgagaggcggagacaggagaattgcttgaacctgggaagcagagattgcagtgagctgagattgagccactgcactccagcctggatgacagagcaagactctgtctcaaaaaaaaaaaaaaaaaaaaaaaaaaaaaatttgtgtggcccccccccgtgcccccgttttcctggcagggttttggggtaaaaggggttaaaaaaaaaaatttttggctcttagggaactccaggggggaaaaag

SEQ ID NO: 635278 - DNA, 208 bp, Homo sapiens
ccccccgggtccgcccacgcgtccgtttttaaacatcacagtgaactattgccccttttgctaatgcctctatttacttgctttggcataaagaatgagccaatgaccctctgtgtcctgtggaaaaatgtataaatgttttttttttttgcttttaaatgtaatgctaattaatgttaaatcccaaataaacagaattttaaatata

SEQ ID NO: 635279 - DNA, 128 bp, Homo sapiens
gattccccacagcccatacagtccacgccatcacacatccaatacagtccacacagtcgatacacatcatcatcatcacatctatatcagatccacaccgtcacacgtccgattcagtccgttcgcat

SEQ ID NO: 635280 - DNA, 232 bp, Homo sapiens
cttttcttgcaaaaaaaaaaaaggggactgtaaaaattgggccattttgaaaatgacaagtagaccctagcaaaagtcctttaaaagctgatcccttttgtaacctcaagcaccttgcttactttgtcaatcattttcctcggggggggggttttcaacgggtttttgtttggttttccccaaaaaggctttttgccctgggcaaaaaaaaaaaaatgattttgactttcca

SEQ ID NO: 635281 - DNA, 1021 bp, Homo sapiens
ctgcggctgtcgcacaactgcgctcagcgtgctggcccccgaggcccttgcttggcctgcccgccctgagactggctcagccatacaccacaactgatgctccagtgctctgccctgggcctgtcttgtacccaggccctgtggcctggccctgtctgtgatgctaggtgccacaacacctgctacacctactgactggtgcgatggaggacgtggcttgtgctgctgacctgtgccgtgctgggagcttgctgctggacgtgcgtgtggcacctgcagggcccatggtatcccaggggacctatcgccacacattgtaccggcgccttgcaacaacccctcggaacctcccgccgtgggaaacccaggctagagcacctcttgccccccggttttgcattggcccatgtggcccagcctgcggccggggcttgcggcgatgccagggggcaatcacgaatcgtgggttgcaggcttgccaaggccagcggtacccccttaccatcgaagcttgggccttgggcatgcccggagtacgcgagcagattgcgccctacaggacccggtcgccgatgcacccgcgggggggcccgccagagacgcccatttgcgcgagatacgaaagccccttcataggacagcgaccccatgcgctgcccgcttggggcaacacttgacagcctgacacattgggggttacagtcggtgagaaagagggaaggcagctaagaagaggcagtgaatgcaaagacgggggccagtataggaccagtggagaccctggaggacacgcatcacggcgtgccggcagcatacagaacaacaggcgccaacagtagcaacgacccggaggcaagacacaagccataagcaccaatcagcaaaaccagaaaaacaaccagaaaccgaagagacacccgaggcagaaagaaaagagcggagacagaaggacacgaaagcaagagaaaagagaaggaacggcacacaggcagggcaaacagccagagcgggaacaacgcag

SEQ ID NO: 635282 - DNA, 270 bp, Homo sapiens
cttacgccactctttcataaggggggaatgaggtgctggctggggcaaaaatatcccatgcctatgtcaccattttcagttttcagcagctttcatccactctcttttccccatctgtagcctctcccagtgttgatctcacagtccactctgcaagcagcttctccctctccccatcactgcttcctcgcagtaggtgttggagtgcccccaccctcatgatgaagggcaaagctaatctttttttttttttttttaaaatggagtctc

SEQ ID NO: 635283 - DNA, 901 bp, Homo sapiens
gcaggtcggcggtcccgagggatctgtctctggcttcaacagatgttgggacggaacagatccggggactctcttccagcctccgacgcgcccgtccgatttccatcggtccgtcattgcgaaactgccggagaacatcttcgtcggaccatctccgtgcttcttgggaccttgctgatgcaccggtgtgaggtggttagcgtccttcttgccaatcaagcatgagctcccagattccgtcagaaattattccaaccggacgttggaggcagcctgtcaacgagccttggtggaagttggtacctggcaggcgctcctagatgctagactcgtctactggggttactagttatgagaagacgggactgactgtggctcgtggaaggccgtgaggacaatttgttccgcagaatttgggcgaggaagaagcgcgaggggctacgaagggtattggatgaaaggatggcgaagaacagtggttggcagggctgcgcttctctttccgaggagattcaagaaggccgagttggaagatgaagttggggtaaaaacccagagagccgattgaagcagcttggacaatgggccattgggacgcaaaaaacagctgtgactcgagggccccctttcgtaggaatccttacagtgccacatgggggttacatggcacaggcacatgtgacgacacccaattggtcattgggtgcacacttccactggtgaggaagttccagtttctcgtcagaacatgagcgcgaagttgaaagagctttattaaacgtaaggcatgtggattgacacaggctggagcgaaacgctcaataacagtggtgggtaatgggccacagggaagagcatggagactaggtgcaggaagctcattcttctgacgaaaaagggg

SEQ ID NO: 635284 - DNA, 1045 bp, Homo sapiens
  misc_feature (43)..(43): n is a, c, g, or t
  misc_feature (73)..(73): n is a, c, g, or t
  misc_feature (538)..(538): n is a, c, g, or t
  misc_feature (571)..(571): n is a, c, g, or t
  misc_feature (840)..(840): n is a, c, g, or t
  misc_feature (1037)..(1037): n is a, c, g, or t
gattgagaacaggttccagatgaagctacttgtatgggcttcngcgcaccaaagaaaattccatcattttgcnacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgcccaaagttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaaatttggatttttttatatataactagctgctattcaaatgtgagtctaccatttttaatttatggttcaactgtttgtgagactgaantcttgcaatgcataagatataaaagcaaatatnactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatatcactcccattttattgtgttagattgcagtacaatgaatgaataaggggatttatttaaaagatcttnactttcttgactgatttaaaaagctaatcaatttattaaagccagaaatgttctcctctgggaaagcaatttctatctatttatctaccaatccccactcccatgtatatgtttgtgtttacatagagatagatggttttaagggttttcctattgttaaattatttcctaagacattgtgggttggagaccactanacttataa

SEQ ID NO: 635285 - DNA, 883 bp, Homo sapiens
  misc_feature (1)..(1): n is a, c, g, or t
  misc_feature (883)..(883): n is a, c, g, or t
naaggctgttactggtccgggattttacggatagggtcaccttcccacggtgcttgcaccattgagcgcgtggcgctgccctggagcctggccggctgggacctggtgcccaatcctgggtggacccaggtgcctgtgtgcccagtgtgccggtgccgaggtcccggtggtgctggtgccttgctgggcccgtccctggggcggtgccatggtgtggctggtccccgcggattcctcccctctctgcgtggcccagtcgccctttggccgggctgagctaatcgtcggctcaatgacgacgatggccctgacccttcccgtccagtgacctacagagacaaccgaatggagagcccaaggcggcttctttgctgtctgccgaccccactgaagcaagagctccccggctccactgaaacaccagctcatttaagctttccccaactgaccggccctccgggacgatacctaacaactgacctggcgccctgcatctggaataggctggcgagatacttagtatccgagggctcgggacttggcgccatcgaggtcatggggacccaggatccagggaacatgggaaccggcgtcccagcctcggagcaaataagctgtgccaaagaggatccacaaggtttattgccctgaagagactggcggcaccaaggatgtgcaggttacagacttgtaagagtcccgaagacagccgaccccaagaagagacggactgctgcaatccggaggactctgggcagctgattggtaacctattaggggtaaagctattgggctaccaggtgcctccatttgacttggcgcattatgtctggctcatgagtttaaaggaaaagaggaaaccctttaatgctacaacgttcan

SEQ ID NO: 635286 - DNA, 1045 bp, Homo sapiens
  misc_feature (43)..(43): n is a, c, g, or t
  misc_feature (73)..(73): n is a, c, g, or t
  misc_feature (538)..(538): n is a, c, g, or t
  misc_feature (571)..(571): n is a, c, g, or t
  misc_feature (670)..(671): n is a, c, g, or t
  misc_feature (673)..(675): n is a, c, g, or t
  misc_feature (677)..(677): n is a, c, g, or t
  misc_feature (680)..(680): n is a, c, g, or t
  misc_feature (686)..(687): n is a, c, g, or t
  misc_feature (690)..(691): n is a, c, g, or t
  misc_feature (693)..(693): n is a, c, g, or t
  misc_feature (709)..(709): n is a, c, g, or t
  misc_feature (711)..(711): n is a, c, g, or t
  misc_feature (722)..(722): n is a, c, g, or t
  misc_feature (737)..(737): n is a, c, g, or t
  misc_feature (743)..(743): n is a, c, g, or t
  misc_feature (750)..(750): n is a, c, g, or t
  misc_feature (754)..(754): n is a, c, g, or t
  misc_feature (759)..(760): n is a, c, g, or t
  misc_feature (777)..(779): n is a, c, g, or t
  misc_feature (784)..(784): n is a, c, g, or t
  misc_feature (840)..(840): n is a, c, g, or t
  misc_feature (1037)..(1037): n is a, c, g, or t
gattgagaacaggttccagatgaagctacttgtatgggcttcngcgcaccaaagaaaattccatcattttgcnacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgcccaaagttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaaatttggatttttttatatataactagctgctattcaaatgtgagtctaccatttttaatttatggttcaactgtttgtgagactgaantcttgcaatgcataagatataaaagcaaatatnactcactcatttcttggggtcgtattcctgatttcagaagaggatcataactgaaacaacataagacaatataatcatgtgcttttaacatatttgacnncnnnanccncccccnnccnncncccccctccccccccncncccccaccccncccccccccccacancccccnccccccnaccnccacnncgggggggggggggcgnnnggggnattgtgttagattgcagtacaatgaatgaataaggggatttatttaaaagatcttnactttcttgactgatttaaaaagctaatcaatttattaaagccagaaatgttctcctctgggaaagcaatttctatctatttatctaccaatccccactcccatgtatatgtttgtgtttacatagagatagatggttttaagggttttcctattgttaaattatttcctaagacattgtgggttggagaccactanacttataa

SEQ ID NO: 635287 - DNA, 179 bp, Homo sapiens
gagatttgactgttggggaactgagaacagcgaggagtctttctagaacttttgaacactaaaaggataagccggcattatgcaaaccggagtttcttcaatgacccctcgagaactttgggaccagtttcctatgggggactcagtttcagaggactgagacaaaagctcttctgtcg

SEQ ID NO: 635288 - DNA, 346 bp, Homo sapiens
cgagctatcagactataggcctgaggcttttgggtcctgtggacagggctgtcatgaccccccgggtggtgcatgccagaccgcctcagacgcagagggtccctctgcaagcgccctgtgagtgggccattccgaacaatggacacaagcccaaagagccttgtcacaattgtggaacccacattggcctgagataccgcttcgagggaccccctccggagtgggtgtttccgggggcacttggcgaccagacccttgtgtgcccaaggttggaggtctcccctggggcactccattctggcccgggctggctgtgtgacctccgtgcctagacgtgggtcttctt

SEQ ID NO: 635289 - DNA, 973 bp, Homo sapiens
  misc_feature (43)..(43): n is a, c, g, or t
  misc_feature (73)..(73): n is a, c, g, or t
  misc_feature (538)..(538): n is a, c, g, or t
  misc_feature (571)..(571): n is a, c, g, or t
  misc_feature (840)..(840): n is a, c, g, or t
  misc_feature (906)..(906): n is a, c, g, or t
  misc_feature (933)..(933): n is a, c, g, or t
  misc_feature (957)..(957): n is a, c, g, or t
gattgagaacaggttccagatgaagctacttgtatgggcttcngcgcaccaaagaaaattccatcattttgcnacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgcccaaagttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaaatttggatttttttatatataactagctgctattcaaatgtgagtctaccatttttaatttatggttcaactgtttgtgagactgaantcttgcaatgcataagatataaaagcaaatatnactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatatcactcccattttattgtgttagattgcagtacaatgaatgaataaggggatttatttaaaagatcttnactttcttgactgatttaaaaagctaatcaatttattaaagccagaaatgttctcctctggggggnaggccatttcctatcccttttatcctnccccctccccccacttcactgggntttgggttgggggttt

SEQ ID NO: 635290 - DNA, 103 bp, Homo sapiens
  misc_feature (2)..(2): n is a, c, g, or t
  misc_feature (15)..(15): n is a, c, g, or t
  misc_feature (23)..(23): n is a, c, g, or t
  misc_feature (26)..(26): n is a, c, g, or t
  misc_feature (44)..(44): n is a, c, g, or t
  misc_feature (47)..(47): n is a, c, g, or t
  misc_feature (59)..(59): n is a, c, g, or t
  misc_feature (73)..(73): n is a, c, g, or t
  misc_feature (77)..(77): n is a, c, g, or t
  misc_feature (80)..(80): n is a, c, g, or t
  misc_feature (84)..(84): n is a, c, g, or t
  misc_feature (92)..(92): n is a, c, g, or t
  misc_feature (96)..(96): n is a, c, g, or t
  misc_feature (98)..(98): n is a, c, g, or t
gnggaacagctcttnggacactnggnaaaaaccttgtagagagngtnaaaaatttaacncccatagtaggccnaaangcngccnccaattangaangngttca

SEQ ID NO: 635291 - DNA, 455 bp, Homo sapiens
gaccatgattagacctcagcatgtcgtatttcactctggaatgctgtttaacacgtatgaagtcatgctatctccgtcaatactctattcacgagagaataacatatatccacctaacagtgatagtccgcctatcttctatcgaatgaacatagacatcccccgtgaagcttttagatcacagggaagtgccatgaagccacaacctaaactaacttagtcaaacacattagtctagtgtccagactcaaatagatacacattcaaccaataaactgagaaagaagcatttcatgttctctttcattttgctataaagcattttttcctttgactaaatgcaaagtgagacattgtattttatctccttttaattgacctcagaagatgcactatctaattcatgagaaatacgaaatttcaggtgttaatcttcttccttacttttggggtct

SEQ ID NO: 635292 - DNA, 960 bp, Homo sapiens
ggtagactgagcgccagggaatctgactaccagaagttggagcctgacagaggcccataaactggagacctgatcgtccagaaccagtctcagtgaacagagattgggtacaatcgtggaggcaacatgagttggatggctgaggtcaggatgaagaaagacacagggactatctcgcgaagaacctgtgggaagcaaaagatagagtgcgtccaatgttcctagggggtagctcctgataggagactgcagtagtcgtgtccgttagaccctgaagaatgggagtgcccatggcaaacagtttccggcaggagtgcgagagcaagtcatgagcagatggcctgttggacacgatggcgacgaggggcatgataggccaatcagacacgggtgcgaaaattggtagcccctgaagcttccgggaaaagtgctcggaagacatggatcagcccagggaacatagaaggtctcaaaactacaggaaagcagaacccgccagagtctagcacgagagagcgtgctggacatctcccggggatggaaggctgagagcaaggggacggcctgaagaagcggacggaaggcgggaaggtccgggcaaagtccgcgtagaggaagcatcgagggaaacttgtgaccctgaggaaggtgtcagaaccaaaggtggacctaggaaagagcaacgtgggtccaagtgaagagccgagacgccaggaacagggcattagggaaagagaaaggtagaacaacaaggggtcgacgagaaacaattcaatccctcgtgccaaatgaagtgtaagtgcgagtgagaccaagtacaaacatgcatgaggacaagaccaaaggtaagaaattggagaaaaggtcatggagcatttcatggtgaaaggcagttagaactgggaaaagcaactgggagaacaaaaggaggctaaagtggaacgaagctgaagaggatta

SEQ ID NO: 635293 - DNA, 1744 bp, Homo sapiens
  misc_feature (1074)..(1074): n is a, c, g, or t
caaacgctgttagtgtgtgggggagtccctgcctcgtgggtgcctcaacgtcgcgctgtggttatctcacttcgtgaggtattctgctggggcgtgttgtcttgcagggtgtgttactttcgtcttgtgtagttggttaaagtcactttggtgtgccgggcatagatcccagccccgctggttgttttttgtggtcgttgtgttgcgtgagggttttctcccctcacgtagtgtgttgtgtgttgcgtcccctctcgggcgcggtcatcttggtgttgtgtgtgtccgccaaatagttgctcgcccgcgcggtggttggattgtgcttcgtccgccgcgtgggttttgttgcatccaggcgggtgctggcggcgttgtgtgtttatttagggggtgcgacctgccgtgtggtggtgttattgtcgctgccctggtgtgtgttgtattatcctcctccccggggcggttggtgttcgtgtggggtggtggttgttctctccccgcgtgcttgtgtgctgcttctgtatgagtgatctgttgctgtgtggtgcctgctctgccgtggtgggggtcttatgtcgcgccggcgtccctcctccgtcggcgggtgtgtgatccgcacgcccgacaacactgaggggtgggctggttcttttgtgttgccccccttttgttcatagatttcatcttcacagtactactacgatactagtatcatataaaacctcgtcaccccctggtgtggagaccttctgtgtgtgtgtccccaacaggtggagattgtcgtaaacatgtaacaacaggcattttttagcagaggagcgcagaatttttgaagagacgcggagacatattgttcttatgaggaggtccgtcgcggagagcgacctccaccaacagcgggtggtttccccgatcagattcctcggttttcgtaccaacactgtgtggtgggtgtggggcctctcgccgcgaggccgcggtgagccacggccgctgtccccctcgtctgtctctcgtctctcccaacatgccacagcgttgcgcggggcccctctgtgtgtgtgttatatngcccgcatttatatgcgcggtgtcctctccccgttgtgccccctcctcacagctggccctcacttggcccaccgagagggagagcgtgttgtggtacactctctcttatgtgtctctcgtcactggggtgtggctcccactctattcagagagtgtcacagaactctcttttgcgcccacatgggtctgtgtctgtcactgtcctctcctctgtgcgcgcccactattcacactctccacaggctccacaagccacgagatttgccacagcggtgtattcctcgcacctgtaccacacaccctctttctatcaccactctctcgccacagtgtcccacactcttttgaacaccacacctctgagttgagtttctgagaaactcgcgcccacactttctctcacccagcgcggagtggcttgaggaaaccctaccactttggaccacaatagagagagggctgctgcctgtcggcctatcgggccaccctcctttttccttggctccctgccttttctttttatagaactaatagtcacaccctaccactttagtcgggaagagggcaccggggttgacctgagtttctgtctcctgtctttctggctgatgtcacccctgaaattaagcctgtcttgccgtggcctaaaacaaaaattaaaaaattaaac

SEQ ID NO: 635294 - DNA, 274 bp, Homo sapiens
gtagttagatccctctacacgcaagtgcactgtgaagacatgtagagcacatagtaactatgaatagtgtatatatacaactctatgtatactgttctaacagtaagcagtttaaattatgttggttcatattcatctaatatagcttgtatgtactcttattaatataatctctattgtattgatttcttctgtattaccttttggattttgtaaaacagaaatttaagaccacaagttagaagaaaggtcacatatttcaaacacaactaga

SEQ ID NO: 635295 - DNA, 98 bp, Homo sapiens
gtgcggccaaacttaaaaaccagccctccaaaaaagatgaaggcattctggaaaaatacagcaattccagggtatactatgtctttttctttagcaac

SEQ ID NO: 635296 - DNA, 299 bp, Homo sapiens
gctgaacccatacgcggatcacattctgtatgttttctcatggtcgacaactgattcaaatgactttaagcttatcccaccatttaaagagagagaggcgctgcaataatcataaaccatggcgttatcttaatttcaccactggctgcttcgaacagaagttctttcagtgcttcctttgacacataacaatagcttgtaatctcattgggatctggattcaaagttacattcttcctcaccaacaaaatgtaatcaatttcatgtgcaccccagataccatcagactgagctttgta

SEQ ID NO: 635297 - DNA, 187 bp, Homo sapiens
tcatcatataccaaacctccctcactaaacgtaagccttctcctcactctctcaatcttatacatcatagccggcgggtgatggtggattaagccagaacccagtctacgcataatcttagcagactcctcaattacccacataggatgaataatagcagttctaccgcgaattatgataccgcgaa

SEQ ID NO: 635298 - DNA, 279 bp, Homo sapiens
tgaggacttacaaaagtgcactcttctatatctacaagttcctgttctagggaagacaaaaaagaaagaaaatacacgtgtccttagtacattagaaggtccaagtactgtagagaaaaataaagtaggttggactcggtggctcatgcctgtaatcccagcactttgggaggccgaggtgggtggatcacgaggtcagtagattgagaccatcctggctaacatcgtgaaaccccatctctaccaaaaattaggtagatatagaagagtgcacttttg

SEQ ID NO: 635299 - DNA, 643 bp, Homo sapiens
  misc_feature (44)..(44): n is a, c, g, or t
  misc_feature (60)..(60): n is a, c, g, or t
gtgcccggcacaccctggcgacagagtgagattcatctccaaanaaaaaagaaaaaaaangaaagtcttggttggtgcaagtttcctaaaaaccggggggtgattttgaagcccttttgaacgggtacccccccccttttggaggttttaccccccgcgggggggggggattaaaacaaaaaataagagggggttgttttttctcctctaacacctttttattttggaaaaaaggatgtttttgtgtaataatatatccccccctccaccaaaaacccccgggggggggtggtttattatcaaaaaaaagagagtttttttttataaacaccaaaaagaaggggttttttttttttttttttttttaagggagagaaatatattatctggcggccccgggggggggggggggaaacccctccgttctcttttctttttttattataaataaaaagaaaggggtttttttttttttttaacaaaacaaaaaaacacaaccacggggggggggtttttttccctccgggggcgctcgccccccctcgccccaaaaaaaaaatatatttttttgttgtgtttaaaaaaccccccccttcttttttttttttttttttggcgcgcgcgggacccatttttttttttt

SEQ ID NO: 635300 - DNA, 386 bp, Homo sapiens
aaacgggtaaaaaagagaaggccttttaaaataaggcattggggtttttcccagagcaactctgttttccccttgaaattacctagagattttcagtaaacatttgccccggatacattttcacagaggagtttgcccgcattctgaggacctcattggctcccactgttcattgctatgcccatctcacacccacttcaactgtcaaacagaagaacaattcttattaacagtgatttgctttgcagttttagtttatttctaaattgcagacatggttgatgagtgaagttgttttagtgactgtttattggaacagagcagagaatagagtcaggaattcttgaggctgccatgtgtatggtgaaaaatagaaataaaaacca

SEQ ID NO: 635301 - DNA, 806 bp, Homo sapiens
gggcgctcgcattccccgcgcggagccgaagcagccgcaacgagccgggagctgagccgtgctgcgctgcgtgtgcgaagagccggtgcggacggccacgagccctccccgcgctgccagtgggactcggagccagagatccctcggcatttgccccgtgggcatggagtgtgctagacaagactcttaacattgtgtccgtcgacgtccccgacacggacctgactcctcgggctaggaaacgcctctagaactcgatcacctgctgccgcgcttccacataatagccccgggaagttccagaagacggtgagggatcgagtgctgcgctccatgaggcaggagggtccccctagtactccgtcaggctcatgcccaagtgtcccccatctgtgacagcccccagccccgatgaggaccctcaggccggggcgaagagcccaggaacaagcccggaccgaaattttgccgctgccttagagcgttagacaggatgtggctgggccgccgggccctgtgcgctctggtccttctgctcgcctgcgcctcgctggggctccttgtacgcgagcacccgggactgcgcccggcctccggctacctcttgcgcccgtgggcgcccccgaaaagcccccgcaggcccgagctgccagatctttgctcctgagccccgctacgcacacactccggtcaggatcaaggagcaagtagtggggctgctggcttggaacaactgcagttgtgagtccagtggggggggcctccccttcccttccagaaacaagtcggagctattgactcaccaa

SEQ ID NO: 635302 - DNA, 158 bp, Homo sapiens
atcctcctcctccataccaagcgtttctagcactgagaccaccagccctggtgacagggtggagacccctgtgtgggagagagccccaacccctgtctcagcaagctctgaggtctcccctgatgagccaatgatggactcagagaaccccatgcaga

SEQ ID NO: 635303 - DNA, 748 bp, Homo sapiens
gtcctgcgtgcggaactacatgaccacttgcacgaaaagcctttgatggaaaaaaaacaatgaaagagaaaagtgaaacgagagtaacactcttcactgatgctaacttcctatttggcatgaacccaatcaataaacactttggaacacaacttaaaaaacaaaaaacacgaactccgtcggagctcaaaggaaaggagcgtctgcggcacgcattacactttacaggagggaataaaccatgatggctcaggtaactgactacaatgaactaagaacacaagactggggcggagcgggcaaaccatcactcaacaggcgccaaaccctgctatcccctccacaccccgtatccccccacgactcacaacgcacacctcaaggccactttcaggccgcacacccagagccaggccgcgaccgcccagccgcgccataccagaggggggcgtgcacaagtatgtgttcaagaacaccgtgccgtagccgggggacacgagaactctttgggagacacagaacagtgacacccgcccccttccccgggggttcccccggcgcacacccccacagcaaggccacccccgccccccccatggcacccggggcgcagccacccaggcagggcaacagccgacatacccacacggccgcccccacgggggtgggaggagagaaaggagagtgtgacaataagaagggccacggtgggggggggcagcccccgcacatcaacgcgccacatcat

SEQ ID NO: 635304 - DNA, 614 bp, Homo sapiens
atatataatgtgtgggcctggttcttgagcctgcagcacctcccctaggcctacatcccaacatgcctgcaactctcctgtggcaatgggtgcctgccccttccctgggatcctgcctgaaattttgacccaggagctacccatgaaaagtcaggcaggagcttttgccccctgcttctaaactttgccagctactgggcctccacatttgctccccttgccaccaccctccagtctatgttaagggatgtatctgtactttttcatagcctacctctaaattgataattttttttttttttttttttatggaagaaacaggtttcaccatgttgcgctggctggtcttaaacttccaaacccaagcatccttctgccttggcctcccaaagtattgggattacaggcatgaacctttgcacccaactgacttattcctttattattaattaattttgaaacggagtttcactcttgtttcccaagctggagtgcaatggcgcaatctacggttaacacaaattacgcctcttggcttcaaaaaaatatttctgcctcgggccaagcacgggggcttaccccccttaatcccaacatgaaacacccggcccggg

SEQ ID NO: 635305 - DNA, 131 bp, Homo sapiens
acacggagatagattgatcgagagacaattcactccatccctatggcagaggaatgggttagccctactgtagaatgtcgattgtttatacaactgttttatatcttaagagttgccttattaaagttata

SEQ ID NO: 635306 - DNA, 541 bp, Homo sapiens
ctactcagcattagcactaatttatggtaacagatcatatcttggaaaggtctaacttatggaaccccttcatttgaaatagcgaattaaagcatgtatttacatatttatatacaaaaaacttcaaaaacaaattaatccaaatctaggtccaagagtttccactttataagtggtatggtactatgctaaatatatcctcttccaaaagtctcttaggacttggtaagttccaaatattcattcacaaatggttcccctttaagcttaatgaaccatatacttcatttctgagtaaattagaggaaatattacagaacacgctttgtacaatacagcaccactactgagaagggctcgaggttttgtaatccaaggttctgacttaaagcaaaaatacacggcatagatggcaacagcaaagaagtgtccaattaaaactagagggttaggagacaatacagaaagcagcccaacaggacccgcaacacattcgccaccaagtttgaaataaagaaaacaggcttttcttagttgatgc

SEQ ID NO: 635307 - DNA, 468 bp, Homo sapiens
  misc_feature (289)..(289): n is a, c, g, or t
  misc_feature (321)..(322): n is a, c, g, or t
  misc_feature (377)..(377): n is a, c, g, or t
  misc_feature (392)..(392): n is a, c, g, or t
  misc_feature (410)..(410): n is a, c, g, or t
  misc_feature (438)..(438): n is a, c, g, or t
tcccattgaaagcatctattgattgtacttaattcatgcatctagagcaatggagatattcttctcttatttacatgagagctcttcaggtttcttcctcaatctcatcttctccagaacaaatagcctctcttttcagtggctgcctcgtcaggttccagatccctcactgtcctggccttcagttttggaggctgaatatgtgaagtttctatgtttggttcatgaattctgcatgggcacctagtatatgtaggatagtaataaaaatgccttaagttcccagaanggctctgtggttttaatgggtgctttccaatnnttcccaacccgggggtagggggagatattttcccatttgactgtggagggaaccngaggagccttttctnaggaacaaacagacatcnttttaatttttggagtttggggaagggnttgcatggcctgcccgacctcacatcattt

SEQ ID NO: 635308 - DNA, 616 bp, Homo sapiens
ccctgctgttcacgcccgggtttgtggtcgcccgctctcccggctctattcggcctcggccgggcaccccggcctctgctttttctcgaaaaacaacctcccaagggattcaaaataattggggcgaggcaccctaaacaagtccttaacggaagctcttagaggacccaattttcccccgtgtcaatattcgagattcattctcatcaaattggtgaggttggacccccggactgtggacccggacatactctttatcaggacccaactccggggcaatattttcacaactgctggggaatattttgccatattgaaacaaaaggctctccacctatgataaaaaaaaacgggcctccctatacaatctcacacaccaacctcggtcagataacaattaatctttttgattatatcgtcctcacataaaaaatactttggaatctataagcccctgcggaaaatatttttcatacccgacatggcccctcaaaaaagttagtaacgctgcatggtagatgcgctgtaaaatattggttcctcactaaaaaacagttctgatcttcatttttctattggccaattccccaaaaaaattattaaaaagccaaaaaca

SEQ ID NO: 635309 - DNA, 427 bp, Homo sapiens
acattagtatgcagtaatttggcatatacagctgaagcacatgatgtctgcgtgcttaacagaataagcattcactcagaccccttctgcaaagctatagaaggactaaatgcaagaaacacatgctcagccctaatcccttctcatttcctcctggcacctgtttctgcccccacaggcaccaaacactctaacagctggctgaaaccgagagagaaccagacagataatacactaccacttcagaccaagctctcaccaaaatggtggctgggaaataatggagacagaaccaccaagattttaagagatcaataaactgggtgtcggaagatctcccacattctcctgtcccagtaaaccaggtctccaggtagacaagagtcacacaacctatccttttcactcctcctcctcacctcccccg

SEQ ID NO: 635310 - DNA, 849 bp, Homo sapiens
gacctaagtggccacctgaaatgacaaccctgtgtatcccctgagatttaacaagtgaagatctctgctagaagatgttagacactccgagaaatatgaacagcgtacatggactgagatcacatttcacatattattgcgatgcctttatctacagtccacccatgtttgtcagcaaagaggatgtttatagtgaatcaaagaaattgaaatgtgctctgaatggaatgaaaatgatgaacacagaaggaaggacggaagaatgtgcaagataggccgagtgaagctgaagacatgaatgagtaatcaggaagaagtgctatggatcttaatgactagacaatggatgtgattgtgcagagtgttgaaaaggagacctatgataacatgataatcagaagctaatggtgtcagaagttttacaggttactaacactgatgatgagatgatgcagaaaatcataatgaactttgcactgtgaataatgttgacattatgtagcgaactgatatctgaatatgcaggggagacatgcgattctgagaagtgcttggtcgaattagcccttggtcgcgtggagccaaatgacctgtccatgggtatcgcattcggaacgttgaactagctcctgaatccagaagacctgggagtttggagtctgaacaccattcaggaagggcaacaagggccgaaaacaactgggcaacatgttgagattatggcgtcaaacaccgggttgcagggggagcaccatgggcacgttaataggcagaacatttacacagtcgcatctgctcttttttgcttgttgtagagtgcggtgacacattacctcaatagataagagc

SEQ ID NO: 635311 - DNA, 326 bp, Homo sapiens
ccacggcgcgccgaccaatgctacagaatgcctgctactgcggcacaaccgctttcggaggcttttattgcaaagtgtgttgttcgatgaactctgtcggtaccacaccttcacggctgaccagccgattcagctccgagcgcggcaatcgagcggccagcaagctgacaccttcttcgtcgtattcttctttctgtacggcgcccagttcgaaaaactgtgcacgcagtcgagcaaaacgttgcggcaagcgcaaggtgccgacaaacaaatcgctgcccagcagttcggcaatcgcttgttcaagcaactccagacgtcgacgc

SEQ ID NO: 635312 - DNA, 134 bp, Homo sapiens
agatctcatactgatatctcaaaagatcagatgatgatagagataaattacacatgccaccaggtcgcaaggatagcattctatctgtcatcatcacaatcacttataaggaagtttgtgatttcattgatccc

SEQ ID NO: 635313 - DNA, 117 bp, Homo sapiens
ctacaggatcccccgcgccgccccgcttctcagcaggacctactgaaagagctgcagaaacagctagaggataaacacagtacgcatagtactaattgtttcatagagactcgcaaa

SEQ ID NO: 635314 - DNA, 319 bp, Homo sapiens
taagatatttatatgttatcttcagatgattcttcctgttcttgacaattgtttttattattgagtctgtccagataagttatttataatgggcattactgaatttttaaaatgccgattacacccaaatattgtgcacatttaatgttctggagatagatggcctatctgatgatgatgctcacttaagggacatgtatgtggccttgcctagccctttggtgataagtacttcctctaggaaatgtacgataggtagaattgtggttccctaaagacaagtacataaaggtgaccctgatgaaaccttgaagttctg

SEQ ID NO: 635315 - DNA, 482 bp, Homo sapiens
tgcaaatattaagatatgccacatttcgcagtcctgttttggcagtgttcccatttttaaattacacacaaagtcttaaataaaaaaatgtggcccagcctcttgcagtttcttgggagccccggggtctccacgccgccctccacacacacacagccattcaaacgcacactcgtgcacacaccacgcgcgcgcacacacacagttactcacggtcggtccaacaccctcctcgcagcggggtaattacggctctggccggacggtgattggccagcccattcctcatcggggccccacagccaatgggtggccgctcagcccaggccccgcccccacggagcgggtggcgcgggacgggggaactgatcacgcgggatcggacccggcgcgaccccccgcctgcgcccggggccgcccgccctcggctgcgccgctgcccgcacaatcaggtctgggcagcgtctcccggcagcggccgc

SEQ ID NO: 635316 - DNA, 808 bp, Homo sapiens
agcggaagtcccgcctgccgtgtagtcgccgccgtcgctgccgttgccgctgccgccgtcgttgttgttgtgctcggtgcgctgagctccgcggctccgtgagccggttccgtccccttcccgccgccgccactgaagtgtcatgttcaaggaggaccactcgctgtgaacatcagcatgcagtgcgagtccagcgaacgattcgatgcgaaatatcccgacagggttccggtgatcgtggaaattaggtctcaggctctcatcattgtcgacattgacaaacggagtacttggtcccatctgtatatcgacctgtgcgtcgtccagttcatgtggcatcgatcaggcaatagaggatccagatttccttctgaaaaggcgatcttcctgtttgtggatatagacagtcccgatcaatgatccaggcctaaacgtagtgcggacaggcgttatcagaggaaggacaagaacgcatgaacgactggactctctgtatatgtggcactacagcgtgaagagtaacacgtttcggcattctgagggccagttgctgggtctaggtgcaccgtaactgcttgtgtatcttgctagatagccgaggcatttctcagttattgataccagaacctcttccacatagacctattcagtgcattcgtaactggatttatttcttaatatattggaaggttgcgtgtccgttcagactagtaaattattcatacagagtttccttctgaagtttcccttgagtgcattgtcctcatgcctgtagttctccaggaaacttgtccttctgggaaatcct

SEQ ID NO: 635317 - DNA, 115 bp, Homo sapiens
attctcgggagatcatccaggcatgcatgtgtcaacggttcgctcctttttattgctgcgtggtattccgtggtgtatgcattggcccccatgaaggacacctggcgatgtttcc

SEQ ID NO: 635318 - DNA, 248 bp, Homo sapiens
tcgccgtaatcagatgtatcgataggttcagataccataggtggcccattgattaagatgcgtaagggagggatcagtagacctcgatctgttatgtaacggatgcgataaggatgggagggcagatgaggactcgagatgactggcgggcagagatagtacagaccggttatctattatcctgagacgtctgagactgttagtacttacgttagattatgtatgtgacgtgtaaggacacagggcat

SEQ ID NO: 635319 - DNA, 306 bp, Homo sapiens
acaaaacaaaaagctagcaaacaattcgacaggatgccaaaaagataatacaccatgaccaagtataatttataccaaggacacaaggatggtttaacatacacaaatcaataaacatgatacatcacaacagtagaatgaatgacaaaaaccatatgattatctcaacagatgcagaaaaaacatttgataaaattctacatccttttatgataaaaagctgtcaacaaaccaggtacagaagaaacatatcttaacataataaaggctatatatgacccacagctaacatcatactgagtgggg

SEQ ID NO: 635320 - DNA, 1215 bp, Homo sapiens
taaagaggtctcgtgggccccgtcggggtgggattgagacctctttttaaacagatttgggccgccggccccaaatgggggctgctccagcggccggggggtgagagcgggaaggggagaaaaaaggagaaggcagaagggggcggacaagcggtttccccatcagcgcacaaacgcgcgggccgcccgctcgagtcacggaccgactcattccgcggagactcgcatcgttctctcccttccccctttcgtatcgcttcggcgcggcgaatacccctcggaggcctgtgaaacccgaaggagaacgggtgtggggcgagtgttgccgggcccgcggcccgggatctcctgtgttccgacgaaaaggggaagggcgtgaaaggcggtgatgagaagagagaggagagcggctatcggggatctccctcttctatgctcggccgccgtgcggggagaaactccagagcccagagtactctgcggttgttgtctctcaaagagaagtctcaatcgcagaatgtgtgggtgttgccacgaggggattgtgagagagttgtgtcgaaggagggaggtgcaaaaaattctgaggagctatccacattggggagagcaaaactttggctctctcgaggggcaatcaactgtgtaggagaggactctctcgcgaggcactctcccgcggggatatttcccaacaagcgacgagaaatttctcctctcgtgtgatctctacaacgctctctctcttatggaaagataagcgctatagagagaacaataacgaggggggggcgtgtgtacacacaaacaaacaaagcgccccccgcagagtataaactattggaggagagcatactatgacgaggggagaaagaaaaaaaaacggggggggaggtattatcacaaccgccggggatgtgttgggcgcgccagaggagaaggtggcgccccttacgacatctttgttcgaaaactcactgcgtagagaaatcatcccggcaccgaccaagcaccgttggggacgagacctcttccccacaaaagagggtgggtgtgcgggggagcaaataacaacggggcgcgcatatttgataaactaccaaccattattgggccgaatgaagaccacccacttatagtagaagtattatggagggggaaatatattaccccccaaccctcattttttttaatatattcccctatatgttagga

SEQ ID NO: 635321 - DNA, 298 bp, Homo sapiens
aaagagtgggacgggaaagaaacaaaaatgaaactaaaagcagacctgatccttttaaaaacatttttgtagactctaaagggaattacaaaaaaaaaaaaaaggtctgaaaccaattcctgacagcaccccctaggtttagggacgggttctaaattaaacccaaagggaaactctgacttctgtgcgcaggggctcgccgcacacctggagggcacctcctgacctgcacacaccttgtgcacgctcacctcccaggagcagggccagggtggctaaagatggcgtccatcgaatt

SEQ ID NO: 635322 - DNA, 347 bp, Homo sapiens
gactatcggctctctgggcaggtgactggaggagtcattttaccagcctgccagggtgctgtaatcccaataccctatagtagggtccaccacttgatgagcttcttagtgtcacattcttaaaaataaacagaagccaaggctgggcgcagtggatcacgcctgtaatcccagcactttgggaggtcaaggcaggtggatcatgagatcaggagatcgagactatcctggctaacacagtaaaaccccatctctactaaaaaaaaaatacacaaattagccgggcgtggtggcgggcgcctgtagtcccagctagtcgggaggctgaggcaggagaatggcatgaa

SEQ ID NO: 635323 - DNA, 345 bp, Homo sapiens
ctcggggttgcagtgttgcccagatgcattttacatcactgtaaagagattacttgtgtggttactacctggcttggctggccttgcggttcaccagattaatttacaaactcccccactttattttgtgctatgtagatctggccatacttgcattagtgactgtcttgccttaaccacacttaagcaacccacaaatttcttctcagatttgtttcctagattacttatgatactcatcccatgtctcaataagagtgtcttttctttctggatgtgttctcttactccctcttaccaccatactttttgctctcttctcctgcaagcgtagtcttcagggta

SEQ ID NO: 635324 - DNA, 104 bp, Homo sapiens
  misc_feature (4)..(4): n is a, c, g, or t
gccnataacctagtacaaatgttaaaaaaagttatgttcctctccttcccaaagggtccctgtgtagctattcttaaaaatgaggggaggggagacggtggacc

SEQ ID NO: 635325 - DNA, 910 bp, Homo sapiens
ctcggttgtggccaaaaaagttctccccccgtgtgaggcccactgtgtctctgtgggggaccacaactatatacggggcgttgtgcgaacaacactcttccctgtgtttcagggagacccccaacctccttgtttggggagaagcgaagcgcttcttccaagatgaattccccgttcgttattgggttttcaacaacaaaactgagtgcctcaccgtgccggtgatgaagcttcgaaaatatatgagagctgaacaatccgcccggcgcgccccacactccctcggagtattagagaaccgaacggggctctctgcaatgcagcgtgacgcaaggaaacagaaatatgtgatgtggcgcgccctaaactagatgaatacaccaacggatttatggatcaaatgaccacctccttccctacaaatggccggcgctccccccaatcccaacacctcactctcttttgagccgccgattacttcccccccgcatctattttaattaaatagtgagaggactcaccgctagcatttcttccaagaagagccgctctgccccaccacaggatccctggacaaatttctcctccagctgccccggaaaagcctcttctttcaccgtctatagtagaccgcgccctcttgaatcgagctcctcctctgataatgttcgtccccagagcgacgctactttgtactcgattgtttcaaccacatcaacaagccacaccctcaccatggtgtatgcgtcaccgcacgccttctctccctccgtcagtaccatcggtggggttctatagatcgctcctggaaaattcttgagtccttcctagagacggggtgacaagcaccccggaggcgtctccccctcatgacacaatccccccgggagccccccccagcccacataac

SEQ ID NO: 635326 - DNA, 1142 bp, Homo sapiens
  misc_feature (278)..(279): n is a, c, g, or t
  misc_feature (287)..(287): n is a, c, g, or t
  misc_feature (292)..(292): n is a, c, g, or t
  misc_feature (365)..(365): n is a, c, g, or t
  misc_feature (380)..(380): n is a, c, g, or t
  misc_feature (406)..(406): n is a, c, g, or t
  misc_feature (495)..(495): n is a, c, g, or t
  misc_feature (500)..(500): n is a, c, g, or t
  misc_feature (503)..(503): n is a, c, g, or t
  misc_feature (542)..(542): n is a, c, g, or t
  misc_feature (549)..(549): n is a, c, g, or t
gacaccgcctgcaagctgagggagccggctccggcctctgccagcccaggaaggggctcccacagtgcagcgggggctgaaggactcctcaagtgccaccaaagtgggagcccaggcagaggaggcgccgagagcgagcgagggctgctgccagcacgctgtcacgtctcagcaatagactgctcttgaggctgggagtgcaatgttgttatcatagctcactgcaacctggaacccctagtctcaagagatcctccagcctcagcctccctgggatnnctattttngttanttctgaattctactacaaaagagtgctgcaataaaaatctttgaacaagttctaatgccgttcaactggaatngaagttttcaatcgntggatatgtcaaaatttaatcagatngtatattgctcaattactttcaaattatgtacaccaagtcattcttgctctggcaaaataagaatattttcattaatatatcattcaanttganatngccagttttccttctcatttccccccagtcaaatgagtngaattantactgtctaaaaatatatattcatttgcttacctgttagtatttgttccatgtattaagaagctttgctagtatatgaaaatatatgtattaccatgtcttgtgaattagtacttttatcattttgaaatgtttgttttcatttctgctgaccgtcctaacctgggtatctattttgactggtttttaatgtaactactaacatctttttatgttcagcactttttcacaattttactttcaatgtctttatttttaaaatgtatcttctgtagacagtggacagggggtcttgttttattgaaatcaagtgacaatctctattcataattgacatattcatccatatatacttaattaatagtcgtattctgagactaatatccagtttaatatcttacgcattatttcggtatattctaatagcccgcctacctacatcagacgaatcccagaattaagcccttgtctcgataaaacaactcttaacatcccgcttattacccaccgtcccgaactaaaaacaccttacacttatcttaacaacggacttctcttgccaaggcaaacttcgcttgccatttagccagccac

SEQ ID NO: 635327 - DNA, 483 bp, Homo sapiens
  misc_feature (46)..(46): n is a, c, g, or t
tggccctcctcagctccaaagtgctgagatataggcatgatccacncatgtccagctatttttttttttaacataaatgtcattatacatgttttcccctggaggctttttttttttaaactgggagtacttgattgtcctggccttccttggcactacaaagaggttcatacttttcctacgggtccacagctttggtggtatcttaattttttggaccacataagttaagtttagacatttaggctcatggtgctcccttttatcattcattcaacagatttgcaagtggctcctatgtgccacacggttctatgaggcaggagtaatagtccagcaggagagacagactatgaggcaggtcaaatatggtgtgtacgatggtgatgagtatgggggagaaaaatacacttgggagcagggcattgggggtagggatgtagggagcggggtttccaagcacggtgctgggagagatacctc

SEQ ID NO: 635328 - DNA, 369 bp, Homo sapiens
atcacacatgtggcatcaccctgacttctttctatgcacaagatccaagaaccctctcttggggtctagattgggaccctttcctgtaactatcatgctactgcactccagcctgggtcacagtgtgagatctgtctcagaaaaagaaaaaaaacaagaaaaacaaaaactacagggtatggtggtggaataaaaagctctccttcacctcttttcaatattaaagagctgtgtgatataaaaaacatttttctcctaacaaaactaacatcgtagctaatgaaatttctttaaactggtgtcttacagtagatggtttaccatccggtgggccagtggccatagataggaatgtccctccatacttaa

SEQ ID NO: 635329 - DNA, 354 bp, Homo sapiens
tgtgagaagatcaatgtcatatctctaaggaactgcacattaaaaacagtgagatccactgcacacctattagaatggcccaaatccacaccactgataacccccagtgctggccaagatgtggaacaggaactctgattcattgcaggtggggatgcaaaacggtggtcactctggaagacagttcgacagtcttacaaaactaaacatacctttaccatgtgatccagcagttttgtccctttgtatttacccagatgaattgaaaatttatgtccacacaaaatcctgcacacagatatttacggcagccttattcataattaccaaaccttattcataatttcataatta

SEQ ID NO: 635330 - DNA, 837 bp, Homo sapiens
tgtaagtctacaacatgctaatctgcctattctataacagctttgtcactctccctagatctaccgcctctctctactcttgaccccgttattggcttactagttgagtgtgcctgtttcctaaacaggcagcacactccttgattcctgactaatctctccgatcctcgaggatcctcacatgaacgtgtgctgtatcctggccgctgacattctacttcgacatctgcgcctctcccgagtatcttgaacgcatcctgtgacaagttacgagcactgagtgtctccctgactcgccttgctacttgactctattgccaaatcaagctgtggggccactccgaattgggtgacatggaaacctttcaccgacgttccctcagactcaaagcgtgggtcgtaaagatttgctccacatcgcttgactagttactttcttcgcccatttattgctcctacaaatgcgagcctgaggctgcggactctcgttggatgagtgacatagtcgaactagcctaatactcccgagtatgacaggcaccacaattgcttattatataattgagcagttcagctaagtacgtacatgggctctacatggagtctaggcaccgcacatttcaggcttatatctgagaatgcctagtatcggccggtacgtcttaccaccagagacttcatgttgtcagcagtaacacgacacggtagtagttactagcaggacaatcgctgctgcacaatctagtggcagcgacacgcagggtctgatgcgcatcgtctaacaattaaatcccctaaaccatctttggactggcgccgtatttaccctaatagacc

SEQ ID NO: 635331 - DNA, 765 bp, Homo sapiens
ggctcacagagaccatggaggatggcaagagcatggactatgctgaacgtatcgaacacatttgtgcgactggcagacactacactttgtacaacgactgacccttcggtacctaccactgagaattcagcaccctgggccaccatccacctgccccgcacacttgtcatctaattgaaaaggacatgttacctggttcctaggactcaggcgttgactagggaacaggtaagaggaggagatcatctgcatgaacgatgctgtctgggcgagcccgaaggccgaagacgaccagaaactatgactacagtactaacgaaggtagcctcggttccaggaatgactgggagttcctattggcaaggaccagaccgtatgactagagattccgaccaagcgacttccgctgaccaatcgcccttgctgagtcgcagatctgcataacgaggaatggaccagagcaatgcatgcgacgcatttgtgcgaaccactgctccgcaagtggaggtgatgattgaccacgttccgtctcagtgctaccctgtcacccatgccattagtctgtccacatgagagtctatcagcatccctatcctgtttggctactatgcatctctatagcctgagttcttgcatcagtatctccattctgctggcagatgatccatttagagtcttgttgcgccagtctggcgacggtggtcggcgcgcatgtctgtctcaccctccatcgggctccgctccctggccgggcctctggatccg

SEQ ID NO: 635332 - DNA, 197 bp, Homo sapiens
ggaactgagggcagacagcaagacggactgcctgacagagaacaggcgctgagatgccctgaccctgttgctggcgctctgagaggattgcctcagggtgcaggggagctggagaacaccctaggtgctcaggctgaggcagcttctgtgggggccaaggaggaggaggccacagagggcggacttgtcagatctgt

SEQ ID NO: 635333 - DNA, 496 bp, Homo sapiens
atgagcttgcttgctggaatatacttgaaaaggtaagagaagggcaggaggtgacggaaaggagtacataaatatttgccaaaaaggctagaaccgctaatataagtataactataatgtactaaacccgctagcggggactggactacgctggtgatggtgacgacgctggtggggagggtactagcgcgcgactggatagctggcgtgctctgggtagctggcagacacctacgtgtaaatcagaggagatggcggaagagatagcctggatccatgtatacatttcctcatacgtctattggcttggaagaggtactcattgccatcattaagtcttagcttgaatacgtgtatctactattttgtaatcaagggccacttcgcagacagcttctatcaaactacacagggacctcgctgtggtagggaattccagaagcagcagtctaagcatatttgtagaaacccatatcaggttatatatgacacaaaa

SEQ ID NO: 635334 - DNA, 221 bp, Homo sapiens
  misc_feature (61)..(61): n is a, c, g, or t
  misc_feature (157)..(157): n is a, c, g, or t
gatctagaggatcccggaaaatagccgacgcagggaggcaggaggcagccagaccctcctngttctatggcagcacagacctaggggagaaaccagaacgcgctgctttcctgagcaaacacgcattggggctgagcttggtttcccgaggagagtngcactttcgcgaaagcaggttgcaaggaagctagattttggtgccattttcttgaacatggcgc

SEQ ID NO: 635335 - DNA, 1123 bp, Homo sapiens
ctccctctctccagactgtcgtggtcgttcggtcctatgtagcgccgggacctccgtgaggctgaggggggaacagcgcggccaggagcccctcgggcccggcgcccttgcatttcgatctccgtgatgatcgatgatcgcggagagaagaagggcccaagcgggagcttggtgtcccggcgtcccgtggggcgcagggaaggagtggcgtctctgagtcaacaactcgctttcgaatgcttgcgttagacacttgagctgcagtcttagagcgtagtgacccgtgctgtgtgaactgggggagaggtctgcgcgtgatgcggctctaccatgacagctgtggctagccacgggcatacaaataggcaagggcgtcagacggtggcagagacacgaggagagacaagatcgagactgggaaggaatgactacacgagaacacgtggcgcctcagcaggcagtcatcagtgccaagtgggcggactccggtaagaacgaaaaagaaccacggggaatggacaacgtagacgaggcaagcccacgggcagaagaccaatcggggaacagagcgagtgagctaagaagatatgcgagcggcatacctagtagcagcgcatggagggacggaccaactgggctaagaacaccggagcgcacggactccagagtcgccctggaggctcccgagagtaaggcacgataccacgtgcgatgaggatgacagacagggaaacagcctattgacgataccgagaactaccacggacatccgtggcgacagggggtaatcacggagggatgccccagggacagacataccatggggagagaaggccaaacaagggtgccacccggggcagggaacgaactgagcaggaagttggatatgccagcccaaaggaatgggcgacgatgatgggagcataggggcacccgaccaccacccgtaataaacggacgaaaccgaaggggcgcccgcccggggactaacaaacggcacgtacacgacgacgcggatcgctaggagacgcaattgcggaggttgggaactgggaaaattcgcaatgaccagaagaaggggacattcgataccagtccatgtgggcgtttcgtgagggccacc

SEQ ID NO: 635336 - DNA, 305 bp, Homo sapiens
  misc_feature (39)..(39): n is a, c, g, or t
tcggtttatcttaaagggttttaaatatagaaagcttcnttagtcttatgggtgagagtgctgtttaagccttacctaggtatgtctttgaacatttattacagattgttatttgtgactatgaccactcatgttcatggatttacagcatcaagactatgacaactgggcctacaaaataactcacatagtagaagtgtgccaccaagctgtggtctagaatgtcctgccaagcttgcagacttcagttccatccctacgacacaaatggtggaagactgactcctatgatttgttgtcgacgc

SEQ ID NO: 635337 - DNA, 522 bp, Homo sapiens
gatacgaggtcgagcgcgtgacccctagttgagaagtttcaatagcattatgtatatgataaatacatcactgctaaaaaaatgctaacaatcttttgctggtggagggtcttacgccaacgttaacgatggctactgactcatcagggtggtggtggttgaagattacgatagctgtggcaatttcttaaaagacaatgaagtttgccacactgacatcctttcacaagacttctctgtagcatgtgatgctgtttgatagcatgatagcattttacccacagtagaacttttttttccttttcctttttttttaaacgcaaggtctcactctgtcacccaggctggagtgcaggggcgccatctcggcttactgcaacctcctcctccctggttcaagagattctcctgcctcagcttcccaagtagctgggactacaggtgtgcaccacacctggctaatttggtagaggtggggttcaccatgttggcaaggctgctattgaaacttctaaaactagg

SEQ ID NO: 635338 - DNA, 470 bp, Homo sapiens
  misc_feature (28)..(28): n is a, c, g, or t
tgtgatatggtttgggtgtttgtccccncaagtctcatgttgaagtgtggttcctcgtgttgaaggtggggcctggtaggggtggttggattgtgggggtggatttcttatggttgatttgatgctgtcctcttggtgctgtcctcatgatagtgagctctcaggaaatctggttgtttaaaggtgtgtggtgcctccctcgacccccacctcttgctcccactcctgccatgtgacaggcctgctccctgctagccttctgccatgattgtaagcttcctgagacctcaccagaaacagatgccagtgccatgcttcctgtacagcctgcagaactgtgagccaattaaacctcttttcttataaattacccaaactcagatatttctttatagcaatgcaaaaatggtctgacacaccctatgaccagtcattgaatatattatccaccccgagccctatgcagtctc

SEQ ID NO: 635339 - DNA, 274 bp, Homo sapiens
ggcacgtcgagtcagctgctatctgatcagtcacccgaagattcaagatacaccaaatctcagttggtacggtaacgatgttcatcttctagagcgcggggttttatataataaagtatgcctgtgatattaaataataagaatatggcaattagcgatatagcatacccaaacaaagatgttctcgatacagtctggcaaagactatcccaaggttattttaatgaattcagacatttggcctgtggatatttctccatcctaaaaaaagtgg

SEQ ID NO: 635340 - DNA, 371 bp, Homo sapiens
  misc_feature (103)..(103): n is a, c, g, or t
  misc_feature (131)..(131): n is a, c, g, or t
  misc_feature (195)..(195): n is a, c, g, or t
  misc_feature (226)..(226): n is a, c, g, or t
  misc_feature (328)..(328): n is a, c, g, or t
acatggcaacgccgtttccgagaccgaggctcgcgtccgcgggacctaggctagccgccttcgcaagaagtctcccaaaatccatctccctgaacccgtcccnaccattcatagagtcacgctcgttttcnaacttgctgtccttcaagtcagacacaattgctcacggcgcgcagcagctctctcccagaccangatggttccgagcgtcagcaggcgcagccgnactcgacaccgtccacggccgctcccaagttctcatacaacatcgcagcgtccttcatcggcaaggacaggccgtacgacccctcgacgcacgtcttccagntcaacccgtacaaccggatccagcctgcgcgcaaccgccatcg

SEQ ID NO: 635341 - DNA, 614 bp, Homo sapiens
  misc_feature (21)..(21): n is a, c, g, or t
  misc_feature (38)..(38): n is a, c, g, or t
  misc_feature (246)..(246): n is a, c, g, or t
  misc_feature (250)..(250): n is a, c, g, or t
  misc_feature (253)..(253): n is a, c, g, or t
  misc_feature (256)..(256): n is a, c, g, or t
  misc_feature (267)..(267): n is a, c, g, or t
  misc_feature (306)..(306): n is a, c, g, or t
gcatctactcaaaccacccangaactcaccattccaantaactttaattgggctggcataaattcccgaggcgccaacattaatgagatccgccagatgtccggggcccagatcaaaatggccaaccaggaaggtctctgtaggcaggtactatcactggtctcgccagatagtctgcccagattaataagccagctttctctaaagggcatgggtgcagtagacaggaggttccctcaaaacccntttntgntgntctcccatganccaactgtgtaggttccctcaataacccctttctgctgntctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggtta

SEQ ID NO: 635342 - DNA, 472 bp, Homo sapiens
  misc_feature (78)..(78): n is a, c, g, or t
ctgtgccacgtatatttaagtttcttgggggccccacggtatattcttagaatccacaaatggcccacaggcgttttncccttctgagagaaagggcacatggggtcgcacagctatgagaccacagtgtaaggttccctccacataaccccttttctgctgtttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggtta

SEQ ID NO: 635343 - DNA, 1277 bp, Homo sapiens
taacaccgcgcttttctctctttttttttttgttgtgtatatataaaacccccttgtgtgtgtggcccccacggacgggggggcgcgcgcgggcgcgcgcgcgcgggcgagaggagaaaaggcaggggggggggtttagggaggggggggcagagagacacacaccgcgcgagagagagagagaaaagcaggggggaaaacacaaggctctctctctctatacgagagagagagagggtgggcgacgagagagagagcgggaggggtgtcttataaagagagagggtcgctctagagagagggtgccgcgtgggagagagagagagcgccgcgcagaggtgtggagagagagagcgcaccgcgcgcgcgcgggagagagagggtgtacacaccacccccaccaacacacacaccaacagccatccacgcaagcagagagcagcagagtgtatatcttgagagagacgacgacagagcgacgaggagcgagaagaagaaaagaccagagagacgcgcgcgagagcgcggcgcggaggagagagcgcgagaagagagagagagagagagtgtgcagcacacacacacacagcagacgcgcgcgcgcgagaggcgcgcgcgcgcgagagacggacagctgctgtggagagaggagagcggagagcagcagagcgagagggacgtgagtatgagaacgagagacaaatatgtgtagtggtcgccaccaccaccacaaacaaaacaccccgctgcatgagaggaggagcagcgcgcgagagaagcaaagagagagagagagaaaacgcggggggcgcgcgacgcaggtgagagaagagaagagcagcgcccgcgcgaagagcagaggaggcggagggggcggggcgacaaaccacccccctcccgcgccgcggtggcgcggccagcaaatactacataaaaaaccaccaccacgcaaacgaaagcagccgggaggcggggccgccacacgacggatggcgatagcaacatcaccgccgcgaacacgacgacaaaagacaaaacaacacaagacgggccacggaccgagaacagcagaggggaagggcgaacccacacgagcagacgacgaagagacgcaaacaagagaagaaacgacaacgcagtccagtacgcaggagagaaaagggagcgggcggcacactaccaacaccacgcatacacaaaaaaaacacactcccaccacaaacaacccgacgggaacgacaaacgcgcagcggcgcccccacaacaaagaagaaaaa

SEQ ID NO: 635344 - DNA, 560 bp, Homo sapiens
  misc_feature (21)..(21): n is a, c, g, or t
  misc_feature (38)..(38): n is a, c, g, or t
  misc_feature (246)..(246): n is a, c, g, or t
  misc_feature (250)..(250): n is a, c, g, or t
  misc_feature (253)..(253): n is a, c, g, or t
gcatctactcaaaccacccangaactcaccattccaantaactttaattgggctggcataaattcccgaggcgccaacattaatgagatccgccagatgtccggggcccagatcaaaatggccaaccaggaaggtctctgtaggcaggtactatcactggtctcgccagatagtctgcccagattaataagccagctttctctaaagggcatgggtgcagtagacaggaggttccctcaaaacccntttntgnttcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggtta

SEQ ID NO: 635345 - DNA, 192 bp, Homo sapiens
tgattcttcgtgtccggccatggacggcatacgcgagaactatctcagccagtattctgaaattgctatccagattatgatgcacattcaggatcagctaaccctaagggagatctgtgcgctggcttgggttctgtgatgagagtcaaagaacatgacccattgcatgcactctcggttgcgcccgaccta

SEQ ID NO: 635346 - DNA, 127 bp, Homo sapiens
atttggtcccagagtgggcaatctctctgttcttgttatcttagccaactatactcatacctacagctacagaaagcatgactaggaactggaaatcactttgggtcctgccttcattagtgacgtt

SEQ ID NO: 635347 - DNA, 985 bp, Homo sapiens
gtgcttgcacacacatgccgggcggggattccgacgtattgtgggtgtccggacaacgagtgtgagacaacgttcgccccgggggtttttgcccctgccgcggggggtccgtccgtcgccccccgggtctggggattattgccggggaacccacggccgcagcctcacacggcgtgtgtaaccgtgacccggcgcgtggcctgttcaacggggacctcccctgagatgtcacctgcctgaaggaggggacaccacggcccacaggactggaggccccattggcctgtgggactgtttccacccgcggacggttcgagacccctgtttggattccggggccacccaaggagaggattacgtacctggttgaggtcccaccggcgtcccagccctggagacccctttccccccggaacccctcgaaacagctcgtccttattagggattcgtctcccccgatgggcaaatcatagagtgatctccgaatgttggcccggcctggtggctctacccccggggtctccgcctcccgagttgctgggattatgggcgcccgcccccacgccccgctaatttcttgtgagtctttggtagagatggggtttccccgttttggcccggctggtctcgaactcctgacctcatgagcctccggcctcggcctccccaagatgctgggattataggcatggacccccgtgtccggccataatattttcgtcttcttgaaaggactgcttatatacatgaattatatggtatgtagccttttgagagcgacttcttttgctatgagtcataacctttgagattcatccctatttctccgtgatattgatagcttcttatttctgagtccctcccttgtgtggatttactactgtttggtcccccgttgcaggatgtttaggatcgtttgccagtttggaccattaccagtaaagctgcctataacctttgtacgccaaacaacaaaataaatata

SEQ ID NO: 635348 - DNA, 1257 bp, Homo sapiens
gggactcactgctacctactgaccagacacgtgacaactctctacaacttttacactactgatctgttacgtacgtactggaactactactttcctgacgaggacgacgacttcttggattactacaccttacatggaccgactctacttgactatttccatcagtagcagtcacagtatggaccccaattcaaatcctttgcaagctcctgcaaaccaatccaattcatgcatctacttcatcctgcagcaaagacattacttgtatgcaggcggtgcaagattttcacacactttcatcaagtcatgcattcatcacatcagtggcagcacagcaatatagcacatccatcaccaagggcacacattagggtccatcattcactagctgatgaagcatttcagatcctgcatggcagcaactcatatgccccagtgagttccagcacagcaatggcacaccattgaagcactcatggccaaaactgatgcgtcaaggcaacacacacaggtcatggccatataggacaaaatgttgtgctttcactgaagcaagcatcagtagagtgcagcatatggccaaaagcacaacaagacttgggtataatccccagacgaccaaacaggaacgacaggcagcatagaacaggaacatttgcttacacagcagacacttctggctacgcaatcctaaaccctttccagtctccttgtcatgttcactgggcctcgagcggtcacatcatcactgttgacagggacagatcttaccaactactggagctaaacacacggccaacagcagcaagacaaacgccatcagaaccataccagaagaaaaacaggtcatggcttcacgacacagaacacagggaggacaaataaatggacggaccaacgagacatcacgcaccccagagcaggacacaaactaacaacacatggagagtacctgggagagacgacacacacaacggactacaattcactaggacaagaaggatactaacacccacagacaactacaacacgagcccgataacactcaacaatgacatcatacaagacacacgaacaccaaaacaaacaaaacaccgagagggaccagcaacagaacatgcgaaacggagcaaacccacagaggaggcaatcaaggacaacaaacaactaagacaaaccacaacaaaaaagagcagcccatcaatgagccgcaactcaataccacacagcaagatagagagcaccaccacagctacc

SEQ ID NO: 635349 - DNA, 423 bp, Homo sapiens
  misc_feature (375)..(375): n is a, c, g, or t
actactaaattcgcggccgtcgactctcaatctcctgacctcgtgatcgtccgctcgcctcccaaagtgctgggattgcaggcgtgacgaccgcaccccgccaaaccaaggattatttcttaagaaattatatactggccatatcctccaccctgtcaccccttaggttaaaagaactcctgactcaaactctgcctgttgagttcacagttcaccactcctggcctggtgacttggtgcaaattaaaacttgaaaagaaggcaagctccacccaagccgggaaggtccctatcaagtgcttctgatcactaagacagccgtgtgaacagcagaatgggggtggactcactatattccagtcaagggactagtanaagagaccccagaaggaagaaaaagaccagtggaaagtgcacgggtca

SEQ ID NO: 635350 - DNA, 1122 bp, Homo sapiens
  misc_feature (182)..(182): n is a, c, g, or t
tcgatgtatcggggctctgaagatggacggcgggaatccgcggaccatcgggtcgggtctatgtctcccgattaccgcgctcctggagacggagagcaatgtcaaccttggtacctgggtgctacgctgggggtggttggggcgaaaatagtcgataatgcggccactagcgtgtacttagnttcaacttcttgttatgccattcttaccgcgagacaagataggactgtgaattgaatgcgcaggtgcaagctattgaagtgcggcgggagactccagtggagggctctcctgtgttcggtccatgtgagaactcggagggcagagcgccgtctggatggcgatttgcactggcgcgtatgcgattttctgagcaccgatgggcaattgccgtgaatgccgggcgtctaccgaatatcgctcgtgcatgggaggactcgatcgacgcataaggcttcgtgtgaacggcgagagaatgaaactgcccttgatatggagtgagatggaacgtctctctaatgttggtgagcagtatatgtgttacatagggaacagtgatggatacaagtacccatgataggaagaattgtatttatattctcacacatgcacatgatttgcagggaaatcatgatatcaatgcgatgtgcgtggcctgagagggatatctctccaatggattgagggtttgttgaaaggataaccgtaacgaagcatgaaggaaatacggtgcagagagagactacaatgcatggttcgagggggattttgttgctaatgcgaggtgacctaccaatgggcaatctcaggtcctcggtggtgttgaatgtggcttcacaggcggtgggcaaccaggacattcccgtggggagtcgttcaaacgctgggcgaatgcttctgcaaacgagcctcgtgtcagccgagatggctacgtggggtgggacacatactcgtggggggcccatactgtcccttggcgaaggtggaatggccgcagaagggtcttgtggggggggcgcccatgccctggcgcagggggcttgtggtatggctccgccctgtggtgaaaaatcggctgtgggggtataacacgcgcgcaaacccgcgggcacacaccccggg

SEQ ID NO: 635351 - DNA, 401 bp, Homo sapiens
acacacacatacataccccaacccttaaaaaaaagggtggcctgaaattttagttacaccacatgtggttttcatttgtgaaaaatgaacaagctgtttgtggttaaactgtctaatcgcctgttatcaatctagcactgcattcaatatttacaggatacatcagcttctgtgccacactccctctacgcccgggggaggtgtgattaaaaaggaggaggagagagtttatcctgaggaataatatttccaatgcagccacactcgcactacatctggttgtgctggtagcggcagttaaattgaaatatttcacagcgtgtgtcagaaacatgcgaatgtaattatgacagatctgattaagccagggagcttgtggcactccggcttaatcagatatg

SEQ ID NO: 635352 - DNA, 578 bp, Homo sapiens
cgcataatataccgtcggactaacgcctataccttctgcatatgaattaacctagaaatactttgcaaggagagctacagcaaagactccccgataaccacgacgagctacttatgagcagttataatagcacacccgtctatgtagcatacatatgatgcgcaagagtctatgtgtggaggcgagaaacctaccgagcctggttattcctggctgctttcgttaataatcttagttcaactttaaatttgcccacagaaccttctaaatccccttgtaaatttaactgttagtccaaagaggaacagctctttggacactaggaaaaaaccttgtagagagagtaaaaaatttaacacccatagtaggcctaaaagcagccacccaattaaagaaagcgttcaagctcaacacccactacctaaaaaatcccaaacatataactgaactcctcacacccaattggaccaatctatcaccctatggaagaactaatgttagtataagtaacatgaaaacattctcctccgcataagcctgcgtcagattaaaacactgaactgacaattaacagccca

SEQ ID NO: 635353 - DNA, 309 bp, Homo sapiens
ccttccccccttcccccctttaagcgaaagggaggtaagaaaagttgaggccttggaacctttttccggggggcgggtttttcgtttcaggggaaagggtgccccctgcccctcttagaaattttattccttttttttttagttgttaatgtttattataaaaaaaaaaataaaaaaatttaaaacattttattttattttttttatattatttagattaataacattaatggcataaggggttgatgcttttctttctttagtcttgcctcctttaagtctttggtgatttaggcttttttaatatta

SEQ ID NO: 635354 - DNA, 359 bp, Homo sapiens
ggagcagagcagccatcttcgaacgtggggctgcatcaggctggcgtttatttaacaagcaacaaaatgtcatggttaagaaaattattcttgctttcagtgtaaatcttcgcagcgttctaaacaacgttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgt

SEQ ID NO: 635355 - DNA, 145 bp, Homo sapiens
tctagagatcccacactggtcgagtctgatgtagtaatagcttatcctgtaataatgctgtgagatcataacaagctgaatcgcttcaaagtgtagacatcactttaacgatcctgtctattgagccccacatcatagtcgctcg

SEQ ID NO: 635356 - DNA, 419 bp, Homo sapiens
ctcagacccaggagtccatactgcagcccctcctccctcagacccaggagtccatactgcagcccctccttcctcagacccagtggtccatactgcagcccctcctccctcagacccaggagtccgggccccagcccctcctccctcggacctaggagtccgggccccagcccctcctccctcagacccaggagtccagacccccaaccccttctccctcggacccgggagtccaggccccagcccctcctccctcagacccaggagtccggacccccagccccttctccctcagacccaggagtccgggccccggcccctcctccctcagacccaggagtccaggtccccagcccctccaccctcagatcttctggaatctggggccaggcacggtggcgcacgcttgtattccggct

SEQ ID NO: 635357 - DNA, 122 bp, Homo sapiens
gttatgctacagtatacaaagggaaaagcaaggtaaatgggaagttagtagctcttaaggtgattaggcttcaagaagaaggagggacaactttcacaggtattaaggaaggttctttttga

SEQ ID NO: 635358 - DNA, 745 bp, Homo sapiens
ggcagatcgagctaccctctaaaagcagtttataggggtaaaaaataagagagcacacccaacgctctgaggcacaaacgggaagaaacttcttctggacatcctcctgcttctcccgttactgatcgtcagctccctaaagacctttaagaagctttttattcctaagaggctaaaatgaggcaccgacgaaagagggctgattacagtagctcgacatggaattgcgagactgactgcctatgaattctttaaactcaaaagcaagctgcctctctggcatataaataagcatggactggaggaaacagctgccaaatgcaagggactgggtgccaaagttcatacctttgtggtagactgcgagaaccgagaagatatttacagctctgcaaagaacgtgaatgcagaaattgtggatcctccacatttagtaaataaagcttgcgtaatctataccatagatttgtatgctacacaggatccatatattagaaaagactttggacgttagtgtacttgcacatacctggactactaaggcctttttttgctgcgatgacgaagaataaccatggccacattgtacatgccgcttagtacgatgaacatgtataggaccactacttactgagttactgcacagcaagatagttgctggtgaggctcaaaaaatttgacagaataactggttgccttacaacaactgggtcaaacatgctttgctccttagccttgccttatc

SEQ ID NO: 635359 - DNA, 844 bp, Homo sapiens
attaatcttttcaaaataacagctctcggattcattgattttttctggaagcgtttttaggtgtctcttatccccttcagttctgctctgagtttatttatttatatgtcttactgctagctattggaattctgtttcgctacttgtatctactagtctcttattaattttcgatgttacgggtagtcgattcttcagatacttatcccgctattactacctgacactgaccttaacggcctaaactacactcgaacatcacaggccacgaaatgaccgacaattcctatctgaacccctacacctgcagcagaccacaacaccttaccgaccataacccagcacactaatcctagggggcaccacttagggctaccagcaacgggctggtaccacgccgacaggcgacaacatctccatcagcccacctgaaaaccaagggccaccgagcccttcccaacacacacgggatcacttcaaatcagcaacgtcggtccagcacatttccaccgccaaagcccgtacccacgcgaccgtggaacacctggacggccttaccaaccgcacaggcccacgcgaacacacacactgttccgacaccgcccccccaaaaccgtccattacgccgcggcacacgcgacctgcacgcagaaacatatacagcccgaaaccacctcgcaccaacgcctgaggaacccctggcaccggcgaaacacccgggagcagaacccaaccagcagcgccccatatttcacccaccccgcttggcaacctccgagagtccccacacatagctcagccgcaaacctccctgggcacgcgcaacgtttccgctaaaagaaca

SEQ ID NO: 635360 - DNA, 317 bp, Homo sapiens
ctttttttttgagacagagtctgctgccttccagtctaggctgaaatgcagtgatgcaatcttggctctcggctcactgaaacctccactagctgggctcaagcgatccctccacctcagcctcccaagtagctgggattacaagtgtgcaccaccatacctggctaatttttgtgtcttcagcagagacagggtttcaccatgttggccaggctcgactcaaacacctgacttcaagtgatccgcccgcctccgcctcccaaagtgctgggattacaggcataagcccctgtgcctggcgtcgacgcggccgcgaa

SEQ ID NO: 635361 - DNA, 189 bp, Homo sapiens
gcagaatgctccgaaagagggtgcgagaagaaaaggccgttctgccatcaacgagggttaaccgagatacaccatcaccattacaagcgcatccatggagtggcttcaagaagggtccacctcgggcacttaaaagggattcggaaatttccattaaggaattggacctccagttttcccatttcaacc

SEQ ID NO: 635362 - DNA, 233 bp, Homo sapiens
ccaaaaaggggggggccaagtcgggcatgggaaagacagcagtgtttgtcttggcacactgcaacagtggagcagttactgggcaggtgtctgtgctggtgatgtgtcacactcggggagttggcgttttcaagatcagcaaggaatatgagcgcttctctaaatacatgccccaatgtcaaggttgctgttttttttggtggtctgtctatcaagaaggatgaagaggtgct

SEQ ID NO: 635363 - DNA, 363 bp, Homo sapiens
agtatttagcagtaccttgacctgtttgtttgtgtgaaaagacattttcaaagatgaaatacgtgaaatcccattacacatcagcattaacagattaacattttctatttattccaatgaggggataccaactttcagcccaaattgagcaaaatgttacctcccgtcccctgccaaaaaatcccattattcccattagtagaactctattactaaaaaaagaaaaaaaaattgtactcaatattttgagttttcaatttttagaataaaaatttggtgaaaagtttccttgagtacctaaataatgtccttcattttgtcttagcttgcaaagcctctaatatttgctacctgcccttttca

SEQ ID NO: 635364 - DNA, 233 bp, Homo sapiens
agaccccagccagcagcctccttcctacggggggtcccatccgtgccagggtcggggtggccacctgccggcggcagcggctttggacgagggcagaaccacaacgtgcaagggttacacccctaccgacgctagcccgcggcgcccgcgacgtctgcacggaccagacccaggattccgaacttgtgaactcgtgacaatcacaaaattggagagtgaaattacggacagga

SEQ ID NO: 635365 - DNA, 388 bp, Homo sapiens
  misc_feature (187)..(188): n is a, c, g, or t
  misc_feature (193)..(194): n is a, c, g, or t
  misc_feature (203)..(203): n is a, c, g, or t
  misc_feature (227)..(228): n is a, c, g, or t
  misc_feature (251)..(251): n is a, c, g, or t
  misc_feature (340)..(340): n is a, c, g, or t
gctcgctgctcccctctggggcgctccaccttccagcgcgactgggaaaaaaaatacttattcttgccataatacctgaggcgacaaaaaattaaatttttaaaccccatgagggaaatcgtgcacatccaggctggtcagtgtggcaaccagatcggtgccaagttctgggtaaggtgaatcacgnntgatnngaacatggnctattcgaacccccccaccggcanncctaccacggggaacagcgaccntgcagctggaccgcatctctgtgtactacaatgaagccacaggtggcaaatatgttcctcgtgccatcctggtggatctagaacctggngacccaattggggaaacctttccgtgggtttttccggggctttccaag

SEQ ID NO: 635366 - DNA, 196 bp, Homo sapiens
taacagtttatctagattacttttgaaaaccgagatattagacaccatcatttaaggtgagttattttcttgttaaccatttttttaaaatagccaatgaacatcatatgctcacctaaataaaagcctcaaagttaaattcgtaggtattttggctgatatctcaaaaaatttagctgacaacattgaacttttc

SEQ ID NO: 635367 - DNA, 278 bp, Homo sapiens
gggatactggctagacatatcgaagaataaactggactcctacctctcactgtatgaaaattaactcaaaatggattaaagctttaaatctaaaacctcaaactataaaaatcacagaagaaaacctaggaaatatacttcttgacattggctttggcaaagatatgtctaagacccaaaagcaattgcaacaaaaacaaaagttgacaaatggaacctaattaaactaaagagcttctgcacagcaatataaattaccaacagaagcacccgtctga

SEQ ID NO: 635368 - DNA, 967 bp, Homo sapiens
aataccagatggaggtccgacactgcttgtctgcatactgccatcagcagctggtgatccttgtatcctggcaaaggctggatcttggtccggtccagacgcctaggggcatggagaagagaatgtccgatgagagttagaatttatagcaatatacttggccctgggtcgaacagatatagggtgggcacaagagatcttgacgtcactttgcaccttgtgacagcgaagcttattaagtgcgattaggaacagtgagaaccatgtatagtgtcagatgtgaaccaatgaactcataatgtgaattcacttagaggaacatggtagtgtgagaggggattgaagagaggttgggaatgccaagtgagaagggcatggagatcttagggtcaacagtggatttccacttcgtacaatataagatcactaacatctaaatgcagctgcaaggggttactctaaaagaagatcacatgccatataccatccaaatagatacccaactgatcgcaagtctgcacgtcaaaaaagtgtgcacaagacgaggtagtgagcaaatctgttccaactgtactcgcactcacgctatcgaggtgcgtgactgggtggctgctcaataaaagaagaggggaaacgcattgtcactgagacagcttttgaatgaattcgcccatgtactagttgtgctgtgcttatgaaattttaatggtaatttgtaagagacagttaaatgtggaaggtgaatgacatgacattgtatactggcctcggacattaatgagtgggtattccagattgggagaaggtgaactgctggtgtgaaaaataggcaagtgagcagggcaatgggacaactatttacatgagatacggtgagtcatgggtacaacaatatggaagtggtggttttgcggaccgtgggaagttactcagcaattggagaaaacatcgacagggaaagtagaag

SEQ ID NO: 635369 - DNA, 509 bp, Homo sapiens
  misc_feature (24)..(24): n is a, c, g, or t
acctgagagtgaaggtcaaaccanagaacacaagctcactcacaataatcacaaaaagaataaaatacttaggaatacagcaaatcagggagatgaaaaatctctacaatgagaattacaaaacactgctgaaataaatcagagatgacacaaacaaatggaaaaacattccatgctcatggagaggaagaatccatattgttaaaatagcaatactgcccaaagcaatttatagattcaatgctattcctatcaaactatcaatgacattctttacaagattaaaacaaaactattttaaaattaatatggaaaaaatgagcctgaatgaccaaggcaattctaaccaaaaagaacaaagctggaggtattactttacccaacttcaagctatactataaggctacagtaaccaaaacaacatggtactgttataaaaacagacacataaaccaatggaacagaatagaaagcctagaaatatttcacacacctacaactatctgatc

SEQ ID NO: 635370 - DNA, 410 bp, Homo sapiens
aggagaaagctgtatagagacacatcaaagctagattaactagaacatggaaatagggttatagacaatccacctatgagaaacaaatctctgaacaaataattaaatgaaaccacgcccccccaaactgttcaagtggcagacaacataaataaccgtaacttatatgccaacacaccttattaaaaaacaacaacagcaacaacaaaaaaccaggagtcagaggataaccttagctcctccaggaagtgtgtaccactgcttctggcctgcaggctggggcggatcagggacctgtcacacatcaggatagttgcagtcctctaccgcggagctggcgtcggacaccaccgaggaactggccccgtggctgtcggggagattcacaccggagtcatgcccctggtagg

SEQ ID NO: 635371 - DNA, 250 bp, Homo sapiens
ccctttttcccccttttatcaaatcctttttggcccccccccaattccccgggaacatcctgaaggggtttccccccccccgagggtttttcccaaaccccaaggggaaaaaccggtttttttttttgattttttaataaattttttttaaagaaaaggccccagttttttcccccccggggttaagggttttattaagggggggcccccttaatgttttgaaaaaaaaaaaagccttggtttaaggcca

SEQ ID NO: 635372 - DNA, 1459 bp, Homo sapiens
  misc_feature (285)..(285): n is a, c, g, or t
  misc_feature (1173)..(1173): n is a, c, g, or t
ttgggcaccccccacgtggggggaaccacttgggggtctatgtgggataatgccacataatttgggtcccctcttggttgagtatgttcccccacgggctctctccactatgtagccacgatgtctttttgccctccattatgaggatgatgcgatataatgtgatgagtgttgttccccccatttcttctctttttgttagtgggttgctctcccccctcttctgtgttgtccctcccctggggattctcgttgcgctcggaaatatattatatttggtggccncttttggcgggcgggcttttcgtggggcggagagaacttataatatagaggagtacctctcttgaaaaatatgggtgtgttaatagatttaagagagaaatagtgggttttaaacaaagatgctccccccctcgctgctgttttggtcctccccttcgtcgagaaatatttttttaggatgtctccactatactcttcggcggggtgaactattatagagagatattttttgtccttggggagccaccacgcgatatattgtagggagaaggttgtgttaataggctctctcgaaatgtgtttctatactctcgtgtatagtttctcccctcctgaagatatctctcgctcgagatttgccacatctagtatgttggtagagatgatgtgcggctctgtttactcggcggagaagagcacacgcgtctgtgtggtgcttataataaacagcgctgcggggatcacacagagactctttggtgtgtcttctttttgggtaataactctcatcgccccacagctgatcactcttgatatatatataggtgaatatgatagcgctcctctgtgcgtgcgccgctcatcgggatgagcccatctctttatagagagagctcccacacatgtgtgtataagaaagatataaatatatatagtctctgtgtgtgctcagagactctctctgagagtatgtctctctacttgtctcacacaatagagtgtgtgttgctcctcttctgagaagagactcactcacagagagagagcacacactcttctcttgtgtgtgataagacgcacagctctgtgcacgcgtgccacacacacactctatatatctcttgtgtggggtgtgtggtgatatatatatatatgtgagtattgtgnggagaagagatatatttaaaacaacacaccatatagcgttttttaatatatatgtgtgtggtgagacaccacaagcatccattttctgccctgtgtgcaccatcatatttgcgtgtttacaccccatttaaagaagacccaataggccatattttaatgttgtataatatgtggtgtttcccacttagtgataataccccgtgtggatattgtgttgtggcccttttatattaactcgcccatcatgtttcttaaatttttttccaaaaaaggaaggaaaaagtga

SEQ ID NO: 635373 - DNA, 1159 bp, Homo sapiens
  misc_feature (51)..(52): n is a, c, g, or t
  misc_feature (73)..(73): n is a, c, g, or t
taataaatttaaaaacagctctaccttctctcctccccccagagcaattannaccaactaaaaggggctaggntctggggggaggacgagaaggtagagctgttctcaaatttattaaaaaaaaacaatataaaagggggaaacacacacaacaaaaccaacaacaaaagaaacaaaaaaaaaaaaaaaacacacaagaaaaaaaacacaaaaaaaagagaaaaaaaaaaaacaacacacaaacaaaaaaaaaagagagcagccaccgcaattcccaccccaacagacacagaaacacgccaacacccagagcaatcgacacaacacagcaccacacaacacagaggaggggaacaaacaagaggacaaacaaccacccaacaacaacaacacacgacacaaaggagcaaaaacaaacaagacaaagcgacaaaacaagagggaccaaccaacacggcagaaaggcgaaccagacaacgagaagcgaaccccactcacacacgaaaaccaaacaacgagacaaaaaaacaacaaaaaaacaaacaaacaacaagcaaaaagcaacgacaaacaaaaacaaaacacaacacgagacgaggacgcgaagagaaaaaaaagagaagccgaacaagaaaagaaagacaaagaaagaaaggaagacgccgaacaggagcgggccacagcaaacagagaaaaaccaagcacaagacaggcgcgaaaagcccagaaaaaaagagaagaagccacgcacggtgaagaaccgaaaaccaaacgaaaaagaagagaagaagaaagaaaaaaagaacaagaaacacaaaagaaagaaagcaagaagacaacgaaggaacaagagacaaagaaccgacaacaagaacaaggcgcaagaagaagaacgagaaccaaggaaaagaaaagagagcaagaaagagaaagacaagaggagcaagaaagacggaaacgaaggagaaaagaagaggcaccaaagaacaagaagagagaagcaagagacaaacggggcgagaagagaagacggacgacggcacagaaacgaaaaaaaaatctaagaaaagagcgaaagaagaaaaaacggaaagaacaagaacaacagagaagcaagaagagaaaaggaaaggaacacgagagcgacacaagaaaaaag

SEQ ID NO: 635374 - DNA, 309 bp, Homo sapiens
caggtctcaaacttcactctgtttacaacataagtaacaccacacccctgctagacaagcagctcgattcccaaccagcgcatttccactcatacgggggctctctcctgaccatgctcagcaagcaggaataaccaagtcccagatcaggctctgcctcctcctggagcccagcctctgttctaggtcatgctgaagagctgcctgtgtgctcaaccaagctgctaccctgtcacagatccccggtttagctcctccttgggtgtccacaggctcggtggggccaaggtggagcagcagggaaagaca

SEQ ID NO: 635375 - DNA, 437 bp, Homo sapiens
  misc_feature (170)..(170): n is a, c, g, or t
  misc_feature (172)..(173): n is a, c, g, or t
cgcacttctgtggtcctagctacttgggaaggctgaggccacggggaatcgctgaggcccgggaggtggagattgccattaagctgagattgtgccccttgcactccagtctggacgggggagtgagactctgtctcagaaaggaaagaaagaagggcttgggcaccggntnntcgcgcctgtggtcccggcgctttgggaggccagggtgggcggatcgcggggtcgggagttcgggaccggcctggccaacgtggtgaagcctgtctctactggaggtacagaattggccgggcgtcttgcgcgtgcctgtggtcctggctgcccgggaggctgatgcagaatagctggggctcgggaggcggagcttgcagtgagtggaggttgcgccgctgcactccggcctgggtggcggagtgggactctgtctcagaaaa

SEQ ID NO: 635376 - DNA, 220 bp, Homo sapiens
  misc_feature (109)..(109): n is a, c, g, or t
atttatgaataaagctgctataaacaccggtgtggaggttttggtgtggacacacattttcacctcttttgggtaaatcccaaaggggatttaccagggagtgtgattnccggatcatatggtgagagttttgcaagaagctgccaaactgtcttcccaagtggctgcaccattttgtgttcccaccagcaatgaatgggcgttcctgtggcttcacgtc

SEQ ID NO: 635377 - DNA, 526 bp, Homo sapiens
  misc_feature (51)..(52): n is a, c, g, or t
  misc_feature (73)..(73): n is a, c, g, or t
taataaatttaaaaacagctctaccttctctcctccccccagagcaattannaccaactaaaaggggctaggntctgggggggcagaaggcgctaggagtcgtaatcttcttcgtcctcttcatcagtgtgctggaggggcccgggggccgctggggggcaaaggcagagtaagaggcagaagggcagaaaagggtggtcggggggctctgaaatgtggggcagaggggtggctgggcctgggggtggggggttggtgatgtctcctcttccccatcagtttctggtggtcctcaagattcatcctcctgggtccgagtctggtcccgggaacagtttctggtcctggcgttttcggttcccatcccaccggttcttccgggccgccgttgcctgggtttccgggccccgtgtggggcgcctcttgttccccatccaggttggttgtcttcccggtccccctggttgtcgggaacagatgccaccaggtccttcaagaagtcaaacggctgctccagctcgatgca

SEQ ID NO: 635378 - DNA, 280 bp, Homo sapiens
tgagcagacggccgggcatagccgacctcagagtgaacacatgctctagactataacacgatggctgtggacagggcccttcatgtactgaccccgatagggccccaaagcagtaacactccagtaaccaagtctactagctcccggatcttggtttctgaataccattatctactacatggaaccaaggccgcatcccccagtgactggtactagggattggggctggacacatacaaggttgaggctagaccctcttgagtacaacctgccggtggcc

SEQ ID NO: 635379 - DNA, 215 bp, Homo sapiens
  misc_feature (111)..(111): n is a, c, g, or t
tcagctaaatttgtcttcagtggtctaagtaaaattttacgtgggctcctgaactttgagctaccctcaatctgagctaacttaaaacttcattctgtgcccctcctaagnacatgctgacttcagggtaaaacattctctaatctaaaatctaaccttttcaatctccaactgccattcccttcccaccttctctctaatcttttttgctccac

SEQ ID NO: 635380 - DNA, 121 bp, Homo sapiens
cactaagtgttcatgtggatgtgggtttgatttccggccttgcccagtgggttaaagacctggtgttgctgcaagctatggtgtgagtcacatgatgtggctcagaatctgagctgttgct

SEQ ID NO: 635381 - DNA, 217 bp, Homo sapiens
ctgtttacttaagtggaaaacaataccctaaacatagaatcaccatatgacacagcactccactcctaaatatatgctgaagaaagacgaaaacatatgtccacacaaaagcctgtataggcatgttcccagcagcgttattcacgacagctaaaatgcagacacagtccaaatgctggtaaaatatgctcatataacacgtgctctctatgcattg

SEQ ID NO: 635382 - DNA, 133 bp, Homo sapiens
gtcgacttagaggacccccatcggaacccaatgagcctacagaaacaagttgaagtacctgtttttcctccgcaagcggatgaacaccaacccttcccgaggcccctacccaacagctcattgggttccgatg

SEQ ID NO: 635383 - DNA, 499 bp, Homo sapiens
gctgactctaaggatccccatactgtcgagcaggttgcactggatgccatcaaagtcttactgcaacatggatgactggctgagacctgcgtgtatcccactcagagcccgtggtgggccaaaaggaactgttacatcagcgagaaccccgaggacaagaggcatgtctggttcggcgagagcatcatccgatggtagttccagttcgagctatggcggccaaggctccgagcctgccgatttgtgcactccagatgaccttcctgcgcctgtatgtcaccgagggctcccagaatattagctatcactgcaacgaacagtgctgtgcttagatggacagcacactggcaacctcgtgaaggccctggtcctcccgggctccatcgagatcgagatccgctccgagggtgacagctggttcacctacagacgtccctgtcgatggatgcacgattcactccgtagcctgtggtctgacagtgattgacttgcatatcat

SEQ ID NO: 635384 - DNA, 144 bp, Homo sapiens
agtcggtactgtgtacaataggaagtatgtgcctggaggggatccattgactctcacaatagagatagaagaactgaggagggtcaagaatattctgataaaactgagtaactagtccccgagatctaaaaggaagagcatggg

SEQ ID NO: 635385 - DNA, 179 bp, Homo sapiens
aggagatcaggacccacaggaggcacagaaagcatcatctgcaaccgagatgactcagtggggacagaaatctgactccgtcgctggacgctgagagtgtgacaagctccgccaagacatgacctgcacagtcttcggtatcaaggagaccatcccatcagtgccaggaccccatgacg

SEQ ID NO: 635386 - DNA, 485 bp, Homo sapiens
  misc_feature (267)..(267): n is a, c, g, or t
  misc_feature (275)..(275): n is a, c, g, or t
  misc_feature (279)..(279): n is a, c, g, or t
  misc_feature (314)..(314): n is a, c, g, or t
ctgcccctctttttctccgggtgcttgtggagtcggatcttttctccagcaattgggggaagaggctttttctctgaattcgcttagtgtaaccagcggcgtatatttttaggcgccttttctaaaacctagtagttatattcatttgttaatcttattttatttttgagctcaaactgcttgagaataccttgattccttaagtggaatgatttttttgcaaggggttcccgatttgagcttttttttcttccaccgtcatttctnactcttanaccnactcagttccatcatggtgatgttcaagaagatcnagtcttttgaggtggtctttaacgaccctgaaaaggtgtacggcagtggcgagaaggtggctggccgggtgatagtggaggtgtgtgaagttactcgtgtcaaagccgtttggatcctggcttgcggagtggctaaagtgctttggatgcagggatcccagcagtgcaaac

SEQ ID NO: 635387 - DNA, 226 bp, Homo sapiens
cttattccttctgcatcaggtattaactagaactaatctttgcaatggagagccaaatgctaagacccccgaaaatagacgagctacctcagaacagctcaaagagcatcatccgtctatatcgcataatagtgggaagatctataggtagaggcgaccaagctaccgagcctggtgatagctggttgtccaagatagaatcttgagttcaactttaaatttgccc

SEQ ID NO: 635388 - DNA, 1044 bp, Homo sapiens
gaaaaaaacattccaagaactttcatcagagattttacttgctggagtgcagcggcacgatctcggctcactgcaatctctacctcccgggttcacgccattctcctgcctcagcctcccgagtagttgggactacaggcgcccaccaccgtgcctggggtttttttttttttttttttgtggatatttttttaggtataaaagagggggttttcccctatgtgtttacgccggggatgtggttcttgggatttcctcctgtgaacctctcgtgtgtctccaccccactcttctcgggcctctcccaaaggtgtgctgggggcatctatccgcgaagcgttgtttttcccccatgcgtgcaacggacaagggtacctgtgccctctgtgcgggggccttcgtgatatgtgccccgttggcggcttttaatttctgtggcccccgtggccccttttataatgggctggatttccgggggggacccgttgttgacggcaaccaccacccacatcttttgtccgcgggatattacgcgggaggtttggccacccctttctgtggagaaactcttttgtgccacagtccctgtttggggggctgcactttcccagcggcgcggggagatgttgaatggcgccccccatgttgttaacaggggccactctcctttggacccaacagagattttgtcgcctcccaatatattttctccagcctcagaaccaggcgtgcccagaaacgagccttcctcatcaatcacggggggggggaggcttgtggtcagacgcggggacaaacttcccagcaaatactctcggtattgtggacactgttcctggggaacatcaatgttgcgtcgcccaccacaacttctgtgtgtggtcccccagcggaactacttatttcgggcaacagcgccggcgcgtattcttcttcagagacccagcaccacaacctcttttggccgaccccaccaagaaaccagcggcccgaagatttcccgccgagcccctcgcgggccccaagatcaccctgggggcaatg

SEQ ID NO: 635389 - DNA, 572 bp, Homo sapiens
  misc_feature (1)..(1): n is a, c, g, or t
ntcggtaccaacgatggtctcagtcgtgttagatatacttgccaagtctctgtcaggtttgtacctgccacagaaatatcttgaaagtttatctaacagctggagccatgaaaaaaaaaaaaaaaaaaccacgggagcttggtaaaacagggttgggctatgccaacaggaagagcccaagagaaagtacgaggttgccaccgtggttggttgccagaggtgccccaggtgggaggcagggaattggcagtttgggggaagctgggggtcccttctaccactgttccttccgggccccagtgatgtgttctctctttacggtgcacacattcttttcttgaagatgaccaagcccatacataaccggggcatgaacaccccactggggttttttctgcactcaggaacaagcgggtcctttggcccagctctctgctgtatgggcgagtatagagggggagatattagggactacttctcatggcactcctgttatttgccagccattagtaggggctttataggcagagccattgtgtttatgttctcaccacctggagaggtcgagtcct

SEQ ID NO: 635390 - DNA, 129 bp, Homo sapiens
gtcggaccactacttctggtgagcctgtgcggcaacttgaggactgcactcagtgagctgcatgcactataaaggcatggcctgtctcctcacttgagtgcaaggtccatcgaccaaagccctgttctg

SEQ ID NO: 635391 - DNA, 1481 bp, Homo sapiens
ttttttttttttctcaggaatcctttattctggtagtaatgaataattactaacaaacaggtgggggaactagggagaaaaaccagaaccatttaaaacgtggtgtgggtggctcgaattctctccatttcagggccctcttctttttctcgtggtgactgtggacaagtggtggagttgtgaagcgggtgtgtagaagaacactgtggaagaggccgcgccctctctctctcgaggggaaagagaggtgtggttagtgtgcacacaaagaacagaggcagagggacaaaagagccaaactctctcttagtgtgtggtgtgcctcttgtgtgagtatctctgtgtgagacacacctgtgagaggacatctccgggtcacatataccctgctcatatcacccacatatctctctcgccgctgtgagaactcctcccccacagaaggaaaacacctgtgagagacagtgtgacgacacacagagggtggtgcgctatacacactatagtagagagagctctctttatcattcatcacaacacacacacatatatattacacaccacatactacacacacaaatgtgtagagagagcgcctctctcttgtctcgcctgtgaggtcgtgatgtgcgcgagacagagagagagctccaggggggcatacgaggacataattcacacaacatgtgcgccgcataagagcccacacgaatacacccctaacaagaaataaaccacccgtgagggagcgagcgcgtggagtgggcgcaaatatctacccgcaatatacactgtggcacacaagtgcatgtgtgcgggaaaaccccccacagcgacagaagatgttccgccacagacgagggggccccccaacccgcggactaagccgccgcctcccgcgccgcaataggccaacagcgggaggagaagcagcctataggaggggagccgcccaacgaggtgggggagccatcgaggaaggtcaccacctatgtagacggcagaaaccggagcgggtggattaacagaaggatcccccccatggtagtagaagaacacggggggcgactatcccccaacgcgcccggttgtacgcgacacaatacacccaaggacatcgacgtggggtgcccccactggtgtgggggcccacaaaaagccaccacaccgagggggcaagtctccaagaggaccgtacccagttaacaaacggcaatacacgccaggggagagaaaaaacccccaattaaaccagttcgttatatccccccgccaaaaatttatccccgtgggggggggcgcccccccagagaagaaaaacggcgcgggaccaaccataaaacccacagcgagtcgagcgtgatgtgcgcccgcgtgggtggtaggcatcaacaaggaacgaacacccctctgttggtagagagaacgagaaaacacccccgcctattataccagggcgggcggacgcgagcaacggacag

SEQ ID NO: 635392 - DNA, 321 bp, Homo sapiens
  misc_feature (192)..(192): n is a, c, g, or t
ttgcccccgggggggtttttttttaagccccccccaaaatttttagccggtttgaaaaaccccccaccccgggggggttccccccggggagccaaaatgttttttgggggggggttagcgccccccataaaacaaaaaaagaattttggggaaaaaacccccttgttttttaaaaaaaaaaacccccccccntccttgggggggggaaaaaaagggggggtttttggaactttcccccccaaaattttggggaaggggggggccttttccccctttgggggttttggttagggttcccccccaggggcttttgttcccgga

SEQ ID NO: 635393 - DNA, 104 bp, Homo sapiens
ctcacacctataatcccaaagtcctgggattataggtgtgagccattgcatctggcctctataatatattcttgcactttgggaggcccaggcaggtgatcact

SEQ ID NO: 635394 - DNA, 101 bp, Homo sapiens
ttggtaggaatggcctgagtggcgtgtgggcaggctactggttgtatgatgtattagtagagcaacccattaatctttgtagttgtattaaacttgaactg

SEQ ID NO: 635395 - DNA, 117 bp, Homo sapiens
taggtagcaagactgacttctgggaggctctttctcattttgaagtgtcaattttgtggctgttctaaagcattaacaatgggagggcatggcgcatggagacttaggtatcatcta

SEQ ID NO: 635396 - DNA, 375 bp, Homo sapiens
gggggattaaaaagtgaaacctctatatgcacgtgttatgtgcattttgcaggatgagactgagtgtaaaagaatttttttttctcttcaaggtggtttgtgttttccatactcatcacaaggccttggttgagtgtcttatccctgagcaatctttcgatggatggagatgatcattatgtacttttgtgttaacctttattcctgtgaatatttctgtgaaaactcggagaacagagatgagatttggcaaaaaaaaattggatttaaaataacacagagtttttctaacataggaaaggccttcctatatatttctcttcttagattctccactgtgttaatcagggacagggcacaggtttctagcagtgt

SEQ ID NO: 635397 - DNA, 538 bp, Homo sapiens
tgggatgtccacagggcagagctaatcctgcgatgctcctcagatgttgatcataagcaatatgttcatcatggcgtaacttcaagttaattgataaaaaagctttaaaatttttctgttttgaccaggcacatggctcacgcctgtgttcccagcactttgggaggccagggcgggcggatcacctgaggtcgggagttcgagaccggcctgaccgacgtggagaggccccgtctctactaaaaatgcaaagttgaccgggcgtggtggcgcatgcctgtggtcccagctgcttgggaggctgaggcgggagaattgcttgaacccgggaggtggaggttctgggggtgtcgagatcgcgccactgcactccagcctgggggacaagagcgaaactccatctcaaaaaaaaaatgtcggtttcaatttccaatatgtgaactgtcaacagttataaacaccctccaaaaaccttgtgggaatcctcagtgagtttaacgaaactgatttgtaaccctgtggaacagtaggggatcct

SEQ ID NO: 635398 - DNA, 904 bp, Homo sapiens
ataatgaggatcagagctttttcccgtgaaaccagtatggtggccatatataagcctggttaaatggtcatctaaagctgtcaaataagacattctgtgaaaggtaaacatcgaaactggttataagtaaaatcatcagagccaacaacagggtctgggagataacctttgaagcttatggtactggcctgcaccagaagatgtctgcattactcattgctaagaatgtgtagcacagaactgactaggattaattgttttccaagaagaaatgtaaactctacgtgtggttttcacatacagcagtctattgaataagcatgcatctgaatttaagttgcccaggtatctgaataattttttcatgtgcatctttgtcgaatgttttggttcagagaaagaatgtttaaaggttttaaaaagacttcagttcttaaatgtaacgtgtacccttctgatggaaaatcataacaaaatggcgtgcagtagacttcttaggtggtatccagggccattgcagacgggtggttaatcatatgtacttgggtgtaggagtctagtgtctgggggtatgcatggggtgcttcatgtaaggattgtacattacaagtagaaaagggagtatactaactgatgcttgcggggtataccactttgggtcataatggacggtcaggggaagatgaaaggtgtttaaccgtagggaaattagggtgggtatgcaggttgtttgtaattaaacgtggagaggcactttgatcgaagcagcggtgaaaaataacaagtggaattgtgcgataagaagaataagtgctagtgaaacgaactgagttgtagcgcgcataacgggatattgagtgtttttttgtgtatagcataaaacgaaaactaaagaaacaaaaaa

SEQ ID NO: 635399 - DNA, 437 bp, Homo sapiens
tcctggtcgggcaggcgtcctcaccgggaaggtctgtcctctcccttcccagatggccgccagcaaaatatctactcatccttcagagcccggtgcaaacctcaactttcccgggaaggttgccttccaccaccaccaccacaaccaccaccatcaccaccagcaccaaaatcaatcaccctcgtctccctttccttcaaggttggtctctctctctctctcccccggtctgtttctctctctctctctctctctctctcggtctgggtctttctttctgtctctgtctctctctctctctgtgtgtgtctgtcttgggtcttaggtgtcgtactccgcgtgtgtgtgtgtgtggctctctgtgtgtgtctctctctctgtgtctctatactctgtgtctgtgtgtgagactgtgtgtctctctctgtctgggtgta

SEQ ID NO: 635400 - DNA, 518 bp, Homo sapiens
ttgatcacagcaacctgcaacccaataaatgttttgagtggaatatgagcattggttgataaacaaatcagctcggctgtcatgccctgattaagataatgttgcccatctatacgttgtaaaaaaacctgactattcagggatgcatctgaaaactggaaatacaccgaacgatgctgtgagagaaaacctatactctctaaaacttgggacatattattaaacattatgtttgttataaattgagacttaatcgattatattttataaaatgcgtacagatctgtctattttttatatcaattgcaatgttaatggctagtcggacaccctatccatacactaaaataaaaagctcaataattcagcgacctgtgccgctaactcatctttaaaactcatgaaatacacctactgcggagatagcagtgccaaagatctaaagtcgatcaaaataaaaataggcgtaattgtagcagatttataggtactgactagagatgttgagttgcatatcc

SEQ ID NO: 635401 - DNA, 273 bp, Homo sapiens
tgaacattctgtgtcgtttctgtagcaggcaggaatttgaagtagatggaagaccgacctggattactccggtctgaactcagatcacggtaggactttatatcgttgaacaaacgaacctttaatagcggcttcaccatcgggatgtcctgatccaacatcgaggtcgtgactgctattgccgttatgggactctagaataggattgcgctgttatccctagggtaacttgttccgttggtcaagttattggatcaattgagtatgacagta

SEQ ID NO: 635402 - DNA, 388 bp, Homo sapiens
tctctagacgaggagtcttctggaggagtccttagggttttctaggtatccaatcattggcaaacagagatcaccggacttcctcttttccaatttggatgccctttgtctctttcttttgcctgattcctctggttaggacttctagtactataatatgttgaatagaagcagtgaaagcgggcatgcttcccttgttccagtccttagggggaatactttcagcttctccttgttcagcatgatgctggctgttgagtgtgtcacatatggctttattttgaggtatgttccttctatgcctagttcgttgagggtttttatcataaagggatgctgaattttatcaaatgctttttctgcatttattgagatgatcatgtggttt

SEQ ID NO: 635403 - DNA, 367 bp, Homo sapiens
tcgtcgaatgaacaccggcacttgtgaggcatacaacgtaaaggttgccacatggctaatggtgagacgtccttcctggcatcctctgaggggtagcgggaaagacagacagctcccagggccacacgcaaatatacctctactcagattagagaaactccgagctcccattgccttatgcgtggagccgaggtgttacgcagatcgcctgttttgtttataacaaagagtttgcttcctccggccaaccttaaagtctggcattcacggctggcacggtatagggcccatccacttctctcccagcacgtgcgccagcagctcccatccggtccagagccaaatgacatgtgagtttggccatcca

SEQ ID NO: 635404 - DNA, 179 bp, Homo sapiens
tatgtatgagctcatgctgatctctaatgagctctgtgacagtcaagcacacactccacattgaccttctggggtactgtctgtggcagccacaggaaggagctggagatcccattaggactgtccaccacacttgaagcacaaaactgcagggattggggctctcactggtttggtcg

SEQ ID NO: 635405 - DNA, 365 bp, Homo sapiens
tataataactggacatatacttactcatttttattatgagtttacacatgacctctttcaggacaactgaagacactaccttctctcccacccataacttttagcaatccccactctcccaaacacttcctccagacccatagcttctagaacaccaaaggcatgagctatggcttcatttgctacattccattatgcttatttgtttatgtgacattctttctaataggctgcaaataccttgaagccatggactttgtcttattcatctcggtgtcctcagaatgtggctcaataaatgtatgttgaatgatgaattaatccctaaggctatgaataaatgacacttactgttaaaaaaaaaa

SEQ ID NO: 635406 - DNA, 972 bp, Homo sapiens
gcagtccaccctggcggggtcgcagggttgggatggcggctggaggcgatcatggttcgcccgagagataccgatcatctcgttgcctcccgctatgccaggccccgtgagtatgtgctatcagtgatttagcgacagggtataaggataccggacatgggcggcagagtgtggtctgtggcctggcggaggccagagtcagataggtgggctgtggcctaatcacagagtggaacaagatccaggaggatgaaatcaatgctgggccgaagccatgcgagtctcaagatggcccgctgactgcacagagaaacgtttacgaacaatgatgtgtatggctcacgtgcaccaccatttgggcatgtgttgtccaaaagctgcaaggcatcactcaccttgtgtgctagttctgtgctatgtgggagacaatacgtgacttgattattcttagaaatgcacttgacctgctgtttgccaaaggcttgccagaagtgatctctcggctggccgacttgcgtaaggaaccgagcagtctacccacatcaggttcacacatttccagcttgtgacagttgacccacagttgggcaaaacgtcgctgtcttggcattcaggatctggcgtgcatctccagaatttggaagcgtgtccggaatgacctggagcttcgggggagtaagggtacaacgtgcactcagggcaggttcgggagggccaccgggggggatcgccaaaagggagaaccgctgacacaccgggggggacaaggcggataaaaaagggttccctccccgcgggagctgttacccgaatggggattgaggcttggcttgcggggagcagggggctctccgccaagatgacagacaatcctctccgacacaaagaaaggggccctcgacacgaggggcagcgggcacaacagaccgtccagagagtcgcacacatgtgcgcacacacactcgccagcac

SEQ ID NO: 635407 - DNA, 455 bp, Homo sapiens
ggagacgggggtctcacggtgtagccaggatggtctcaatctcctgaccttgtgatctggcccatctcgggcctcccaagggtggctggggattacaggttgtggagccacggcacccgcccaaaatgtcttatagactggaagagtccggctactggcaaagtcagcatttttctgggcgtggccattgggtagaactgacatggctaaatctgattatcattagacaatacggtcaccctgaacatgacggggcttcccttggtggataagccccatgttcttaaattctccccatcttatgagctagagaagtaatttttttttttttttttttgggaaaacggttccccttggtacccgagaggggagtacaggggcacaatcggggtccagtggcacttctaccatgggggcccaaggtagatttgggggcctaagcctcccaggtaggg

SEQ ID NO: 635408 - DNA, 155 bp, Homo sapiens
ccaggggccctgatttcctcggatgtgctattggccccaggacttgaagcttgcctcccttcaccctggggactgtgggttccaagggataagagcaggggttgggatccatgggcctcctggaaggtgctcggccgtcttctccaatgaatcca

SEQ ID NO: 635409 - DNA, 1284 bp, Homo sapiens
  misc_feature (1284)..(1284): n is a, c, g, or t
gctcaggcggagcggcccgtgtcgctgtttttctgagtccggggtggtctggcagaccgagccgatggtacgaggtgtcgtgacgggggctgcccccggtggtggtggactgtcgatgctgggatgccttgtggctggttgagggaaccgctgtggcgctcctgcgattgctgctggtgctgctggccgccgggcgattccggtgagatcgcctgggcttcggcagtggaccggtcgttgggctggtcgtcgcgtggagtgtgccgtgtgcatgctcgcgacgagcggtcatttttggggctggtcaacccgtcagggtggaaggagcgtgcaatgtggatcggtgacagcggtgatccatcttacgcgtcataggagcgcgcttatgggaaggtcgcggggtgggtccgaggcacgtcgagactactggcagtgaataactgtcacaagtacctgacgtggccgagagcctgatgggatcgccaggaatcctgtaatccacagacgtggatgcgggtcacgaagttgcagggagaaccgtattgtgcctagtgaaaggtgcgccgagtactaaaggaggggaggggggatcttaccgttgctaggttcttggaacattttgcgagaagggtctacttttggcataggtccctcaggaaaaacgtgtattctagatcgtacagatttgaatggcacacagtcggtggttggaatggacttgggatatcttattgatcgggtgtttggggcataagcaaagctcacgaatgaacattataacctatgaacatccagaaaagggggaagctgagatgtccaaggcggggagcgtggtcccaccctacaacagggggacaaacgcctagacttggaagatatggtccaacgggcgtcactatgaactgatacacaaaggacctgggccacgccaccatccatggcatgcggacacctggcatgaaggtacccaaggtcaggctccatcggggaatgcgaagagagaaagcacagagagcagcacgacaaccgtactggaagcgctatcgcaaagagaggaggagataaagagggggagaagaaggagagagcagagagagaacatgaaaagaaagagatgagagaaagggtggagaaggagagtgagaagatagtgaaaggagaacagagaagtagaaggggggtaggaggaagagaagaaaggtaaaagaaggtgaacggaaaggagaaagagaagtacagaagaataagagaaagctgtggtagagctctcttttcaaagagtgn

SEQ ID NO: 635410 - DNA, 201 bp, Homo sapiens
acgcacattaactatgatcacataactagattgggcagtgagagtgagtaatacaatgtctagtgagcctagcggtgttgtgatctgtaaattaatgcgatcagtacggcaagggagcctacaacggtgtataatacgaactatgtgcctgccttcacgcgtgctggttggttcgtctcctcggcgctgatgatagccccc

SEQ ID NO: 635411 - DNA, 932 bp, Homo sapiens
ctctgggttgaagccgcgcccccacaggccggtccacactttttcgcagggtcgtgtagccaactcttctggggaacagggcactgttgtcccttcccgaagtcgtaatttcaaagggctctcccccctcgagggccagaaggaaaccaacgagaattgtgggggaggcaaccaccattatttctcttccgagcccgccacagttggtgtttccctaaagccttttgtgtgattttagaaatgcaacccttgattaggccctcggatataatgagaaccctccgcacactttttggaatttctgctaaagacactcccccaaggcgcccatttccccacaccccccggtgtggaagagaatgtataccctgggggatccactaaaatttcccccctccctcggagaagcctgggttgtcaacccttcacccccacttttttgcctccacccccctccccccccacgggagagtcgtaaatttgatgagagccctctttttcaccccgcttaggcgacagaggaactggtgctgaggagctcttgtgagagaaagtttttgaccccccccgagatgaggtacccaggccgcagtggtggatcgacttctttgtggatagagacaacgtttccttgtgacaagaatgctttcaggagcctggagcactgaagggggcccgggacgcccccctctccaggagaccctcgggcacgcacatttccacgcccacagattgtacacaacatcttttgctcttattttgttaaattttataccagcaagagagaagagcacagtcttttccttgaaaattttggccaagaaattgggggggggaaaaaaaaatgggttttcacaaggggattttaattttttcccccctaaaggccctttataaaaaaaaatataataaagaaatttttacactcccca

SEQ ID NO: 635412 - DNA, 1167 bp, Homo sapiens
  misc_feature (281)..(281): n is a, c, g, or t
  misc_feature (713)..(713): n is a, c, g, or t
tggtggtgtgtgtgtgtgtgtggtgtgtggagtggtggtgtggtgggggtgtggtgtgattgtgtggtgtagtgtgtggccgctcgtgttggttgattatgatatgcggcctatacccacgttgggaggagccaggtaggcgccctcctatagtgggatgtgcaacgaaagtccacgccactgaatgccgcaattttttttatagcggtggacacacaccccctctagttaagggggacaccttctcggatatgggaggatgcgcccacccacacaagagntgtgttggtgtagcaccaagaaaaagatccccacaagggccgtgtttggttgttatataccccgtccatgcgccacccatcgtgatacacgtatgttgtacccggggttctctctatatagggtattacctcgagagggcaccacttgtgggggtgtgtgcacgaaaaattttcctccgtggctcaactcgagaggggagagtctcgtcttgggccgcaacatagagcggttgtctctcaaactgtggggtgtccccccgcagtgggcagcacacgaaagagagccttacactgtgggggggataaacacagagattttcgggcgcacagagcgcccctacacacacttggtgtcccactctggcacagaggtgtaaacacagggccgcctctttgcgcgagctctcttgttggcctgtgtgagagccctcntcactggacccgtgcgcaacaccccagaggggccacatggcgcatctggttttctccgcgcacacctggtggcgcctttagaatagacctgcgctctcatagataggcctgtgttatactcgatagacactgcgtacacacacagctcagaccccggggggcgatgccacatgccacacaccctgggggccacacatttgccactagagcccacacctttgtatagcccatattttgaagaacactaccagagtacactgacaccccggacactttggaagagagaacatgtattctcaccccagatcttctccttatccaggagattctacatggcaccacactctgtctaagaacacccacccccgagtttccctgcaacggaatccggctccaactgggggtaccaaaataggggttttaaaccagaaaaattaaatgaatttagcgtgaa

SEQ ID NO: 635413 - DNA, 752 bp, Homo sapiens
gggcatccacagtttccagttgttactcagggtagaagtggatgaaaacgcttacagatgtggctctggcatgctagtatggtcagaggacagtcaagcagcttaagagacgacaccagaacacagaaccggtcgatccgaaggagcgagggacaaagccctgttctgagcggcataacggacaagacgacttagagtgtagatgacaggctctgtgtgcttaaactgaatggggagagacgtgtgctgtgttcatacaatgtcgtacaggtaattcgttttgcatcgtaacggggacgcgatcatagggattagctttatagccaagttgtaaccattgtgcatggtcttaggttgttctgttgtatctatatatttaaaggggaagactaaagatatacagattactgttaaaagttgcaggtccatgttatcttgtattaagacgaatatttctcgtgcgaattgcactgtagagacatggatagagccaggtgattactaaaagtcacagagccaaacatattctcatgcaaaggggtcttactccttaagcttcatggatttcatcagtggccttctaaataaccagatgtggtacgtatttacaatatttcaccaagaacttacgacattctcggcaaacgtgctggcaatgcctgccagtggttcactctagcataagccatggcagtgcaaaaagtttgaaacttggaaaatggggacccaaagaccatcaggaatggtaatga

SEQ ID NO: 635414 - DNA, 105 bp, Homo sapiens
ggttcaggtgattcatcggattctgtcacacgtctctttcaggtgtctgactacttggcctccacagccatctggaccatctccaaagctccctacaactcgagg

SEQ ID NO: 635415 - DNA, 666 bp, Homo sapiens
  misc_feature (636)..(637): n is a, c, g, or t
tgtaataaattgagaccaacttctggttaatgtaatcagaaaataaggtcattataatctgagttcaagtgattcacagaaatgaaggaaaaagtattgaaacagggcagaaaagaacagtagtcaagaggcactaaactgccaaactggcactaaaccagtttgagcaggaacgattgttcactccaccatcattactttactactgtaggacacaactgtagttgagtattatttaaacactaacaatggataccaacactttatatttgtctaccatgaccatactgattcatgctgtgaataaattccaactcttttttctttttccaccagattcaaaatcttggtaacatatctaattgaccatgtacggtttgcatgtctagctgccagcgtgtagtggagaaaacattaaacacattaggttttacagagaaagcagtggttcgtttctgaagaaagactcacacaatttcattgcccattaaaagagaaaggtggttggatgctgagctgataaaaatagcaaatgaccactcaaaaatatgctcattaaaaagccctagctgtatgtaacgatccagtatcctcaaacaataatgtagtggaacagattttgtttatagaagttgnngtattaaagtagaaacagcataagttctc

SEQ ID NO: 635416 - DNA, 171 bp, Homo sapiens
ctttgacaagatctccccattttgtccattcccattcccaagcaaccatattctactctctgcttccagctttgacttttttagattatacatatacgtatataatgtagtatttgtgtctctgtgcttggttactttcacacagcataatgccctccaggttcatccatg

SEQ ID NO: 635417 - DNA, 200 bp, Homo sapiens
cttgtgtggtgttccgtgaacagaacagaattgaatagaatagaacagaacagaatagagtagaacagaattgaatatatagaacagaacagaatagaatagaatagaatagaatagaacagaatagaacagaacagaacagaatagagtagaatagaatagattagaacagaatagaacacaatagaatagaatagaat

SEQ ID NO: 635418 - DNA, 123 bp, Homo sapiens
gctttgcctaagtatccacttttcccttcttacagcctgtataggaacccccaaccatacacctctgttatagccaatagtggaattgaactgattagttagcaatactaggcgatggcttga

SEQ ID NO: 635419 - DNA, 228 bp, Homo sapiens
gctggtacgcccccggagttacgggatcgacttatcaggcgccgggactgacgcgaagggcgtttgggtactgccgtcgccgcctggcccaggccggggcaggggtgcgttagatgtcagtgaagtcggagctgcagccgaggtcgtagctggaaccagctgggctaccccggcagaatgaaccacaagagacaagaagacgcatcccgcgtaggccaagcggagtgc

SEQ ID NO: 635420 - DNA, 139 bp, Homo sapiens
  misc_feature (120)..(120): n is a, c, g, or t
  misc_feature (128)..(128): n is a, c, g, or t
cgatctcaggactggcagctacggtcattaaaatatgataaatgtcactgttacttacaaaatatatcaacggtatgtatgggatgtaggttatattcttgatgttgagtacttgtcatncatcctgngcttttgttct

SEQ ID NO: 635421 - DNA, 386 bp, Homo sapiens
tctcatattcaggtacagctctacgactcctgcgccatctgttatgtactagcttgcctgcgctggggcttgaactaagtaaagaagcctaggtctgcagatctagatcgcagagaagtcagtctcattctaacacattgcaactactgctagagtccaccccatgaagctgttgcagattgtgtatctgcgactgaattctatgacgtatatgtagttcagactaaaacaaatgttgctagctaggttggctgtcctgtctcagtaggacattgacagacgccagctaacaccctcagcagacccttgacctaagatccagcatgcgttatgagacccgcgacgggctgccgcgctccgaattcgtgatcttggccatggctata

SEQ ID NO: 635422 - DNA, 1357 bp, Homo sapiens
tggctttttttggcttttggtaaaaaaaattgaaaatggtactctaagtcaaaaataagagtttggtaggtgggaccagaaaattacttaccgtgacatccaccccaattccccctcatccgtgcgtggggtggaaagttccagaaccgtgcgtgtcgaaggccttgtgttggctcagaacacccaggtgtccttccgtgcaaggggacggcaacggtggtagacgcagtagagagtgtgtagacgccatagagacgcccagggacccctgtaaccccgggccggctgtgctgtgcacaacgcctctcaagaaagggccaccacagggtgctcgcacgggcaagccacaccgagggccgcggagagccccacgaggaaattcaaggaattagcggcataagcgatttaacaccttaaagcgtggtgaaaggcgaggaggacaatagcggtgacgtgcattccatccgcgaccacttagaaagaaaccgtgatttcttcacacagtgtggtccctttacagtccaggggggcccgggaggcactcaaggagaccagtgaaccgtgggtgattctccgtgatgcccaccgcgtggttcccgagggtaacatgttgacagtggaaaccggctttgacaaggcgttgtcctcgtcttgggaaaaccgggggcagacaacacaaaacacaagggggtgctgcacaaaccgcgaggcacacacccagagacagacacaccaccagcagccgacaagcaacaccatagcacaaacacgagaaacaaagtaaacacaaacacagaacacaacgaaaacaccattcaacaacaaaacaacacgaagcaaacacagacacactactaaaataaaaccacccgcgtacggaaaggagcacatcaggcgcgacgccgataacaacgaatagaaagacacagaaacagcaacaaacaaagaaataaagcaagcgagatccgacgagacgtagaccaaccaaccatacacaagtcacagacgcggacggcaagaacacacagaaaacacaactacagagacaacccaccaacacgaaacaaaagacaaaagcaaggaacaacaggacggcactgcgcagccctccacacagataaagctgaagcacaaggcaagaaacagagtgcggtaggtcgacaaccaccaacaaaaaaaaaaaaacagacaacacaggcaagcatcaacaacgatcatgacacatacgacagaacaagacaagcaaacagaacgaacaacaccaacacacataacgaccaccgatacgacacccacgaacacaagacaccgaaccgtacgatgcaataaagcgaaacaaaagcaacgacaacacaca

SEQ ID NO: 635423 - DNA, 135 bp, Homo sapiens
cactctaaaggatcccctgtttccctgcgacccaactgttaagattggccctaagaagcccctgcctgaccggtgttcgcatacagggtacccagctcgggtagggggatttttttaaaactggtctcctcccta

SEQ ID NO: 635424 - DNA, 579 bp, Homo sapiens
gtacgcgaggaggccgcttgatggtcaactacaccagaataatttagtgtgcgacgcgcgcttcctcatcttctcctttgtctactgctacacccgactggatcctctatcccacccagatcctctacaccacatactacgagtcatcagcaacaggtgccccttcttcggatactacttcttcaacgggcttctgatgtggctgcagctgctgcacgtgtactggtcgttgcctcattctgcgcatgctctatagcttcatgaagaagggccagatggagaaggacatacgtagtgatgtagaagaatcagactccagaagaggaggcaggaggagcggaccaggaacctctgacagataaagaacgggacagcctggagggcccacgccagcaccccactgatggacctcggaagccgggtggcccgggcagtctgaccaacaggcacacaacaagccacacatagccgggcggggctggctgcaaggggttgccccaccgccacggaccgcgaacacccctgggtgcccaaggcactgcaacccctgggccacctcctgccaaccaagccaccccc

SEQ ID NO: 635425 - DNA, 893 bp, Homo sapiens
  misc_feature (443)..(443): n is a, c, g, or t
catcttcgggcccccaagactactacgagggcggtacttcaaggcgcgaccgtcaagttacccgccatcgaatacccatactctccaccagctggtttgcggttcctgactcaagatgtggcaccctaacatctatccatacgtggggatccgtgtgtatctccatcctaccattccgctcgagtgagtagctgactcaccgcagagacggggagctgccctcacatgaggatggaaccaccacgcagaatcgtcatggatccattgtctctcgtggagatgtgactctctcactccctgaaacgtatgccccaactgccgttgcatcgtaccacgacaaaactgtggtaccgccctaaccgtctgaatggttacaggaaagtgtgaaacgcatgaggacacaggcggaacgatctctagatacaatcagaccatcatccggnaagctggtcgctggcggtaccagatgagtggactgcggatgacgttgatcggcgatgataggtgcccacctaccgcctgggcctgagtacttgcgtgagaggaccattatggtgctctgcgttggccccgaggtagcgggctctaataccgtcttgcgtacgacgactcaactatccgattgactggcgatgtggacgaagacggccggacatggtttggcgatcaggggaacgagtgatcgatgagctcgtggtccggcacagagtccgtgatcaacgcgaccgatgaaagtataaccttgcctgatgtttcacctcactatggccggaccccgttgggctccctttggacggagcagtactacctcacggaggggacgtgcgtggtccccggcctccgtctggttgctgcgtcctgggcctcttctcccttccccatgtctgtcctgg

SEQ ID NO: 635426 - DNA, 200 bp, Homo sapiens
taagctctgcctgtctctcccgcatggctccctctatgcgactgctaggctaggctggccaggccatgttctgcggatctcaccgcataagcgaacacctttacacgctagatagtggggacatcatcaacgccctgtgcttcagccctaaccgctactggctgtgtgctgccacaggccccagcatacacgatctgggc

SEQ ID NO: 635427 - DNA, 595 bp, Homo sapiens
  misc_feature (237)..(237): n is a, c, g, or t
  misc_feature (292)..(292): n is a, c, g, or t
  misc_feature (380)..(380): n is a, c, g, or t
aggtccttggcagcaccgttgttgattcggcatggagagagtcacctgagcagggacagtgttgggcgcagggctggagagtgtctctgctgtgcatgcacccagagtgcacccacccattcactgacttcatggagctcccaagcctctgctcagtcacggcaggcacagcggcttgcagccagtggggagggcatggggatggctgctgtgggagggccaggtgcatggggtttncggcaggtgtgccgttgaggatgtgtgtgcttttaggcagggcaccgtgggcttngaggagtgtttctgagagattcgagtctgagggccctgagatcacgggtgcagtagtgagccccagggcgcatgggagacacctgggnaagctgcaggtctgtggtggggggcgctggggcatgtactcgtgcccactgagggcacgtgcacccaggctctcggctgtctgtgtggctccaagtgaggagggtgaccagggtgagggtaggggcaccgagggcatggatgagccctgaggggcgggtgtgacatgaatgtgtggggtgcctgccatgcgtggaatgccagggggatcctctag

SEQ ID NO: 635428 - DNA, 452 bp, Homo sapiens
tctggatgcaagtgtccagcgggagaagaatggctgcagagaacgaagcagaaagatgagctgagagagtaaggggggtgttagaagtcaacaggggataacaaaaccatctggggttgggatcactacaggaggctctacatggcatggtgcatgaacaacaacaagagtaaatttggctgactctgagcttgaggtaagctccttaaagtctctgtggagaaagagaggcccagagtgtgggctggagattaactgatcccagatgcaaagaaaattagaaaagcataggacatggtgcatttcttggataagctgaatgttgggcatttaaatggtatcatctgaggtgttgcagaagatatgattcctttatcaaatcaaatacaagtaaatggatatccctaaaatggtaacttaaagtaatgcgctaagacacttggcatccagag

SEQ ID NO: 635429 - DNA, 419 bp, Homo sapiens
ctttacttaaaaatgaggcagcagacttgatttgatccataggctataatttgctgattcctgttcaagaaaccaaacaaataaactgtttccaggaggaaagaattattgattgtatcaacttctgcttatttgtcaaaggtgaaactgaggaattgaccattagatttaacagcttggtagctgtattagtccattctcacactgttataaagaaatacctgagactgggtaatttacaaagaaaaaaggtttaattggttcacagttctgcaggctgtacaggaagcatagcagcttctgcttctggggaggcctcaggaagcttataatcatggcagaaggcaagggcaaacaaggttgtcttacatggccagagcaggagcaagagagagagtggggaggagccacacactttt

SEQ ID NO: 635430 - DNA, 852 bp, Homo sapiens
gttaatatatgctcacacctcatatctccctactatgcctagaacgagtaatactatcggtgtatcattatagctaactctcataaacctcataggacccactccctcttactcgcaatattgtgcctagttgccatactagatcatctgcctgctcatgctgcaaagtcatcgagtgtgtcgctagtcgccatacttaggtctcaaatcctcgctaaccgaccactacttggggcttgatagctagcggtagcaatacacacctaatagtctactccgacatgcgtatagaaactagatcggtcccagagcaagatcatacttacctagcgcagctgaagatgacttatccaatccaaaatcatcagtttgaattcaagagaaaccaaccccaagcagtgccgtaatctgattagctctcaatcccgtctattaattgtttcaaccaaaatcaagcatgctacctaatttaagctggttcctcaaactatttccgtccgaactccatagatcacaaccgcccatactgtcattcatataacgtaactcactaccattgccctatcactaatcatgcactaaggctcaaactcgcagcatattaatcacacagtgtagaccccactttggtcaacagtagacaaacaacaactcctcactcgtcttacgtgacttaccataggatactctcgcgtaactaaagtccttcctgtaaaatttgataattgttccctctgaccgcttgatactctgtccttttagtcatagtccttccgttcgaacttggtagtttaattcccgacctgggttttgatcgctccgtggaggccttgagctagagcgccttaaccg

SEQ ID NO: 635431 - DNA, 892 bp, Homo sapiens
ttactatgacagaccgtagaggttactcgcttgtctgtgtacatcatttctaaggatttcaatagtttagcttctatgtatgtgctgctaagagctttctccaggagagatatttgccctgtctgagcacactggtccagtcgtcccagtgggctgctcgttggtcgtcgtcccgagattagacctttgttgtgccgatggcgtcacacacatcgtaagtctgagtctgtctttgtccttcgttctgtatggcgagtctcccttggttcataaggaagctttctaaagcatactagagaagcctgcccagagccccgtcttgcttctcttccaggtgctctatcccctcgagaccctctggtgccaggcttgcttcacggtccatcttgtgttgtcactgcagagtttgcgaggccagttttccacagcctaaacagggaggagctgcagaagtggggctctggtctctgggcattcatttccctcatagaggctgagaataaagacaaggacttattcacacatgtgctagaaccccagaatggcccaagttacctgagaccagggtttctcaagcttggacaccattgacatttccggactgggtaatgactatggttcgtgcagaggcgtgatcctatggcacctgtacggagactctactgaaatataccgctggggctctacccaggtagtaacactaggcaactattacccaaccaggtggatttcggatattggtgaaatatccccatcgggtggcaacatgattccctgggtaagatttgtgggccaagaaatgttactgttccatgcccacattggagttgttcccttcgtttacccgtgaagatttcttaaagctctagaaacgggaaaggcacaatcacga

SEQ ID NO: 635432 - DNA, 216 bp, Homo sapiens
tctagaggtccctcataggtcgcaggctggtctcgaactcctgacctcaggtgatctgcccatctcgaccccccaaagtgctgggattacaggcgtgagctaccacgcccggctgaggatagacatttttaataggaaatctcattttgggctccctttagacttctcaagttccagtatgctactatagcctttcctcccgggcgaaccatatga

SEQ ID NO: 635433 - DNA, 1200 bp, Homo sapiens
ccacagctggcaaattcagtgcagatcagaatcaaactgcatggctgcaaggcgagtagacaggcatatggcacacagttttttgatgaccctttcagattctttctctggcaactgaaccagaggttcacaacaacaagtgtacgtaggttcgtttctgcgtcacatgcatcttggcactacaggtaagcttgcatttcatgccacagtgtttaaactgtacactgcccttcagcagtacttccagaatggtgagaaaaagacagcggaggatgctgatatggaactgacccagtcagcagcatgcagggtgcaaagcaacacaatggcaccaaagcaagcacactgcactgtcatcctgtcacagagcaagcaggcaggtcatcatcgcccgcaggcgccctctaggacccctacacaaaaccacagcccgcaattcctctctctttctactccacaccagtgcttcatctctgcctccaaagcacattgcattgagcactccaagcgcccctccaatcccagcctttccctctgccagcaacggcactcaaccacaaaatccggtacggaacatcttcatcccttgacccccccgcccgcaggccgccactcattctccacgctaactcaaacaccaaacctccggggtccacagcaagccacccaagccccaccaccacagctcctcctcccatcattcccgacacgccctgatcctcaccgcgaccccgacacgcaaccacaacgacccgccaccagcgccaacaggcccgcgagccctgacgcactcacccggccctgacacctgaaccgccctgacactggccggcccggcaaccaatccacaagcacccaccccccccgccacgcgccgcacccaccgaacgcacccaacagcccacgcaacacccccaccaccccaaccacgcacgcaaccgcccacacccctagcccccccacacaccccaccacaccagaccacacgccacaaacggaacaaacaggagcacacacggagaacagcaaccccgccacaggacacagaccctgtcacacacgaaagactgccaccccaacgccgacgacccaccacacacacgaaacacccccccacaccccccaccacacaccagaccacaacaaacacaacacacaacagacagatcaccccaccccaccgcgcgcaccaccaacacc

SEQ ID NO: 635434 - DNA, 163 bp, Homo sapiens
aatagtgatgctgactagaattgacctgcctgcatgaccacactttaccttgattgccaaaggtgaatcatacaaaacacaatatagagcaatgttagtaatgaatagaactattaacaagaggaggtacaaggtattaagccacgagaacaggaagaaaggc

SEQ ID NO: 635435 - DNA, 91 bp, Homo sapiens
  misc_feature (1)..(1): n is a, c, g, or t
nttcggcacaggtcgctttcgactctcactccaaagcagtagggccgcgttgctgctcactctctgcatagatggtctgcacctgggagat

SEQ ID NO: 635436 - DNA, 353 bp, Homo sapiens
cacttaagatccccaattcgtcttgcacaacgtgtcttttaaggtcagcctgataaggaaacagggatgcctggaagtgacagggggaccctttgtatgaagtaactttctaaagcccaggctgggacacattttgggggtggggagaaacttattctaaaacagtgctggcaggaatactgatgtgacttgacttgacttttgaaacctatctttttcttagacccctttaacaaccgtggtataaatgggcatcgctctgggtgaagctggaccggatggaaatatggtttacacacatgtgttcgctgaaaatggatacagaagtattgatagtttggaaacaatatgct

SEQ ID NO: 635437 - DNA, 273 bp, Homo sapiens
caaccaagctggaacattataactactgcagatatgtaaggcacaaaatgcgacttatacaaagtagacgatggaatcgcacgaattacccagcgccctctttattatattacagtgataccaaaccatccacttgcaaattcttaggtctcccatcagctggaattaagtaggtactgtgtatctttgagatcatgtatatgtctccacttaggtggatacaagacaggaaggcacgaacaagctgccaaagaagggtatcaaccagtgaaa

SEQ ID NO: 635438 - DNA, 272 bp, Homo sapiens
ttcacctcgcaggctcaagagatactcctgccttagcctcccaagtagctgggattaaaggcagctggcaacacacccacataatttttggtatttttagtagagacagggtttcaccactgttggtcaggctggtctcgaactcctgacctcaggtaatccacctgcctcagcctcccaaacggctgggattaacaggcataggccaccgcgccagctggtttagcttcttattgtttggtccatctgtggtatgtttattgacttgaggt

SEQ ID NO: 635439 - DNA, 160 bp, Homo sapiens
  misc_feature (12)..(12): n is a, c, g, or t
  misc_feature (111)..(112): n is a, c, g, or t
tgaggaaagacnagaggcttgcaaggccctgaagaggcgggagcatcatacagattcctttattagcccacattctgatgtccctggtgagacttgccccaagcaattgtnngtaaatgggggttaatttcttctccacctccctactgaacaaaaaaaa

SEQ ID NO: 635440 - DNA, 136 bp, Homo sapiens
  misc_feature (7)..(7): n is a, c, g, or t
cagtaantcgaggacaaggaatgttgctgatttctagttatttcactgtggtgaaggtcttcagctctaggaaagacagaggaagaaatgcaactttttgccactgctactgacctcccgatgattcccttcctct

SEQ ID NO: 635441 - DNA, 1417 bp, Homo sapiens
  misc_feature (645)..(645): n is a, c, g, or t
  misc_feature (676)..(677): n is a, c, g, or t
  misc_feature (681)..(681): n is a, c, g, or t
  misc_feature (689)..(689): n is a, c, g, or t
  misc_feature (691)..(691): n is a, c, g, or t
  misc_feature (695)..(696): n is a, c, g, or t
  misc_feature (703)..(703): n is a, c, g, or t
  misc_feature (706)..(706): n is a, c, g, or t
  misc_feature (708)..(708): n is a, c, g, or t
  misc_feature (712)..(714): n is a, c, g, or t
  misc_feature (719)..(719): n is a, c, g, or t
  misc_feature (721)..(721): n is a, c, g, or t
  misc_feature (730)..(730): n is a, c, g, or t
  misc_feature (734)..(734): n is a, c, g, or t
  misc_feature (739)..(739): n is a, c, g, or t
  misc_feature (860)..(860): n is a, c, g, or t
  misc_feature (872)..(872): n is a, c, g, or t
  misc_feature (914)..(914): n is a, c, g, or t
  misc_feature (936)..(937): n is a, c, g, or t
  misc_feature (1018)..(1018): n is a, c, g, or t
  misc_feature (1020)..(1020): n is a, c, g, or t
  misc_feature (1051)..(1051): n is a, c, g, or t
acaattagttccctgtaatgatttttttttgcgtatttatgtgtctctctcacaatatgttctgttgttggtgcgtcatttttcttttattgtacatttttgggtgttgataatcgttacaggaaattccttatatcatgttcctgcactggggattcctagtccttacaaaccatctaatctgtttataagcatgaacgagatgttacaactgtaacaacgtattcgcttttattacttacgagttgctgcaggcaaccttattgcaagcaggtaaatcattccgtcgccaatttcattcacctaatactgtgcatgaatttatctatagaattaaaatgatggcaaaacgtcacccaatgatgcaacatgtgtaatgctttcgagcctccctttctggttgaatctttgtttagtttgatgtgctcaatatgaggccaacgtaattacaaatgctggcagtccggtcatagtatgaaactaacaagccctactttataggtaagtttgctcaattttcaggctacctgaggccactgctgtgggactcgtcagtatgtgaatagagaaggattcacatacacttgacatatttcacatggtctgtaccttcatctgtctacttccagagtataacccgtggangatttgatgagggataaatgaacctatttcnnttgnacaacatnancaanncactttngcnanaagnnngtctngntatgtgtgnaaangatanttgtcaccaactcatttctttatggtccataatgaaataaaaattttgtatactgttaattctgtaaacagatgcatgttcaaaagatctatgatggtcttgtaatcttaatctaatatantttagatatttnaattttttccctcttggggaacacatttagtatagtgtaganaatacttccatgacattttcanntaaggttatataacttttcatacataaacatgaaatttgttgtagaaaattctttaaaccaaacatttaaatctaggactncnatttaatttgttccttgatctatttttatgnggcccttaaaaaatatccaaaaaacccattgctaatatagcaataaaaatactttgggtactgacagactctttggagtgtttatattacaaatttgtattcatattcttttctgtgatgtgtcgtactaaaatccaaaatggcttttgcaccatttttaagccaatttcttcctttgatgtggtaccagaattactattcagtgactgcctgcttcttgggggttaaaccactctcgcccggtgacccacctccccaccacgaaacaactacacttactccgactcacaccatttccacgacactagcgtcggcccagctacaccttccacctaccgttcctactcccgtgttacctcccgcaac

SEQ ID NO: 635442 - DNA, 241 bp, Homo sapiens
gccccaagtttttttttttggggcctttgttttataaaaacctggggtggggggggggccccaaactcccgccccctgaacccctccccattaaaagggggttggggtggggtccctttgggtcctgtcctgggaaaatcctttttttaaagagggcccccccaggggtttttaaattttctgaagtttttggggccattttggttgttggctaaatttcccaataaacttgtttttccca

SEQ ID NO: 635443 - DNA, 1118 bp, Homo sapiens
  misc_feature (645)..(645): n is a, c, g, or t
  misc_feature (676)..(677): n is a, c, g, or t
  misc_feature (681)..(681): n is a, c, g, or t
  misc_feature (689)..(689): n is a, c, g, or t
  misc_feature (691)..(691): n is a, c, g, or t
  misc_feature (695)..(696): n is a, c, g, or t
  misc_feature (703)..(703): n is a, c, g, or t
  misc_feature (706)..(706): n is a, c, g, or t
  misc_feature (708)..(708): n is a, c, g, or t
  misc_feature (712)..(714): n is a, c, g, or t
  misc_feature (719)..(719): n is a, c, g, or t
  misc_feature (721)..(721): n is a, c, g, or t
  misc_feature (730)..(730): n is a, c, g, or t
  misc_feature (734)..(734): n is a, c, g, or t
  misc_feature (739)..(739): n is a, c, g, or t
acaattagttccctgtaatgatttttttttgcgtatttatgtgtctctctcacaatatgttctgttgttggtgcgtcatttttcttttattgtacatttttgggtgttgataatcgttacaggaaattccttatatcatgttcctgcactggggattcctagtccttacaaaccatctaatctgtttataagcatgaacgagatgttacaactgtaacaacgtattcgcttttattacttacgagttgctgcaggcaaccttattgcaagcaggtaaatcattccgtcgccaatttcattcacctaatactgtgcatgaatttatctatagaattaaaatgatggcaaaacgtcacccaatgatgcaacatgtgtaatgctttcgagcctccctttctggttgaatctttgtttagtttgatgtgctcaatatgaggccaacgtaattacaaatgctggcagtccggtcatagtatgaaactaacaagccctactttataggtaagtttgctcaattttcaggctacctgaggccactgctgtgggactcgtcagtatgtgaatagagaaggattcacatacacttgacatatttcacatggtctgtaccttcatctgtctacttccagagtataacccgtggangatttgatgagggataaatgaacctatttcnnttgnacaacatnancaanncactttngcnanaagnnngtctngntatgtgtgnaaangatanttgtcaccaactcatttctttatggtccataatgaaataaaaattttgtatactgttaattctgtaaacagatgcatgttcaaaagatctatgatggtcttgtaatcttaatctaataggtctacccacacttaaagcatccttggatcgttcacccatgtaaggagtgtgcaataatcagttacagggcgtattcatataagggaaggaaaggttgggtacagaaagattgaatatggggtaggagactccttgccccacccggcaggattggagctgtccaaaagccatggcctttaagtcaattgtgaagtagccctttaaggagaggagaatgtgcgggtggcgtaatagcaataaacacgctccgggtgtcgcc

SEQ ID NO: 635444 - DNA, 320 bp, Homo sapiens
cggagggacgacgacaatagtgcagactcccgcctttggggaggtctggaccacccagtgcctccactgccaccttggcttggcacgggcgacctgtgtgtgtcgtcttagctttaaaacagtcacagttcttgctctatcatagatgaacaaatcctttcttgatcattctgtcagacccggcggttgagtcagcgatgatccacccgcctccctattcatccaccctgtatccagctgtacaccaagagccagctgctctgtcgacccttggatcccgccgtgggatccagcctttgttaacccgcgacatatcacca

SEQ ID NO: 635445 - DNA, 130 bp, Homo sapiens
tcccggtcatctgctacacaatgagttaagtaaggatttactctcagaaaaatctttatagttatcctaagaaggataattacagtagcctagcaaagatttatccaacattcctatatacatcatgcat

SEQ ID NO: 635446 - DNA, 287 bp, Homo sapiens
  misc_feature (13)..(13): n is a, c, g, or t
  misc_feature (236)..(236): n is a, c, g, or t
  misc_feature (242)..(242): n is a, c, g, or t
  misc_feature (250)..(250): n is a, c, g, or t
atttcggcacagnaaggatcttactctttctgtttaggatcaagctcaaatagttaagggttataaatgaggatgacgtggccggggcgcggtgactcacgcctgtaatcctagcactttgggaggccaaggcgggtggattgcctgagctcaggagtttcagaccagcctgggccacatggtgaaaccccgtctatactaaaatacgacaacaaaaaaaattaggccagggcgtngtggtnggcgcctnttagtcccagcttgaggcttgaggcaggagaactgct

SEQ ID NO: 635447 - DNA, 931 bp, Homo sapiens
ggaaaaaatggcttaggtcgaggcctggtttgaattgtcactgaggcggagactcgcgttatggcgccccgaacctcatctgctgctctcgttgagccctggccctaccgagacctggtgcctgctcccactccatatagggtatttctacacgcgccgtgtcccggcccggccgctgagagcccctgcttcatcgcagtgggctacgtggacgacacgcagttcgtgcggttctgacagcgacgccgcgagtacatggatggtgacgcctgcgcggcgccgtgttgtgtgttgctaggacgtgttggccgtgagttatttgggtacctggtggagactctgattgttcatagcgcctaggcacatgactgtacctgtagtgcagcctgtggaacgcttcgcgttgtactatcggatcggctaggatgcgtaaggccgtggtcttcacacgcctccaggtaggatgtataggcttgcgaaccctgggagcccgacgggctgccatcgctccggcgaggtatgacctatgttcgtccttatcgaacggcgcatcgattacgtctccgctttaacgatggacctgcggctcctttggatcgccgcggacacggcggctcagatcaccgcagcgcaatttggatgcggccgtgcgggggttgcagcagaagagtctaccttggagggtcgactctgcgttggagttcggtcctgtgatcccttggagaacgggaatgaagacgctgtcagcggcgcgtgaacacgctatagactacactgttgtaccacctattttgtctcttgaccattgagggtcgccctttggtggttggccctgggcttctaccctgcgggagatcaccccttagctcggcagcggcaggcgcggaccacactctagtaaccgcgcttttgtggaccacgccgcagcttg

SEQ ID NO: 635448 - DNA, 271 bp, Homo sapiens
tgaacggtttttttcattattaaagccaaattggggtggtatatattcgtataccaggggttagatggaagcatttcctatccagggctgaatacaaccgaacagtggtacgtaaattattataaagccgagtgatatttcagtggcaggttattctaccacagcggtgctgtgtgggtttttcccagtgacggtatggcttttatacaatgtacaacatcgttcctggcaatgtacgagacccttggttggcacagcattaaataaagaa

SEQ ID NO: 635449 - DNA, 1280 bp, Homo sapiens
ttaatccccttcgtgggcccctcaatctggagcggataaattcttggcgcttctccgggggttgtgctctaccgtactcggatcgctctcttaggagtatcctaatctgctcggtgggagagaactgtcgccctaaacctggggttccgatccaggaactgggaagttcgaacagcttggcgtgcctggctccatacgatcgtagcctttctccgactcaccgatctctatttcatgttctccaaggcattgtcgagtaggctttcagcgcccagaggtagagctgacatgcgccttgggctagctgcgctccggcacgtagctagagaccaataatgtccaccggcaggtctaatcaaagacttttgtcaatcattcactaataattacggtgagggtagtacctatatatatgttgttatgtttcatcctgtccttgttcaacacgtatgcatggtcaatatgtatgcacgtcatagaacgtgtatacatttcagggcagcgtataaaagtagggaacacgtacttttcccacctggccagtggaaatacttaccatgacattcttggctacttattgctttatattgccgaagtagattacgtcgatgcatttccaaaaatttcttgattgagacaaacctagctccgtggtaggggtttgcgcaatcagtaatgtgaacccttctaaatagtaccgtctaaattggcttaatgggcgcaagataggggtttggaatttgaatagccaaaagcagtatgtacctactttttgccgcgtcaataatcaactaccgcaagtccccttttgcccccggtggggtccccttgttctgaaccaacgatgacaccttcctcggtctattaacagttctccgaacatatggctcgacttgtcttggttgctttgttgaagcacccacaggcaccaaagggaaaaatcttggccttggatctaaatcccaatatccggggaataggaagccaccaaggccgatttggggtggaagacaaaccctagggggggacattattccctggaggcagcgtgttcttggcaggatcgtaaagagacaaagtggcacccgcaaagcaaaccaggtggtgtctacatttggcgcgtagacgggtgtagatataggcccattgctgtggggacacagttttcttaagtatactttccctcgaacataccgggaaaaaccagacaatttctgtaaacacctgttgtccctcatgggagcaacggcatgtaaggtcttcctgagattggatcccag

SEQ ID NO: 635450 - DNA, 109 bp, Homo sapiens
gatatgaaatctcactctttttgcccagggtgaagtgcagtgactgagatgggccactgcactccaccagcctggatgacagaacgaaactctgtctcaaaaaaaaaaa

SEQ ID NO: 635451 - DNA, 140 bp, Homo sapiens
tgtcaccattcggctcatggctcagtgcccaggtgcttgtgagtttactagaggtcccttgtgagattgggcctctgtttgggcctctgaaatctctgtctcagtgtagctttccatggtgcgtgtatagggtggtctcg

SEQ ID NO: 635452 - DNA, 151 bp, Homo sapiens
agtgtaacgacggccgtgtaaacgacggccagtgatacacgacggccagtgttaaacgacggccagtgttaaacgacgtgccagtgtaaacgacggccagtgtaaacgacggccagtgtcaactgacgtgccagtgtaaactgacggccag

SEQ ID NO: 635453 - DNA, 922 bp, Homo sapiens
catttacacgacatggtacccatagccatattaggtgcactatagcacagtgtgacacacaacaggtggtcccttcgtattccccgaattcatcgaaacacgcggttcgtccaacgtcgcagggtatttgtaggtgacgcacaacagctttgtgttatagaaagtttggtatagaaatgcaaagggtaaaattatctgttcgtatgccaactgttgcccgaagagtgtggtgtctgtcgatcgcttttgatattatagtgagcatccccgaaacacaatgtgtggcccctgagattgaaagggaaggatgggggcaacccacgcgaggtttagccccgtgagtgtctgtgtatggaatgtgccgattaagtgaatgctgagaggctataaagaagggcgcacggaaccactgggacacttgagcccttgaaattcccgcggtcttgggcgtcgggcttcagagtaacgctcactggcttagggttataagcgggcccgtttagttccaaatgccgctggctatgaccaatgcggggagaaccacccctggcacggtgctcctctccttggccaagtcactgtgagtatcccgagttctacgatggttaactgaaggattggctaatgttttgaaccccccgtgtgactgggtgtttttgtttgggggtgggtttggggttttgttgcgttttgaggtcctgaaggttacccgatatggactggctaatactcccttgttctgcttgttgtaatggtgaatgctttaagaaaaaaaagtgtaatttctaagaataattcatgatctggttatgcgatactcccttttgttaccatttttttaaaaaaactatttttgttaaagtaaagtaaatatttccgagccaattttttaaacttattgcactataccggctctgtacca

SEQ ID NO: 635454 - DNA, 577 bp, Homo sapiens
actttagtacttctggtccccagtaacggagagagaataaatctttcttgttttaaggctccaacaaattggtagtcacttgttacagcaaccacaggaaatgtatacagcttctgatacttctgaaaacctcacacagccaaagggtacatccttggtatagaggctcactcttactcaccagccaggcaaggaaggctcaatcctttggtgttagagagatagatgttgggttttcaaatttcaacatagagaaatcagtcatttgcaatgcttttgagaaagtactgtgtataccctacgagcctgcactccttatgtgtgagactgatgaccattggttggcttattatccattccactaagtgacaaaatcccactgactattcaaatccaggctcctggcatgcctgtaccttagaatcacaaccagctgcaattccaggatggagttcaaactaattgtgggggcatgtgcttcttacatgactgctagattgttcccagatggggaaggttgccctgataagcaacttaaatgaaaataataaatgtattgtttggcctctttaaacag

SEQ ID NO: 635455 - DNA, 422 bp, Homo sapiens
  misc_feature (301)..(301): n is a, c, g, or t
gtcgaccaaagagaaaaattcaataatccgaagtccaagtatcactgtcaatagtagttgataaattgtatgtcaatgcaacaagtgtaagaattagtgaatgttggctgggtgcagtggctcatgcctgtaatcccagcactttgggaggcctggacgaggcaggtagatcacgaggtcaggagatcaagaccatcctggctaacacggtgaaaccctgtctctactaaaaatacaaaaaaaattagccaggcgtggtggcgggcacctgtagtcccagctactggggaggctgaggcangagaatggcgtgaacccgggaggcggagcttgcagcgagcagagattgcaccactgcactccagccagggcgacagagcaagactccgtctcaaaaaaaaaaagaatcagtgaatgttgaa

SEQ ID NO: 635456 - DNA, 295 bp, Homo sapiens
  misc_feature (276)..(276): n is a, c, g, or t
tgctggtaacagtgaataagggccttgtgggtgggcaggacgtgtacttccacacgttgaatcccgtcgccgcgcgcgtgaggcaggcggcggccctgcgcatgcgcgagaagcacgtgcatccgctgagctacgacgaaattccagcgatatttcgcaaggccgtaatcgccaccgaggaccggcgcttctggtccgatcccggcatcgatccgattgggatcgctcgaagcgtcgtggtggacgtggagcgcgacggttacgtggaagccttantcactggtacgcagcaaca

SEQ ID NO: 635457 - DNA, 861 bp, Homo sapiens
gagccgagatccgagattgcaccactgcactccagcctgggtgacacattgagactcattctcaaaaaaaaaaaaaaaaaaaaaaatttttgggaaaagcccaagttccttttgggtgacctctccctggatggctattcctccttcttggtgtccttctccacacaccttggggggaacctctggtcctaatgccgtatgttttttataccaccaatggtcctatggcgtggtggttattttttttaactcttctcggggcctctttaacgtggtcactttatggttgctccattatacatcgggtcgaacacatttggtttcttaataacattggcgctctttttccaatggcacacaaataggcatttcgggcaacatttcactaagttaaatctcaagttattatcaatcaatcatggtcggtaaacgtccgttgggcgctataataaatctgggatacagaaggacactttatccacaaggggggtcgcgtcaaatccgggggaaagttcggtccagaacgtgttgtccccttctgtaccacacggtataatttacatattggtcgcatttttactctctggtaacattaaccggtacgggaattggcccccctttaaattttttcctggtcccccaggcgcctcccgtagagggttaattcatgggtcttccacgcatttaatagatcgccaaagggcctgcacgtggggggggacgcatataggcgaaacccggctggataataccccaagttgccttaagtgtgggaaaaacccccccttttttcacaaggtaagcgcaaggaattttatcttaatggccctacaagtttggggagctcctggccatttcaaa

SEQ ID NO: 635458 - DNA, 403 bp, Homo sapiens
gcttcgctcctggccaggatgcaggcagatttttagtgctgtggggctgctttctacccaggttgggagacaatcccttccatgttgaagaaccgagtccccggctcctgctgcatttatgtttgtgtgggctgtgggcttcctttcaacgagaaggcgatcctttaggagggctgtgtggccagcttgggggctggctgaggaaaaatgtgctggtggtagcttcagcggcccttggtcttgcttttctcccggttttgggggttgtctttgccccccgcctcgtgtagagtttccggagtggttttttggtgatgtaggggtctggtctcctcaagcctcctcatatgggggagtggaatagaatcctacaggtttttcaattaaaagaaatattttttca

SEQ ID NO: 635459 - DNA, 268 bp, Homo sapiens
tctaatttaattccttctggcattgtagagggcagactaagttcctaactagatgactcttaagcaatatttgaagttctgctatttatttgaaatttggacagaacaagtgagcatgccctttagaaaatttgtacctagaaatgtattccaatacttctatctggggatgccaacaaattcctcttacatattcactggacagtctgttatgtggaaaactcaggagatatgcagactaatatgtcaggattagaagcccgcttct

SEQ ID NO: 635460 - DNA, 858 bp, Homo sapiens
gacacggtctttgagctgagtcgaggtggacccttgtgaacgcagtcgccctacagccgctgattccccccgcatcgcctcccgtgaagcccaggccgcttcgcagttttctcccttgtggtctcaataaccaatgtccaccaacgagaatgctaatacaccagcttgcccgtccttcacagattcaagaccaggggacaggacagtacagacaatgagggtcgcagaatagaggtcaatgtggagctgaggaaacgctaagaaggatgacagatgctgaagaggcgccaatgtaagctcatttcctgatgatgctacttctccgctgcaggaaaaccgcaaacaaccagggcactgtaactgggtctgtgatgacgtggtcaaagggcataaatagcagcaatggtggcaaaatcagctccaagctactcaagctgccaggaaactactttccagagaaaaacagcccccatagacaacataatccgggctgttgatcccgacaattgtgtccttcttggggcagaaactgattgtagtccccattcccaggttttgaatctgctgtgggcacttcactaacatggttcctgcggacatcagaacaaacaccaaggtttgtggctagctgggggtgccatccccagcttcatttctctgtttggcatatcccccattgctccacctcagttggcacaagctggtctgggtccagacaacattcgcaagtgatgctccagggtcccgaggaactggtataaacgtaccgtgcagttgacccatggggggcccttggaggctggattggcatttacatggggcttagaactcacggccttttatttggccaaagatctc

SEQ ID NO: 635461 - DNA, 195 bp, Homo sapiens
gcgaacactctgaaccttccgcagtaccgggatccgtgccttcaccaactggcagcccttcatcctcaactacctcgagcaccccgtcacccaacgcctacacggagagcctgaacagcctgatccgggtgatgaaccgactggggcgtggctactcgttcgaggcactacgggccaagattctgttcaccgagc

SEQ ID NO: 635462 - DNA, 97 bp, Homo sapiens
acagggaccagggcaggggggccaaagactgatgccttcccattaggttccaacttcattcctgcttcccgtttaaccctaactttttcttttcggg

SEQ ID NO: 635463 - DNA, 453 bp, Homo sapiens
ggtcatgctgtatcaagaggatcccttcagcacattaagtacacactgatatctccaggctggacaatctgaccgggatgagaggtgatgacgagggttcggtggtcaagagtagatatgggcttctgggaagccacacagggcttcaacgagcggtatgtccatacacatgaaagggtctcctcctcgtcgagtaaaaacagcagggtccttctgatctaacacaaggataatatcgccgggctccagtccgggtcctgggtctccttcaacagggaatgtaatcttcgggccatctttcatgccttggtcaatatgaacttctaaaattttcttctctcgaactatcttccttccgtggcagcttttacatctatcttaaggacggatcggctccccagggcccgggcactccaggcacacagactaaaggtgcggaagggtaccggagct

SEQ ID NO: 635464 - DNA, 347 bp, Homo sapiens
  misc_feature (308)..(308): n is a, c, g, or t
gccaagagtcaggccctggggatttagaaatgggcatgacatggtaactgacctctctgcaagctcacactaatgtaatgtgataagtactttgccagcagtgtgactaaagctctgtgggaccacaggtggcagtgtgtccgctgagttgtgcacacacattagcagtgggttaaaaggaggtttatggaaagacttggtagaagctgtcttgaggttaggcttgagggccacataggtacagaaaggactgccaccttctgaggcctgagagcatgctgagactcttcagaagcttgagcactaantatttgtctcctttcacaaacgtactttccctcaaacac

SEQ ID NO: 635465 - DNA, 166 bp, Homo sapiens
aattcttattcctttgtcgttccccaccgcctattaggccttcttgttataaaattttctcctctgctctccctctctcacgtttatactccccctttatctattgtgtccactccgtgggcctgttttgtgcggaaaaccttcctactctttctgggcctctccg

SEQ ID NO: 635466 - DNA, 372 bp, Homo sapiens
  misc_feature (71)..(71): n is a, c, g, or t
ggtgtagttacatttttaaacatcagattacaaaacaatatgagaagcccatctccaggtggttgtccagngaaagttggcaactttcactgtgggaaattttcacttaaaaataggtcgaagttaagctgggagtggtggctcacgcctgtaatcccagcactgtgggaggcctaggtgggtggatcacctgaggccaggagttcgagaccagcctggccaacatggcgaaaccccatctctattaaaaatacaaaaaaaaaaatgggctgggcgtgggggcaggtgccggtaatcccagctactggggaggctgaggcaggagaatcactcaaaccggggaaggggaggtggcagtgagccaggatggca

SEQ ID NO: 635467 - DNA, 127 bp, Homo sapiens
ggaggcgaggacaaactcaggacaccgagctggtccagacagcacagcaggagacagaaccttcagaagtgggcagctgtggtggtgcttctggagaagagcagagatacacatgccatgtactgca

SEQ ID NO: 635468 - DNA, 480 bp, Homo sapiens
gtaaaatgatgcccggtgcacttcgaaacttagcaaaggcgagccagccacagagcataacactgtggctgagacacatgtccatgtgtggttcacgtacgtgggcatctgtgccacaagggtcatgtggcaccacagttcatcagctgtgtttccccttcctgccctgctgcagcgccacaggttggaggaaaagcctgcctgtgagcagggtcccggcagggcccacccacccaacagtggagatcgggcctcagagctgggcagtcatgggagttcagggcctggctcgcctcggcagcctggtcttaaagagggacttgcccgaggcctcgatgtaagtgacagtcatctctttggagctgatctccacataggcaaagccacccagtgagtcttcagtcccatagtggaagcgcagatagccggtggggaccttgcgctggtgccgctttgaggggtccatgaaaattccagccc

SEQ ID NO: 635469 - DNA, 175 bp, Homo sapiens
catcttccgaaacagcctctcattaggagatggtgtttgaggtggcagtaagtatcagctggcaggggatgcatgtcatttcccgcttgaaatccaagaacgagaaagaagggagaggcatgatttggtggaacagttacatgtttcccctttcctcctttctccaattaataat

SEQ ID NO: 635470 - DNA, 358 bp, Homo sapiens
gtaacttctctgccatctatactcatactggatcacgcatctacgatagaagatagcggctcaggtccacgccatggaggcagcgtccatctccacattgatactcaccacccacctggcctcgcagggcgttcatctcctcctacgtggtacttacttcaggtaggccagctcctccttgaggttctcaatctgcatctccaggtcggctctggccaaggtcagctcatccagaaccctgcgcaggccatatgatgtcggcctccacactcaggcgcagggcctgctctgtctcaaacttggtgcggaagtccatcagcggccagacgggcattgtcaatctgtagcaggatgtgtg

SEQ ID NO: 635471 - DNA, 471 bp, Homo sapiens
aagcaaatccccaactgccgttcccctccatgggtaattcttagggtctgggaggtgagctcgcccgccgaggcagaactaagcgagtcgcctggagaggcgtgaagggagcctgcacgtgtcccccgcggcttccccaccgccccaagagcggggcatgtacgagaccgcgctgtggggttcagatttaggaaggacgaccgcgtcgccctgcctccctccctcgcccagagccgggagcaatgctggggcacgaaagaggacttgggaaggatccggtccttactttccccgcgggtcccggacccgcagcccccgggttgtgaggcggaagccaaaggggcgaacccagcggagccggcgtgcacagaccctgccccgcggtccaagaggggtgcctccggcccgggacagcggggctcccggagcccgaaagccccacgagcggcgacagcggggcccggcgctgac

SEQ ID NO: 635472 - DNA, 667 bp, Homo sapiens
aaactgtttggatgttccttcccgtttcaatgtatctatattttttcagccctcaaggttattataaatgtcattataataacttcataaagcttcccctataatgagaatcttaccattctcctaactccaatagcactgtaatccacctctgttaggacacatcactcttcatcatgtgtgattattatttgcagatatcatcttcaaggctcttctctatttaccacctgccattcttgttctcacctctacatgaccttcacattttatttctctcggttttttggacaagctgcattcccttccacagagaaggcttccctgacccctttcacttggttggattaccttgctattcttttctatctttgtacattccttttcaaaatacttatctcccttgttgttacttataatgtctgtcttctttactcaagagtctagacaaaaagctccacgccagcctcggctgtgtttgtattgtttacgtctgtgttcctagtgcttaataaaatacctagcaagggttaataagtacttgttgactggaagggaatgacttccttcccttactagagagtgatttccttacaggcgagatgtgtcaaccttctatagcccacataaaataaaggacaatatctcctattgaataaaagacaaa

SEQ ID NO: 635473 - DNA, 360 bp, Homo sapiens
  misc_feature (355)..(355): n is a, c, g, or t
acttagacagaaaaagggagcagcaggcagagcccaccaggttccctgagaatagaggaggaggattgaaggcactgacgcggggcctggagctcacggacctcagtgcagcctgctgcccctacaccgctctggtggggctggtgggggagacgcccgcttccccatggcactgagtgtggcggcggcccatggcttttcctaacaaaggcctgggcagccttcctgggaggaggagagcctactcattggtcaggggcgggtgctgggcccatcaccctcactagctatgtggccgtggctgactgagcactgagtacacgtgggccacacggctgagatgctcaaagaaggngagga

SEQ ID NO: 635474 - DNA, 300 bp, Homo sapiens
  misc_feature (44)..(44): n is a, c, g, or t
ctgagcagaagcacttcagcctcgtctggcatttgatgaatttnattaatgtgtgctatggtaagtctattcccctgtataattttatgggagaggccatgtgcaagtctgaatttaaaaaaaaagaaaagaaaaagccttgtgcagaattattacctactcaatacattatatatatgccagagatggctaaagcagctatatgtcaaggtctgcaaaaacatgaagaagctggcatggaaattaacacgttggtggtctgcaatgtgttcaaagttggtgtttttaatgacacttaaa

SEQ ID NO: 635475 - DNA, 434 bp, Homo sapiens
atgcagggaggggcttttttttgagcctccttcatttgcccaaagacaaatcctcaaaaggaaattcaatcatcatgaatcccaaccccaagtatttcatcagccagggaagagtaagtgggatcccagggaaggatgttggcagcgaccccatcccaaacaggctcttacctcttttcctgaggggtgctccagacaacatttattacccaaaagaccttttgtttgaaaaccagccaagctttattcaggacccactttttgccttccctttcccccttccggggccccccccatgcaaaagccctaagcccccattctttcgatagctcccggtggggcatgagggtccatcatttgactcttttcggagtttcatattttgtgggactcctgggcaaacatatgttattaaaatttttttccccctgtta

SEQ ID NO: 635476 - DNA, 424 bp, Homo sapiens
ggtagcgctcgggttaaatcaaggtcagagtgctgctttctcctggaggctctggggcaagggggtccatttccttgccttttccagcttccggaggctgcccacattcctggctgatggtcccttcctccattttcttttcttttttttcttttgagacagagtcttgctgtggagcccaggctggagtgcagtggagtgatctcggctcactgcaagctctccctcccaggttcaagagattctcatgcctcagctggggtcacaggtgcctgccaccatgacctgctaatttttgtatttttagtagaaacggggtttcaccatgttggccgggctggcctcgaactcctgaccccaggtgatccacctaccttggcctcccaaagtgctgggattacaggcgtgagccaccgagcctggc

SEQ ID NO: 635477 - DNA, 783 bp, Homo sapiens
tactaggctctctgctctacagaaggttctgccgagtacccccagctactgggtacccggctactagcatcgcgtcgccatgatggggcatcgtccagtgctcgatgcatcagccagaacacaaagcgtgaatccggaagaaaagttcaatactggaaacatcaatgctgccaagactattgcaagatatcatccgaacaatgtaatgggaaccaaagatcacatgactgaagatgctattctgggagccaactgggacggccattgtgattgacccaaatgatggcacatgcccaatactatcagaagaggattcaagtacaagacatacaaaagggacaagatcacatagaatcggcaaatatagacgtgaaaaccccaggaatgaaaacacgagtagggaagactgaggaaccacaaatcacaataaacttcattcaattgacaaggagcaacactgcataacattagaaacatgacaaacctatatacttgtgaacacaaacgaaatataaccaccaacacaggagaggtgaatacacaagtggataacacgcagaagaagacaagggagagaacaaaaaataacaacaaaaaaaaaccgctaaataagcacaaaaataaaagaaataacgccaacagcaacataacgaaaagaacaagaaaacaaataaagatcaatggagaaaacccaacaaaacaaaaaggaaacaaatttacaataacaacaaaagacaacaagaaacacagaacaacccaaaagagcaaccaagacaatagccc

SEQ ID NO: 635478 - DNA, 347 bp, Homo sapiens
  misc_feature (140)..(140): n is a, c, g, or t
  misc_feature (306)..(306): n is a, c, g, or t
aaaccatcctcgcatccccagaataaatcccacttggtcattgggaaatatccttttatgtgctgctgaattcagtttgctagtattttgttgaagatttttgcatctgtgttcataaaggatattggcctgtaattttnttttcttgtggtgtccttgtctggctttggtttcagggtaatgctggccttgtaaaatgagtttggaaatattccttcctcttcaagtgttgggaagagtttgagaaggattgcattagttcttctttaaatgtttggtagaattcatctgtgactttatcaggtnctgagtttctttaaatgggagactttttaaagttactaatt

SEQ ID NO: 635479 - DNA, 858 bp, Homo sapiens
  misc_feature (198)..(198): n is a, c, g, or t
  misc_feature (246)..(246): n is a, c, g, or t
ccctttttctcccaaagacggggcggtcagtccggttgtgggggggggggggttaattcccagggcccctttcccttggctttttgtgccctataccagttgccaaaaagggtgggcgggtcggattccgggatatgggcccgggtgcggtccctccggggaagggcccccccccccccccgtgggttttgtaggggnatttttctcaccccacccaagctggggtgttggattcccgggggaacnccccggtggtgcccccccccctttgggggggggggggccctcccatatccgtgtggttggaaatattccccccgaggaggggtgtaccctccccgcggggggccccccccccccaaaccctcaattgggggggggggggccctttttatttccccccccccaaatttttttggcgcttggggggttttgtttggggggctttttcccccggggggcgccttttttcccctcccgggggggaaaagggggccccccccccccccccaaaaattttttaaagggggtggggttccccttttttggacccccgggtgggccccccccaaatttccccccgccggggggggcccggcccccccaggaaaaaggtcccccggggggggttcccccccccccggggttttcctttttttccccccccccgggggggggggggggttttttttttccccctccccccagcccccccccgggggggggcccggggggttttcccgggcccccggggggttttttttttttttttccccccgcgggccccgggggggcccctgaacccccccccccccttttggggttttttttctttttttacccggtcccggggtttta

SEQ ID NO: 635480 - DNA, 143 bp, Homo sapiens
tcggcctcctttaatcaagcagcggagaaggaatgtgaccagctaggtctggagtttcagcattggacactgagccaagcagacaacgcaaagcaagccaggacacaccatcctgcccaggcccagatatctctccatgacct

SEQ ID NO: 635481 - DNA, 933 bp, Homo sapiens
gtgccaagggggcaatggtggcttcctgtgttctactgggacactggggcaagtagagatgcctctgaatggtctggtgtacctggaagatgtgagcctggtcaggtaaaagtcagctgtcaagtatgcccattacggtggtaggctactcgccacattggtgtgctagctcatcttcaatgcataacatgtagccatgagcaattagcgcgtgcaggcccctaataggaaggtgcaccgtgtggcaccaaggaccaggcaggctgccttccgggcaggtagctagtattcgttgcactatcacaagcttgttggtagacaccaaagcaaacaccaccgtaggaatttggcagcctgctcctccgggaagactctggactgtacctccaaggtggcagcttatcgtggatcctgggtacccgtgatgcaacctggcctgtaatggcctatctggaagccgcggcgaatgcatcaaatcccacttatcaccccaaaagtacattgtctcgcattcggggtacttactgattgccgtaacgtacctttcctacaccctattttatcaaaggcatggaatttgggtacagtggctctgtgcaggtcgctggttggggcttaagggcactggctgcagtgcgctgggctcttgtccaatatttcacatcagtcagcgccaagaattgacgagagatttctcaggtgtgtgcccatccgttgccgatcccatggctgtcttttgcatgtggtgtggaattgcctctcacattacttttgtggttccttaaactgacgtctacgttggccccatcatgtaccatcgccctcgtgggccttgggggggtcaacgtggtcttattagacccatttgggggcttcctgctggactccgtggcctgggggggtggatccctgcgtgaagggctcgttccggct

SEQ ID NO: 635482 - DNA, 151 bp, Homo sapiens
tacctctgaaggacatctttactatcttccaagagttttctgaacccaattggaagccattcctgggccggtaggcaactactgatttgctttgtctatagattaaccttttctgaacatttcatttaaccggattcttccattttgtagc

SEQ ID NO: 635483 - DNA, 165 bp, Homo sapiens
  misc_feature (2)..(2): n is a, c, g, or t
gnctatgatgctcccgtcgtggctttgtggtagcaaatctgactagcatcatgaggacacaggttcgagcccgtggcttgctaagtgggttaaggatccagcattgccatgagcgtgtggtgtaggtcacagacacaactcagctctagtgtggctgtggtgtag

SEQ ID NO: 635484 - DNA, 103 bp, Homo sapiens
gtcaattgtgcatcgatggcccagcggcttactgctttaatggaatttgtttgaggcgacatgatcatgtgttaagcattatgatggaatgtgtcctctatga

SEQ ID NO: 635485 - DNA, 850 bp, Homo sapiens
  misc_feature (53)..(53): n is a, c, g, or t
  misc_feature (127)..(127): n is a, c, g, or t
  misc_feature (237)..(237): n is a, c, g, or t
  misc_feature (546)..(546): n is a, c, g, or t
  misc_feature (555)..(555): n is a, c, g, or t
  misc_feature (570)..(570): n is a, c, g, or t
  misc_feature (576)..(576): n is a, c, g, or t
  misc_feature (584)..(584): n is a, c, g, or t
  misc_feature (591)..(592): n is a, c, g, or t
  misc_feature (595)..(595): n is a, c, g, or t
  misc_feature (601)..(601): n is a, c, g, or t
  misc_feature (607)..(608): n is a, c, g, or t
  misc_feature (626)..(626): n is a, c, g, or t
  misc_feature (630)..(630): n is a, c, g, or t
  misc_feature (637)..(637): n is a, c, g, or t
  misc_feature (641)..(641): n is a, c, g, or t
  misc_feature (648)..(648): n is a, c, g, or t
  misc_feature (667)..(667): n is a, c, g, or t
  misc_feature (669)..(669): n is a, c, g, or t
  misc_feature (671)..(671): n is a, c, g, or t
  misc_feature (674)..(674): n is a, c, g, or t
  misc_feature (679)..(679): n is a, c, g, or t
  misc_feature (686)..(686): n is a, c, g, or t
aggccacttccggcgtagccatggcggtaacgctactaccaacccgtcgcagntgctgccgttagagcttgtggacaaatgtataggatcaagaattcacatcgtgatgaagagtgataaggaaatngttggtactcttctaggatttgatgactttgtcaatatggtactggaagatgtcactgagtttgaaatcacaccagaaggaagaaggattactaaattagatcagatttntgctaaatggaaataatataacaatgctggttcctgaggagaaggacctgaagtgtgaatgagtttcctgtgactaacactagatttgtttggcttataatgacaagaaaatggaattttttttcccactttctaatgtttaaatcccataaagctaagtttcccgtaaagggacagtgctttgaagatgcgtaccccattttgtgtaagtaactcatgattatcctggaaaaagaagaaaagagcttcttcttgcagatgaaaatacgggtgtttggttaactgtcatttgttatctactgcagtagncagggcacnaagttgtagttattngcactnacttctgncatatannctnatggtngtcatnncgtgaccattgatctcancaangtgtccnaccnaatgtgnacttgtttgacggtgtttnancnacnggaangtccctngaaatcataaagggtgtgtggaggagggatttgggtaatcctgagtccttgaaaacaagttgggtattgtgctttcagcgactcttgggtgaccgcgaaagattgtaatgcgagaccagatttggggaagggggaaaaaccggtttgtccaacttgcctctgcc

SEQ ID NO: 635486 - DNA, 133 bp, Homo sapiens
ccctccctcttcaggtctacattgcaactgtgaggaggggacgattcacgtgtggtgggggactgagtgtgtgcaggactcccaagcagtgacgggtctcgtctcttcgctcttgtgctcgttgctgtgggct

SEQ ID NO: 635487 - DNA, 619 bp, Homo sapiens
  misc_feature (53)..(53): n is a, c, g, or t
  misc_feature (127)..(127): n is a, c, g, or t
  misc_feature (237)..(237): n is a, c, g, or t
aggccacttccggcgtagccatggcggtaacgctactaccaacccgtcgcagntgctgccgttagagcttgtggacaaatgtataggatcaagaattcacatcgtgatgaagagtgataaggaaatngttggtactcttctaggatttgatgactttgtcaatatggtactggaagatgtcactgagtttgaaatcacaccagaaggaagaaggattactaaattagatcagatttntgctaaatggaaataatataacaatgctggttcctgaggagaaggacctgaagtgtgaatgagtttcctgtgactaacactagatttgtttggcttataatgacaagaaaatggaattttttttcccactttctaatgtttaaatcccataaagctaagtttcccgtaaagggacagtgctttgaagatgcgtaccccattttgtgtaagtaactcatgattatcctggaaaaagaagaaaagagcttcttcttgcagatgcgcctgctcggcccatccaacttttgactggagcaggtttttccttgccgccccgaatttgagcttcatttggccctttcccctattgtgggtcctattacaattcccgtcgcggcgttcg

SEQ ID NO: 635488 - DNA, 344 bp, Homo sapiens
ccgttactgggaggaattgaaagccttctgtgtatctgccgcgggataatggttattgtgtaaacatctctcgaaagctcacagctgaatgtcctcggtccgagctgggtcaaattgctcctacgggaaatgggtcccaacacagcagtttggtgtgggtttgcagtgctatgggaagcagcggatgatacccccacccctccaggagcaggagaggcgaaagcagctgcggacacgcgggggtccctacctttccttactctgtccggggttttgaggacgtgggcgcggccgagtggagaggaattagactctgacctgtgagctcgacaggagtatatgga

SEQ ID NO: 635489 - DNA, 1304 bp, Homo sapiens
cctgcgcggacgccggtgctgccaacggaagggcgggctctgctgccatgaaggtgaagattaaggtgctggaacggcgtgtccacttggttctgggtggccaacgatgagaactgtggtcatctgcaggatggcattataacggatgctgtcctgacgtgcaatgtgcccggtcgacgattgcccgcgtggctgtggggccagtggctcccacgtgtgttccacatgctttgtagtccatcgaagtggctgcacgcacaggaggtgcatgcagcactgcccctatgtgccgtcaggaatggaagttcagaggagtgacggcccgatcctggctctcggcgtgtgaggaggcatcctgagacatccttgcctcatggctggcgccgatggctgctgcggtgacatgcgccccgtgagctgcaatcaagggttgagaacactagtgggctgagatgctgcagttagtgtgagccaatcacgtattgtttgacaggtttgagtcgcgaaataaggttgatgaacctcattgaaatctagtacatagatgttgaaagaatgagagtagtaaacaaagagggtgggagggagtgctacacggaatgtaattccgcccacatgaagaggtggacgcctaaaggtagtgcactggcgtaattcgcccacacgcttttacattggtgagtttcatacagccacggtgtgtgttccccccccttaaattaaggcgagagattgatcagcataatttccaggagagacctcaaagaggggaccaaggagtggacgccggaccgagttgataaaacacaatgggtgttagcaatgcaacgctaggtggagacaaaaagacggtcggtgacaaagggcatgaggggcggacaactgccattgtggggacgtagaacgtgggagaagacccgtttagaaaataagtcaggagttggagtggtggttgaggcaacgattaagtatgtggtgcaaccaaataggcatatagactgccgttttacaggagagcaaaattttttaagaagaagaaggctcagctagaggggggttgaagtgatattatttgcacagaaaatgtttagaaaagagagggagggttaaatttaacagggggtgataatgtaaaaaaggatagcaggcggctgtgaaatttaattgtctgatgttgctcaagggcgacttgtggaggagacagagatatagtggcgcctatacacgaggacagttattatgaaaggaatgaggaacaaagacatgatttaatttacccccgggggagcctaggggtgtgaaaa

SEQ ID NO: 635490 - DNA, 593 bp, Homo sapiens
  misc_feature (397)..(397): n is a, c, g, or t
  misc_feature (495)..(495): n is a, c, g, or t
  misc_feature (562)..(562): n is a, c, g, or t
aattccgccagcgtggctggaaatgcgcactgcagcggtgctttccagcgaaccaagagaaaataaaccttgcggctcatcgccagcgacaacgctccgcgcttcatccactaacgcgagaatttgttggctatagcgtaaaaagttatgcccggcaggagagagacgtaaacgctgattctcgcgaataaacagatcaacccccagttctgtttccagctggcgcagacgggtagtgagattcgacggcacgcgatgcacttttgctgcagcctgggttagctgccagcttcgggcaaccgcgttgaacatctccagttgggtcagatccatagcattctcgatcgtgaataatggcttaatattatcatttaaagcaagagtaaatcgcgtatcntcataccatgactcataaaggagataccccgatgaccatactccggcaactcatgcatttcgataaatcctgccacggtgaacaactttctgtgctgncgtgggctggcgctgacgatatcgagcacttcagctggcgcagcaggctttcgcgactgggcgaganaatatagatatcgtgcgatgcggattcggtg

SEQ ID NO: 635491 - DNA, 226 bp, Homo sapiens
tcggaggaggactgaagctttgcaatacaaggttatctgccagcaagaatttggtctccattgacttggtggactcttttttcttctgcatgtatttaagaatttccaaagtatgtttaatcacaggaatctgaccttatagccttcttttcttttgagcaaggttgagttccataaacttatacttcttgtactgttcatccagcttctttaatacgtgtatctt

SEQ ID NO: 635492 - DNA, 317 bp, Homo sapiens
atttcaagaggatcccccctcgaaaccagtttatgtggccagtatttaaattttgcagttctatttacattcccgatgtaatcactttcagtaattctctataggctaagctgttaagatttccatttttatacaatatagcagagatattttgttctctttctttcttactttctttctttctttctttcggttctttcttgctattctttctctctttccttgccttccttgcctgcttgcttgcttccttgtctgtctgtctgtgtgagacaagagtattcgctcttgaacccaaaggctggagtaggagtagg

SEQ ID NO: 635493 - DNA, 773 bp, Homo sapiens
  misc_feature (144)..(144): n is a, c, g, or t
  misc_feature (155)..(155): n is a, c, g, or t
  misc_feature (158)..(158): n is a, c, g, or t
  misc_feature (194)..(194): n is a, c, g, or t
  misc_feature (247)..(247): n is a, c, g, or t
  misc_feature (253)..(254): n is a, c, g, or t
  misc_feature (257)..(257): n is a, c, g, or t
  misc_feature (285)..(285): n is a, c, g, or t
  misc_feature (307)..(307): n is a, c, g, or t
  misc_feature (336)..(336): n is a, c, g, or t
  misc_feature (348)..(348): n is a, c, g, or t
  misc_feature (352)..(352): n is a, c, g, or t
  misc_feature (361)..(361): n is a, c, g, or t
  misc_feature (380)..(380): n is a, c, g, or t
  misc_feature (435)..(435): n is a, c, g, or t
  misc_feature (537)..(537): n is a, c, g, or t
  misc_feature (566)..(566): n is a, c, g, or t
  misc_feature (570)..(570): n is a, c, g, or t
  misc_feature (624)..(624): n is a, c, g, or t
  misc_feature (643)..(643): n is a, c, g, or t
  misc_feature (650)..(650): n is a, c, g, or t
  misc_feature (670)..(670): n is a, c, g, or t
  misc_feature (712)..(712): n is a, c, g, or t
  misc_feature (752)..(752): n is a, c, g, or t
atccgcggctctctttatcttgtgggcttccctggcctccgaacgtaaggctggtgaagggggctcttgggtggtctgtaaaccgcggactaattggaaatggtttcacaacacgcagtgtcttcggggtgatcccattaaaanaataatgccancantgtctcctaaaatggaaaaaagaaaaattgtaaaanagctgaaaaaaaaaagtaaaacggtaaatgctggaaatgcatatatgtaaaantaaaannaanaaaactgtggttgccttaaatgcaaatnataatggaatcttggccaaaancgtggttaaaaaaaaaaataaaaaaaaanggctaagttcantaantggtttaanaataaaaaaaagaaaaaantgaaaacattttaaaaatcccaaaaacataagtcctccaccaccaatttcaaaancttcagagcctcgcgcctcaccagaaccacagatttccatccctgtcaagaaggaacacatacccgggacactacggttccgtttaagtccagctgcccgcnatattctggaaaaacactcactggatgcnagcnagggcacagccactggccctcgggggatattcactaaagaggatgctctcaaanttgtccagttgaaacaaangggcaanattaccgagtccagaccaantccagccccacagccactcccacagcaccttcgcccctacangccacagctggaccatcttatccccggcctgtgatcccancaatatcaaatcctggacaaa

SEQ ID NO: 635494 - DNA, 142 bp, Homo sapiens
cccaggtcgttgtagtgagctgagatcgcaccactgcactctagccttggaaccagtgcaagactgtctcaaaaacagcaacagagagcaggacgtgacacttctacctgctcactcagaatcatttctgcaccaaccatgg

SEQ ID NO: 635495 - DNA, 246 bp, Homo sapiens
aaatggagtttcgctcttgtagcccaggctggagtacagtggtgtgatctcggctcactgcaacctacccctcccaggttcaagcgattctcctggggggcaaaaactgcattgagccaagattgcaccactgcaccccaaactgggtgacaaaaagaaactatgtctcatagaaaattatgcaaatacttaatatctaaagatccttttcaaaatgaaaaaaattaaatttaattaatcaaataa

SEQ ID NO: 635496 - DNA, 111 bp, Homo sapiens
gaggtcttcttctcagaaacctactacaaatggacaaagatgtgacaaaaacagctgtttcgaacactgtagatactactactgtcaaaattcacagtgagaacgtcgatt

SEQ ID NO: 635497 - DNA, 506 bp, Homo sapiens
tcgacccacgcgtccggagcgggcaggactcctccagcaccatcacacccagtggcccgagacccctctgagaacagtgaggctggtcctcgtgccgttccagccggtgcccggccagtggggaggacacagcctaggaaccagctgcctgagaccaggtgcctctgggctgtcctcccgcgtggcggagaccccaagcacgcagcacccatttccggagctgcaggatagagcttcctcttgatctctgtttttaagcagaaattcattgtgcagacaaagtccctccaagaagcctcgtggtgggccaccggcttcggggatccggcttgggacccaccatggcctgggctggatcccgtgcccacgtggggcaggcccacatctaacccccacaagtcactgcctcactggcaccttgccaagggtctgcccttgtgctgctgagttccctgggcgagtcacacttccacggggaaggtttcccttgggggaaagaacaacgg

SEQ ID NO: 635498 - DNA, 353 bp, Homo sapiens
tgcctgctgtcacaattaagaagttagatttaaagttcacatgcctggtacgaggaaattagagattctttgctctctggtcatcatcaagattgttctgcagaaagacaaaagccaggagatcttgtctgtatatggggtaaggtctcccaggtcataaagagacgtttacagaagaggtggataagggctcaaagctacttccgaaacagttattgttcagtgaatatgtgctttggcctgctcactgggccatgcagtttgcagggatcattgcgtctctcaataccatgaccctgtgagatactattgctttccccctgtgccgtaaggaaaccagggctcagagagtt

SEQ ID NO: 635499 - DNA, 198 bp, Homo sapiens
tgcgttgacactgcacatactctgggcacagtgctacacgtccgcttgtttaacgtggtggaattaccccgcttatgggtggacaattcccatgtggtaccaacgcttgtctttggcgtcttctgggaagagaagtccgatcacgacaataatttgtgcccacgtatacaatgccccttggggcctgaccttttcacg

SEQ ID NO: 635500 - DNA, 1657 bp, Homo sapiens
  misc_feature (134)..(134): n is a, c, g, or t
gttgtctgactctcgccggttttttggtctaggccccgcgggggctgtggatcaccatgttttgccaacgggggtacctctcttggccatctgttgagcgcacttttgttggtgcacccctctgtgtggacagngttgtgtgtccccaagaaactccggtgctggtgtttccgctgctcggggatttttcgccgggggtaagaaaccatcgtgtcggtggtatgttgtgtcccacccacacttcgccccggcggggtctgttgacctgccgctcgctagaggaccggctgctattgtagctacacctattttgttacaacgtgctgtcaagtggtggtccacacagccggggggtgtattgtaagtcatacgccagccacgcccccgtctggggtgttttactcacacaaggcggctgtgtggggggacagacgattgctcgcgcaactaaccgttgtagtcagtctctacacttctgtggggggagcaccatactacacagaccgagtagtttgtgttggggcaatcccacaataggggaggcacaggctttggtgccttgagtaagcaagtaacactccagtgggcgtggacccgacgccgtgttggggcggaaagtaggcttcgttgttcttcgcctgcagtggtggtgttatactcgctacggctcgggctgtccctcttcccgaggtggtttcttctttcggcaggacagagatttttttcgctgggcgcttcgcccacattgtcacgggtgaaatacaattatgtgcccgctcgcgctgtgacccacgattttgtgtggagcgttccccagcgctctttgtgtggtctcaggcgggccagacgcatatatgttgtcgtgcgggttcccacacccctggggcgggcacgagcgacagcgccttcaatgatggtggttgtctggggtttttttctgctgccggtggatgggtcgcccctacactgtggttgacctgtctctttaggggtctgatgcgcccagagaggggtgccccccccttctggggtttcacatctgtggggtctcgcgcgccccctctcctcttggggagaggggatctttcttggagcgcctcacacagatgagcgccacacacactgtgggggggtgtgtcttctaaataaagagtgaagactgttttatctcctcgggggggacgcccggtgacaccagaatgcgccgctgtgtgatagcgcaagtattattcgcatgccgccgctttctatatgagcgcgggagggttgtgagggaacacccaccacacacacaccctcgccaagactctagagcctcacactcactcataggctacgtcccggggccgcaccgcaacgtaagttgtgaagcgctgtacagccctgaggcacagtgggaatctccccccagaagagtactcaactgcccgggtgctacacgcgcattatagggggcgcccctggaggagagaccagtggcgccccctacacagaagaagtttcatagggtctttaacaccttcacccccccccccggggtacatagatctgccaggagtcgcacgggggggggtttttcctcccaccccacagggattaaacccttttccccgcactccaaaagaccccccaaaaaaattttccttggtccatacca

SEQ ID NO: 635501 - DNA, 471 bp, Homo sapiens
tcggaccgcgtgcgctctgaatccagcgagtccaggtcggcaaaatcagatcatctgcccacgcccctgcttcccatttttaacaccacctgcgttgccaacaaatcggataattcttcttcaagacgggtgatatcgcgtgatttttcgaccttatcacgtggttttccggtggtattagattcagcagcggtctttgcaaccagtttttccgcttcacgcaccgacatgcgcttggcgacaatttgattcgccagctgaatctgggttgcgccatcggcagacagcagggaacgggcatggcccatgtcaatatcgcctgccgtcagcatggtctgcacaggctttgccagatttaacaagcgcagcagattggatacggcgctgcgcgagcggccgacggcatttgccgcctgttcatgagtgaacgaaaaatctgtgatcagacgatgtatgccttgcgcctcttcc

SEQ ID NO: 635502 - DNA, 828 bp, Homo sapiens
agcccacacccactccaccttactaacagacaaacttagccaaaccatttacccaaataatgtataggcgatagagattgatgcctggcgcgatatatatagtaccgtcgagggatagatgaaaatattataaccaagcataatataggcaaggactaacccctataccttctgcataatgaattaactagtaaataactttgcaaggagagccaaagctaagacccccgaaaacagacgagctacctaagaacagctaagagagcacgacccgtctatgtagcaaaaatagtgggaagatttataggtagaggcgacaaacctaccgagcctggttgatggctggttgtcccaagatagaatcttcgttcaactttaagtttgcccacagaaccctctaaatccgccttgtaaatttgactgttagtccagaggaggaacagctctaggacactaggaaacaagctgtgtagagagagtaataaatttaacatccatagtaggcctacaagcagccaccaataaagagagcgtgcatagctcaacacccactactaataaatcccatatatatgactgaattcctcacacccgattggatcaatctatcaccctataagaagaccgaatgttcagtgataagttgcatgcaaaacattctcctccgaaataagccctgcgtacagattaaaagactggactgacaattaacagaccaaatatctacaatcaacccactagtcattattacctgattgtcaaaccaaacaagggatgcgcctacggcaagttaacaagtcaacaggactcggaaacttacccgctgta

SEQ ID NO: 635503 - DNA, 336 bp, Homo sapiens
  misc_feature (2)..(2): n is a, c, g, or t
  misc_feature (279)..(279): n is a, c, g, or t
  misc_feature (314)..(314): n is a, c, g, or t
gnttttgctcttcctttgcctttcaccatgattgtgaggcctccctaaccatgtggaactatgagtccattaaacctctttttcttttcaaattactgggtatctcttcatagcagtatgaaaatggactaatacaacagcattcaccagggaagtgactagggaacacagagcttcaagctttgtgagggcacaagggtactgggggccatggataccaaatggcctcctgggaagccccagcagggagtcccagggtggtgtttcagcagcaaaatnagtcgtggccctggggaagggaccctcaagggctncacagccctgatgatccaattt

SEQ ID NO: 635504 - DNA, 1038 bp, Homo sapiens
  misc_feature (361)..(361): n is a, c, g, or t
  misc_feature (382)..(382): n is a, c, g, or t
agcgggactctaacctcgatgctttggtgagaagtgagcggccgtcgctcgcgtcttggctactggatacctgcttcctgcgttgtgccttgcaggcatcgttgctgtgcgctcacgtgtaggtggctccccgcacagagtgagcgtacacgccgtgagttcgcgcggaagcgcggtgaggccggggacgcacacgtgtccgcatggcgcatggcgaccttccgacgggttcggagaagatctgggcaccgagggaggacgttgccatagagattgagtgcgccgaagggacgctgacatggccatctcggcaacatacgcgcaagacggaagacgcttgaagagaatgtcatcgatcggntggcatagaatctgtgtcaancccatgcggatacacatctgagtgacacagcccgcattgagaatgagaggacgcgaacggttcgggtacatacacgtgggtagtaccgcttgtgctggcttaaccgttgtagacacttgtaacttggagactaccttggatgtagcgctaggacgagagagatgttggtatgcgctggcttgccagacgtgtcacgttggcaggttgccacttgctcgtctacaggactacgtaatcgcggagaagtaaactggcaactaagggcgtcttgcgaggtaggtgcacccaggggcaataggcgacttctgaggcacgtacgggaaggacatgagtgggcacagaggggactcaagggggcgcaaggaacggggtggaaagcaaccaagacgtagtattggggataacacgtcgttgcacgcgaggagaaagacgtctaggccccgggaggaatccagggtaagggtctttggaagggagctacgaaccattcccgcgtgcaactttacgcccatacgagcacagctgaacgcggattggacgtactcgaggatgtctcgggcctaaacttgtgagcgtggataattccgtgcactgggtgtgtggccactggagagcttgtaagtcacgggggagaaatccccctgaattattcctta

SEQ ID NO: 635505 - DNA, 867 bp, Homo sapiens
  misc_feature (41)..(41): n is a, c, g, or t
  misc_feature (61)..(61): n is a, c, g, or t
  misc_feature (64)..(64): n is a, c, g, or t
  misc_feature (128)..(128): n is a, c, g, or t
  misc_feature (141)..(141): n is a, c, g, or t
  misc_feature (150)..(150): n is a, c, g, or t
  misc_feature (182)..(182): n is a, c, g, or t
  misc_feature (205)..(205): n is a, c, g, or t
  misc_feature (208)..(210): n is a, c, g, or t
  misc_feature (270)..(270): n is a, c, g, or t
  misc_feature (299)..(299): n is a, c, g, or t
  misc_feature (319)..(319): n is a, c, g, or t
  misc_feature (324)..(324): n is a, c, g, or t
  misc_feature (337)..(337): n is a, c, g, or t
  misc_feature (346)..(346): n is a, c, g, or t
  misc_feature (348)..(348): n is a, c, g, or t
  misc_feature (355)..(355): n is a, c, g, or t
  misc_feature (385)..(385): n is a, c, g, or t
  misc_feature (404)..(404): n is a, c, g, or t
  misc_feature (417)..(417): n is a, c, g, or t
  misc_feature (421)..(421): n is a, c, g, or t
  misc_feature (438)..(438): n is a, c, g, or t
  misc_feature (447)..(447): n is a, c, g, or t
  misc_feature (512)..(512): n is a, c, g, or t
  misc_feature (581)..(581): n is a, c, g, or t
  misc_feature (584)..(584): n is a, c, g, or t
  misc_feature (639)..(639): n is a, c, g, or t
  misc_feature (783)..(783): n is a, c, g, or t
  misc_feature (789)..(789): n is a, c, g, or t
  misc_feature (818)..(818): n is a, c, g, or t
ggcagcgggtgaggcgaccctgagtgtgcccccaccccgcnatggcccgggtggtgcaggngtnctgccgtgctttccgcgtgctccgtggccggcttcgtttcgcagagccggggacaagagaagtngaagatggactgntatggtggnataagtgggacgcatttacgagtacggagccntcaccattgatggggaggagtanatnnncttgaaggagtatgctgggaaatacgtcctctttgttaacgtggccgaggtactgaggcntgacgggccagtacgattgaactgaatgnactacaggaagaggttgcancattnggtctggtcattntgggctttncntgcaacnaatttggaaaacaggaaccaggagagtaantcagagatcgcttcctacngtcaagtatgtcngatnaggtggaggttttgttnctaattttnagctctttgagaaaggggatgtcaatggagagaaagagcagaaattctatagtttcctaaagaantcctgtagttaaagatcggagctcctgggtagatttgaccgcgtcttctgggaaaccatgaaggtttanganatctgctggaactttgagaagttcctggtgtggccagatggtatacccatcatgngctggcaccaccggaccacggtcagcaacgtcaagatggacatcctgtcctacatgaggcggcaggcagccctggggggtcaagaggaagtaactgaaggccgtctccatcccatgtccaccatgtaggggagggactttgttnaggaanaaatccgtgtctccaaccacactatctanccatcacagaccctttcctatcactcaaggcccagcctggcacaatgga

SEQ ID NO: 635506 - DNA, 403 bp, Homo sapiens
tttctaaacttttattgaaaaaaaaacccagggggggtgctggatcccttttcaaaaaagccctttttttttccaatgggggctttggaccccccctttcacctgggctgaggacgttttttttttaaacttaagctccccaaagtacattatggcttttaaaaagggcaaaggtcaaatgtgggtagctggccctggaccaaccccttttcccatgttccagtttcccaagcttaccggacttgggtcaagcttttggccccaatgtcctggcatgagtgttggatgccccccatcaggtaagggacaaatttgtggattgaccctttgttctgcacagaaccaaacactccctgggccactttgattttgtcagcttcactgaaatatctgttttggctgc

SEQ ID NO: 635507 - DNA, 424 bp, Homo sapiens
  misc_feature (293)..(294): n is a, c, g, or t
  misc_feature (311)..(311): n is a, c, g, or t
  misc_feature (326)..(326): n is a, c, g, or t
  misc_feature (337)..(337): n is a, c, g, or t
  misc_feature (342)..(342): n is a, c, g, or t
ggagggctcaggcactggtgccacttgtggcctcttaggctacgaggccttcgggacgaggcccaccgacgcagcaaacgtgacggactagtcgtataggacgttcgtagcagacgacgatgcgacacgcacgaacctagcaacgaacgacaagcgagctagggggcgctagggagactccacactgctcagggtgtagacagcagtacagctaaggttgggggccgtggtggggtgagtcctagggggtgagggaagtctggactcaggtgggctccaggttctggtggtcnntgccagatcccgttgcnggaacgggttcagangagggtcaggngtcanactgcaggctgggcatcaccatatatcactcagttccttctggaggtcatccttccagcagccactggctccctgcggtatc

SEQ ID NO: 635508 - DNA, 215 bp, Homo sapiens
  misc_feature (84)..(85): n is a, c, g, or t
  misc_feature (102)..(102): n is a, c, g, or t
  misc_feature (117)..(117): n is a, c, g, or t
  misc_feature (128)..(128): n is a, c, g, or t
  misc_feature (133)..(133): n is a, c, g, or t
cctagagaatccccgaggagatcgtgaggatctagagggacagtcctggacataggatgcacgccctaagggttctggtggtcnntgccagatcccgttgcnggaacgggttcagangagggtcaggngtcanactgcaggctgggcatcaccatatatcactcagttccttctggaggtcatccttccagcagccactggctccctgcggtatc

SEQ ID NO: 635509 - DNA, 356 bp, Homo sapiens
  misc_feature (76)..(76): n is a, c, g, or t
  misc_feature (82)..(83): n is a, c, g, or t
  misc_feature (94)..(95): n is a, c, g, or t
  misc_feature (128)..(128): n is a, c, g, or t
  misc_feature (142)..(142): n is a, c, g, or t
  misc_feature (151)..(151): n is a, c, g, or t
  misc_feature (176)..(176): n is a, c, g, or t
tactaaattcgcggccgcgtcgacgtaatttttagtatgtgtgaaagccaaagaaaacaaaattggccatgggganctggcnnacatgcctgtnnaaccccaccactttgggagggccgtggcaggcnagattggcttgagnccctggcanttggagaaccagcccaggcaacatnggtgagaaccccgtttctccaaaaaggtgcaaaaatattagctgcgcatggtggcatgtgcctgtggtaccagcttctcgggaggctgaggcaggaggatggcttgagctcacgaggtggaggctgtagtgagcttaaatcacactacagcctgagcgacagagtgagaccgtgtctcat

SEQ ID NO: 635510 - DNA, 255 bp, Homo sapiens
acatcttttgacctctgattaactatgggactataccagattagggccctaaagagcataaagcactgtatctgtcatatcatctcatagtgataggaactgataaggcttagttgctccgataggaaacttagtcaggtgatcagtgatagcagctcttctttcaattacatttatagatatattatcaataccaatatttcaaaaattagatcatacattatcaatcatattttacgtgttatgttaaatcta

SEQ ID NO: 635511 - DNA, 104 bp, Homo sapiens
tatatcctttctgtgtaaaatgtatattctttcagtttggagcgcctctgcctggtgccacaccatctgggaagtgaggagcacctctgcctggcaccgtgcaa

SEQ ID NO: 635512 - DNA, 348 bp, Homo sapiens
gagcagaaattgtgatgcctttgatttaccccctagcattttatagtcttgagcaagtcataaccctatggtgccttattttctggatctgcaaggagccctgcctgcataaatgtttgcttaggaacttacgaaaatgacatactcctctctctgctttaagaaggccatgagccagctgcagctcatctcactcagcctgctcctgaccagagtcctttcctcttccaagagaaagcatggaaaagcagcaagcaagcagtcataccatggtaacaggagtgatctatcattgtcatcgagtccttaaacaaactgtaaatgctcttggcttcagcacctttattc

SEQ ID NO: 635513 - DNA, 667 bp, Homo sapiens
ctacctggtcggcggccatctgcaacctaacacatcaaagctggctggcgcagaggatgaaaaaagcggctggagttgactcaactctaggctccgaacttcatttaaagtgaacattggtcatacctatcacctgtgtaacattaaggaaatccaaaacagagtactaaacaccatgttggccaaaactggcatccatcattacagtgacaataactgtaaggcatgtagaaaatactacagagtttgtacactggctatcgttaacccaggtgattctgctatcattaaacgcatgaacctgggaggcagaggttgccatgagccaagatcgccccactgcactccagcttgggcgacagagagagactccatctcaaaaaaagaataaaataaaataataataataatgttacaataaaatcctggtttgtaaatatgtgcctgcatcactaattaattccttcagattcctagaaaaggagcaccgggtcataagatatgaattttcagtcacacaataacatgttgctaaattaccttctagataagttagatcaatttatatttccacattagtgcatgagtgattgaatcattcttcagtcaaagcaacagactcatgtaacatacctgtgtaaatgaatctagaagttctgaagattct

SEQ ID NO: 635514 - DNA, 702 bp, Homo sapiens
  misc_feature (612)..(612): n is a, c, g, or t
gtcctctcaagcttggcgttcgtttggtgaggttacacggcgggttcaacatgcgtatcgaaaaagtgttatttctgttcggggcccatctatccgtggacacggatgatgttcgtccgcaaggattgcagaggtgttcagattatgcaaactctaaatgtcatatataagctttacaaagaagcgcaatcctcgcaaagttaggtggaccagagcattccggaaagcagctggtaaagagcttacagtggataccattcatctgaagtttgagaaacgtagaaggtgaacctatcaacataccagcgagagctagggaataacaagtattgatgcgagtgagagagagttgaagaattcaaacgagaaggcgccatagtctagatttatacatggaacatgattgcacagaaggacatacaggagctacgagaaagttcaaggatatcgaaagaagtcaagcaaaagatccgatctgatccgagcccctctgtgcaggcacagggaaacagttggaagagaagatggtacagcagttacaacgaggagtgtggacaatggaagatgctccttgcataatctctgtaacccatttctttgtatgtacacttngaaaaatgccctttgatacttggaactgctaaagtgattttatcttcaccataaggcacttgaatgaaaacgattaaagacatcttcctg

SEQ ID NO: 635515 - DNA, 142 bp, Homo sapiens
cccttaggataccaggacctgttttcccttcggccctccagccccaaacctgccctagccagccctgcaaacatgccagtcttgtcacgcagtttgcacagctcaggcaaccccacgggcaactgcacgtgtggtcccaggg

SEQ ID NO: 635516 - DNA, 149 bp, Homo sapiens
cgggaccaaaccgcatacgaggaccaaaaggggccaggaccagagaagacgacatctccatgtgactacccacagctccagcagaaaacagggagtgaccttagaccctcagcatctgcctccactagctctcttgccaagggggaact

SEQ ID NO: 635517 - DNA, 212 bp, Homo sapiens
  misc_feature (11)..(11): n is a, c, g, or t
tgggatcatgntagtcacttcctgcccccaggccccgtgccaaagaatggatgccccctactcctcaggggactgtccagggggcccagtggtagtgagggaaagtgtttttgtttttttgctcagcctgctgggccctttgtgtttgaggatggttaatgattccagcctctccctgtgccttatgcattaaaatttttttgttacgagca

SEQ ID NO: 635518 - DNA, 182 bp, Homo sapiens
tgaccctaaaaggttgaaacacttctgttatgtgtatgtgaaatcacttttgccgggcgtggtggctcacacctataatcccaaaatgttgggaggtcagcatgggtggatcacttgaggttaggagttcaagaccagcctgaccaacatggggaaaccccatctctgctaggaacataaaa

SEQ ID NO: 635519 - DNA, 190 bp, Homo sapiens
  misc_feature (189)..(189): n is a, c, g, or t
gtgatgtatcccaacactgaaaacaggatgaaagcctgtttactgcaattccttttacccagtgtatcatgtctacctatcaacagaaaattaccaagcatacttaaaaggcagaaaatgcagtttgaagagactgaacaagcattagaaccagagtcagtccgtggctggaagtgttgggcgataacna

SEQ ID NO: 635520 - DNA, 254 bp, Homo sapiens
catgttgccctctgctagcgctacggtgtttccatagaagtcatagcagcatctatgccagtgctagggatggaacctgctatcggtatacttgtgtgtgttcttagtgtgttatcttacccagtttcatcttcttctaaaaatgcaactctggtgccttccctccctccaggaagactggcaaatatcccgttgcattacctgctgctgtggacgcgctgcgctctgccctaacctctttacggacttcacgc

SEQ ID NO: 635521 - DNA, 201 bp, Homo sapiens
caagggtcgaaccagttgtaaaataattccccgaaggtatcttgtctcggcacagtaataaatggcggtgtccgaggcttcaggctgctccccttccagtccgaggtgttgacaaggatgatgttttcgggaagctggtcatcggagatgaggatgtggttgagctggtcatacacagtccttcctggggatctgcagctg

SEQ ID NO: 635522 - DNA, 112 bp, Homo sapiens
tgtgttcgccagtcaaagtcaagcagtgaaggacaaagctgatttctgcatatcactatgccggcaaggtgaggagcactcacggggaggtgctggccagatctgaggtgga

SEQ ID NO: 635523 - DNA, 1036 bp, Homo sapiens
  misc_feature (52)..(52): n is a, c, g, or t
  misc_feature (65)..(65): n is a, c, g, or t
  misc_feature (71)..(71): n is a, c, g, or t
  misc_feature (81)..(81): n is a, c, g, or t
  misc_feature (92)..(92): n is a, c, g, or t
  misc_feature (109)..(109): n is a, c, g, or t
  misc_feature (122)..(122): n is a, c, g, or t
  misc_feature (124)..(124): n is a, c, g, or t
  misc_feature (127)..(127): n is a, c, g, or t
  misc_feature (162)..(162): n is a, c, g, or t
  misc_feature (165)..(166): n is a, c, g, or t
  misc_feature (205)..(205): n is a, c, g, or t
  misc_feature (211)..(211): n is a, c, g, or t
  misc_feature (235)..(235): n is a, c, g, or t
  misc_feature (244)..(244): n is a, c, g, or t
  misc_feature (255)..(255): n is a, c, g, or t
  misc_feature (323)..(323): n is a, c, g, or t
  misc_feature (465)..(465): n is a, c, g, or t
  misc_feature (491)..(491): n is a, c, g, or t
  misc_feature (527)..(527): n is a, c, g, or t
  misc_feature (562)..(562): n is a, c, g, or t
  misc_feature (564)..(564): n is a, c, g, or t
  misc_feature (592)..(592): n is a, c, g, or t
  misc_feature (601)..(601): n is a, c, g, or t
  misc_feature (605)..(605): n is a, c, g, or t
  misc_feature (617)..(617): n is a, c, g, or t
  misc_feature (642)..(642): n is a, c, g, or t
  misc_feature (651)..(651): n is a, c, g, or t
  misc_feature (653)..(653): n is a, c, g, or t
  misc_feature (670)..(670): n is a, c, g, or t
  misc_feature (717)..(717): n is a, c, g, or t
  misc_feature (722)..(722): n is a, c, g, or t
  misc_feature (725)..(725): n is a, c, g, or t
  misc_feature (736)..(736): n is a, c, g, or t
  misc_feature (743)..(743): n is a, c, g, or t
  misc_feature (759)..(759): n is a, c, g, or t
  misc_feature (774)..(774): n is a, c, g, or t
  misc_feature (799)..(799): n is a, c, g, or t
  misc_feature (828)..(828): n is a, c, g, or t
  misc_feature (837)..(837): n is a, c, g, or t
  misc_feature (839)..(839): n is a, c, g, or t
  misc_feature (859)..(859): n is a, c, g, or t
  misc_feature (874)..(874): n is a, c, g, or t
  misc_feature (899)..(899): n is a, c, g, or t
  misc_feature (907)..(907): n is a, c, g, or t
  misc_feature (911)..(911): n is a, c, g, or t
  misc_feature (913)..(913): n is a, c, g, or t
  misc_feature (928)..(928): n is a, c, g, or t
  misc_feature (932)..(932): n is a, c, g, or t
  misc_feature (943)..(943): n is a, c, g, or t
  misc_feature (964)..(964): n is a, c, g, or t
  misc_feature (975)..(976): n is a, c, g, or t
  misc_feature (1013)..(1013): n is a, c, g, or t
ctttttttttaattaaaaagaaaaaaaaagagagaaaaaaaattccacattnattaaaatctctntctctngaaaatttcnggtttccagcngactggatgagtttctnctgtggctgtgtnanccnctctgtatactttaatggttttatcagcctcagcngtnnagtaatcgactttaagactgaacaaaagcacaagcaaanatcccngaatcactgtccaaagacccaggnggcacagcngcgtgaacccnctgaaaattgtagccagtcctccagtcccaaagaggcatggggccattgtaagccccagaaacaagcnctccatcagaattaaccgtcaatgtgttaataaaagcattatgaccggaaagattttgaatgaaactcccatcagggaatttccactgccttatgttatctggagaaccagaagcaaatgtgttaagtcttggatgttaaancacagccctaactgattttttgtganttgttaatgttacttttgtttttccagccaccagancccataatcgaattgtagtttcaaggcttcctgtnanaatttgtggttttgcagcctgaaaactnaatgtagcnactncatttgtatgtncagaaaaagtgtgttcactggcttnagttcttanancccaaaaccgtgcagtngaattttgactacaggttaccaacaaaacgattgttgggtgcaaatncaaancanaaactgcactnaaatttncatgaaaatgccgtanaaccttattgtattngagaacccagcatttcacttgtttnttttctccacaagaaaacagaaatgggcnccttgtgcntnctataaagccccgcacagtncttatatgcccagtnaatgaaagtgtttaatttgccactngccaagtnccananctttatagttctgtnagcngaaccagttanaaaccacttaatttccagggnccacagcaatnnatcgaacccagcaaagaagcccactgaaaaccctgtngagtttccacggggggtgccaat

SEQ ID NO: 635524 - DNA, 224 bp, Homo sapiens
agtctttctctgtcgatctcagctcattgcgacctccaccttccgggtcctgcctcagcctcccgagtagctgggactacaggagtgcaccaccacacccggctaatttttttttttttttgaaacagaatttcgctctgtcacccaagttggagtgcaggggtgcaatcttgctttactgcaacctccgtctcctgggttaaagcaattcccctacctcagcc

SEQ ID NO: 635525 - DNA, 853 bp, Homo sapiens
tggcaaaccccaccgccgaggaaaaaccgggtcctattaagcccagggtcaaccccacgggggttcttcgaatatggccgtcaagcgggaagccctggggccgggttctccttggagcctggtttggcaagacaagggctcccaaaagacagcaagaaaattttcggtggctctggagcactgggaagaagaaagggatgtggtgttataagggtgtccctggtctttcacaagaatatatcccaggggttatatggtggtcagggggggtagactctacacaccgccataatgggcatctggtgtgggcaaatgtcccctattcatatggggagaagaatattttggaatagatgagaaaatctatccatcctcttaaacggcataaccggtgtccctgggctattctgtgtgtgccccatgtggcaaatattggctgtgggacccaaaacaacaaatatggggttcccccatgttttttcacatctgtggcacctgtgcgcaaagaagctgtagacgtgtggcgtgtgcgaatgtgcgccaacgctatgtggtgggggtgcgtggggcgccacaaagggggtgaacaaagaaaggggcattgtgaacaacatattgtgtggggggaggcgcctatgggaaacgcgctactagggggtgtcccaggggcatattggggcaaagaacccaacgcaaaagaaaagattccaccctatggggcgcgtgctctgggtgggggacaaactcccggcataaaagtttggagaccttcgggcgttttaatccttaaacccaaccaaagattacaattccctttcttgggtagctcacaagggaaaaaagaacccccttc

SEQ ID NO: 635526 - DNA, 870 bp, Homo sapiens
cccggatgattgtggcggaacggggggggtggtagagttgcgcgccaaggggggttgcacgtgtggggttccgtcgtgcccgggttttgcttgctgggggggcagggccgggatgccgtacgtgttggtgggggcagcttgggagggcctcgtgtcgggagcctctgtggtggggatggccccccgccgtcctgggagcgggtgtggtgagagtgccgggggccccgttggcgtggtcacaaggagttgtgtcaatccccgcgttcctgtggggtgcccatgtgctgagtgcccacgaaattgtcgcctgtggtggtggtgttggttcgcccccgtcgatctgctcgcggggtgatgtgagcgcactcctagtggggggcgtgtgcccacgcagcgtgtaggcccgctgggtgcgggtggtgcgcgccgcgtggtgggagacaccaacgggcggcgtttctgttgttgactgcagccgcgccgcctctaggggccgcgtcctttttcggccccgggcgcgagtgtgactccagatgggttctcgtcccggggtctcttcatctgtcggcggtagcaatgtgggtccgctgtgctaatcccggggcgtgttcgcccccattttgtgtctactcttgttcggcgggcctcctcctcgtgtaaactgcatcttatcgggccgcttcttttggaagcgtggtgccttcttcggggtggtggctgttactttcgcacgtggcgctcctctatgaccctccgctcacggtgctgccccatggcgcccgcgcccgcgcggggaactgctttttggggtctttaggtttaaaaaatgaaaacccccccccacaaaacaaaaaaaacggaacaaaaaaa

SEQ ID NO: 635527 - DNA, 1188 bp, Homo sapiens
ctagttctagatcgcgagcgacccgaagctggcatctttctctacggagacagattttagaaaatacttttcttgcccatgaatttctatcttctggttgataaatatcattttccctttacttacaagaaaataagattgcaaccactcctgctaatgatttagtagtacctaattcatttcagctataagtaaattaggagataaattctaagagttgactcaaaggatgatctatttaacagaactcacgtcaactcagcgaatgagttatgggtacacattcagcacgaaaataacctaatcccgtgggcaacggtttctcgcaaggcatggatgcacacatatacaaatcattaccacaaaaaatctcaacatacaagcgttattttaaacatcaccacacaccacacacaacacaaacaacaaacaaaaacaaaaacaaaaaaaaaacaaaaaaaaaaaaaaaaaaataagaaacagaggaggggaggaggagagagaactccacgcggcgcggggccctgatctctccccgcccaccaggtgaagaaaaatgagctccccacaggactcgctgtccagaggacgccgttactgccgcacaacaaacaaaggggcgggagagacgcagcactacagacaacagagacagaatgagggaagcacgaacaaaaaaacgctgggccaccccacccagccaccccacctcgcctacagagacgccacccgcctctgctccattctattacatactctatccatgcatagtgttactttcgtatctaatcgtcacctgcttggtgtggagggaatcgtcaagacagatagtgctatgacgtccggacacctcaaaagacatactcctcggggcggcatgagaatgaaatcatagataaaagacaagtacatagtcatgctagacatatgaagatacaaggtgcaggcgagcgccggggcaacgcgtaggagcagcggacgaagggcggagagagagcggaggtgacagagagcagtcagagcaagagactaccagagatgggcggacagcgagtgggcgggcgatggaagaagacgcgagataccgctagagaaagaggcggacgcagagacgctgcgcgagacgtagcggagaggacaggagacggagagggagcccgacgagagtcacgggaaaacagaggaacg

SEQ ID NO: 635528 - DNA, 295 bp, Homo sapiens
aaggctcgaaaagggggttagtggtacgaggatattgtgtttctaaaagggaaatgcagtacctacaatcattcccaggacgaggctctcagacagacctaccgaccagtaacattttgtatgtctgccacgctgggggtcatttgtatatgccatactatatcccaggtagcttatgctctcactacttatgggttgtgtgaccgtctttagcaacagtatttcacacatctacaactttattgaggacaagtcaactactctgagttagcagactcctgcggaggacagctcc

SEQ ID NO: 635529 - DNA, 319 bp, Homo sapiens
caaagtctgaaagactaattaacagactgggaaaaagaaaattatatgctgggcgcagcggctcgtgcctatatcccagcactttgagaggctgaggcggacggatcacaaggtcaggagttcgagaccagcctgaccaatttggagaaaccctgtctctactaaaaatacaaaaattacccaggcgtggtggtgcacacctgtaatcccagctactcaagaggctgaggcaagacaaaagcttgaacccgggaggcggaggttgtagtgagccgagatcgcaccactgcactccaccctgtctcaaaaaatgaaaaag

SEQ ID NO: 635530 - DNA, 506 bp, Homo sapiens
agctagagcagtatccatgcatctctaactagagcagtttctgtgatgaggacccagcttcagcagtcactcagcatgtagtctgagtgtaaactcactctggaattataattttatatattttgtgaaggagcctcagaggatcgaggtttttactctctgttgctttctttcttgtcgagcatttccactgcacatgggttggccaacttgcccctcagtgtggtcttacttgaattatatgatagagaaatcgcttctagtttttatttgtggatggtgttcatcccattttccagcgctagtaaattgtttccctacttttattcctttgctcatctcagtgggaattgtagaagggggttaaatggatgtgttgaaagggttttgaaccaaaggtctgtaatgatttttttttttagatcttatttaagtttcaaagactgattccaaaggcaaccaatattgacatctgtatagatagacttaagatgtgtagttcaagg

SEQ ID NO: 635531 - DNA, 184 bp, Homo sapiens
ggatgttaaccgtaacgccgaacaagaggagtaggactggtcttgtcacatgagactaaggctaaagtgtaaaaagtcccactagtaacaacgacagatacctctccgaaaagaacgagggtttctttggtcgtaactaccgacaacttgtgctcctgtaccttactgtacgtttttaccacta

SEQ ID NO: 635532 - DNA, 482 bp, Homo sapiens
ctagctcatgcctcccctcctgccgcagcccttccctacatctcctctccccatggccaagctgcgccacagacgcggcggggatggttaccgacaccgtgagccacagaagaacgattgagtcctgcagcgccggcttagcgccttcccggccgccggcgtcctcttccacttccaagccatcgaggaggactgatgtggctcttcccatggcggccttgaggttttgattgggtccttgcatcggttttgacggagcctgataggaacgccgggagagaagtagccttggattggagcatcgtgggcatttcatcctgtttgtggtggccacggggcaggccatcgtcgagatccatccctgtgagccgcagttcatctgcgatggggcattggggagaattcgtgctcgatccggctgccaccacacgccatctggtggggaagtagagggggtagccgagcggaggagcgggcgcggg

SEQ ID NO: 635533 - DNA, 744 bp, Homo sapiens
tgggaaaaaaaggaaggggttaattctcaagcgtctaagggttagcaaacgagggctatttggttttaaaaaggggcagggcgacactggcggcctgaggaggggtccatgggtctggggggctggcccgagccaccctcaggccccgtgcccacccggtccgccctcggccgggtccagagggatggctggtgacgaggggggaggtctgggaagaggctgggaggcaggagagactcccccaggctccccacttaacactgagggggggtgggggttgggcggacacacactcataaaacagaaaataaggttaacttaaaaataaaaccaggcagcccggcctcgggcctgtgctgggcccgtgggaccagccatgaaccttccgggaatcgcagaggcccccagggtttggatgcggggaggaaagggccaggcctgtgggacccccaccgggggaaccccctggccccggtaaaagggggccaaggtggcaagaagaaggtggcttccctccctgggggcggagagaagatgactctatgacttttaacccttgcggcgtttggtgactttcctgatactccagagtcaccggctaggtgagaggcggggtgctaccctagctggcccccacagcgcagccggttttgccctggggtggattctgggataccggtggggtaacactgtacgggggttcctgccttgttgctccccccagggaaaaccggctcttgtccg

SEQ ID NO: 635534 - DNA, 175 bp, Homo sapiens
atattagcgcatgttttttcattcggctctgcttatgctatgccttatatcaggatgcgcttgagtatggttttcactgactaccagagaggatttttccaggtcactgtgtgggttttttgtttgttttttttgagatggagtttcgcttttcttgcccaggctggagtgcagt

SEQ ID NO: 635535 - DNA, 763 bp, Homo sapiens
gtacagatgtgatgcgtatcaacgggcgtgatgttgtcctgtgccaacgtttgctacagcttataacagcatccctgggtctcgcagatctgtgcctatgatcatgcttgacattgccagtgttctttactggcgacgattcacggaacatgaaggtctcctgatatccagcgtgggagcaccagttcctgatgaagcgagttcgctagatgacccagggcaggttagctcgtgctggctcctcctccttagaaatgatatgcaagctccaatgagttccctgatgataccctgaacttcatcaagacgcacccgctcatggatgaggcagtgccctccatcttcaacaggccatggcttcctgagaacaatggtcagataccgccttacccaaattgcagtggacacagctgctgggccatatcagaatcacactgtggtttttctgggatcagagaagggcaatcatcttgcaagtctctacggcccgaataggaacatagtggtatgctaacatgacagccttttcctggcaggcagatgcagtgtctacaactcctgaaaaaacgccgctatcgatggatgtccgagaataacccgcgagtcatcgggccatgcccgcttggaacaggaacaaagccagctctcctgttactctctgcgttcctctaacctggttgttgaaccaagggtcccccttggccgaaggtgaaacgatcatgagaaagtgcacacaacctgtatcgctctcacagagaccata

SEQ ID NO: 635536 - DNA, 562 bp, Homo sapiens
cagccgcccgccagacgcgcccagtatgagggagatcgtgcacatccaggccggccagctgcggcaaccagatcggggccaagttctgggaagtcatcagtgatgagcatggcatcgaccccagtcggcaactacgtgggcgactcgggacttgcggcttggagcgtgcatcagtcgtcttactacagacgaggcctcttctcacaagtacgtgcctcgagcctattctgggtgtgacctggaagcccggaagccatggcacatgctgtccgtctcgaggggccttctggagcatctcttcagcgccgtgacgaatttcatcttgggtgtcatgagttggggggccgggcgaaggaaacttggtgcccgggggggttcacataactgcgggtacggggggccgggaggcttgggtcgccgatttcccgggtccccttgggcattcggtccggttggcggtgaaccggggccgtgggtggaagagattggggccgactttggccttgcaggggggctttcccaagcttggagccccactttccgctgggggggtgggcgggcg

SEQ ID NO: 635537 - DNA, 531 bp, Homo sapiens
cgacgagtcggtgatggtggtggaggatgatccggcggtacggatgctggtgctcaatgtcctcgacgagctgggttataccgtgcacccggcggcggacgcgcggaccgccttgccgctgctggaatcgagcctgcgcatcgacctgctggtgaccgatgtcggcctgccggggatgaacggccggcaactggcggaagtcgcccgccagcaccggccggggctcaaggtgctgttcatgaccggttatgcggagaaggctgccgagcgccagggttttcttgaaccgggcatggatttgatcgccaagccttttaccctggatgcactggcgaaccgggtgcgcgacatgatcgggcaaacgtcctgatcttcgggcataatcccgcgcccgccgcatgccccaaggtttcaaggtaaccaatcgatgaaagcccaagcccgtcatatcctggtcaagaccgccgaggaagccgaacaactcaggttacgtatcgtcaagggcgaagcctttgatgtgctggccaagaa

SEQ ID NO: 635538 - DNA, 360 bp, Homo sapiens
  misc_feature (228)..(228): n is a, c, g, or t
  misc_feature (249)..(250): n is a, c, g, or t
  misc_feature (263)..(264): n is a, c, g, or t
gatccctgtcgctcggacaagatcacgtcatgactccgaacggataattcagacaacaacaccatctttgtgcaaggcctgggtgagaatgttacaattgagtctgtggctgattacttcaagcagattggtattattacagacaaacaaagaaaacgggacagcccatagattaattgtgtacacagaacagggaaaactgtgcaaggctgaacgggagacggcaanctggtctcttttagatgaccnncacctctcagctnnaaagcagctattgacgtaggtattgatggtaaagaaaattctccggaaatcctcatcaagcgctctcatttgcatactcgactccgagcggaccgg

SEQ ID NO: 635539 - DNA, 313 bp, Homo sapiens
ctgagctcaggtgatccaccagcctggcaacatggcgaaaccctgtctctactagaaatacaaaagaactagtctgacgtggtggtgcgcgcctgttaagtcccagctactccgaaggctgaggcaggagaatcgcttgaacccggaaggcggaggtagcaataagccaagatcgcgccactgcactccagctcgggcgacggagcgagactccatctcaaaaacaaaaaaaaacaatgagttttcaacgtaaaataaggcccggaacagtggctcatgcctataatcccagcacctggggaaaccaaggcaa

SEQ ID NO: 635540 - DNA, 942 bp, Homo sapiens
catggtggcacgtgcctgcaatcccagccaatcaggaggctgaggcaggagaaccgcttgaaccccggaggcggaggttgcagtgagccgagatcgcaccactgcaactccagcctgggcaagaagctgagacaccatctcaaaaaacaagaaaatagggttcctcaaacaggcaaacctgtgagatgcacgttatattcctctctggggaagcccctgacacacggtaagttactaaagacagcctggctgtgacagtggacctggttgcaaaactagccctcctgcccacagacagaatagaaaaatatgaaacaacctctattcaggcaggtggacagctaggcaggaacgcacctgcaggctctgaaggcagtggaagttccaagcagcgaagcccacgatggatcaaccaccaactccttaccctggggatgtaaacccaaaaccaaaaccacacggtacttctgacgtgcaagaggcggagatcaaacatctactggcaagctaaagtgtgcccagaacacgggcccccagagagaaggggcaccatgtggacaaagcaggagtccacgaacgtcatgcaggaccaccaagtcaaacaaatgcgctgcatgcgacaggggacacccagggacctccaagagagacatgatggagatgtagcacgggtatgcaacgaggattggcagaaggacctggaggaggggagtctgacatggtaatctacacacagggggcgacgggagggcagacaaagggatgagatggcgacccatgaccgagaggaccggaacaagagggaaaaaggacgccagaaaaaaaaagaaaacggcgggagacaaaatcacaaggggggaaggacaaaaaagggaaaagaaggaaaaaagagataaacgggcgccgaagcgaagcagaagaaacaaggaaaaagggctatcc

SEQ ID NO: 635541 - DNA, 159 bp, Homo sapiens
caccctagcctggtcatattacatactcatatatcagtaagtaaagtatgtaatatgccagaaggggataaatgccttaagtgatagaaaagaaaaaagaagagccaattaaaggggagatgagagggtgcaaagtggtaggtgttattttaacgccag

SEQ ID NO: 635542 - DNA, 186 bp, Homo sapiens
  misc_feature (117)..(117): n is a, c, g, or t
  misc_feature (180)..(180): n is a, c, g, or t
cacggcctgggcgccttttggcagcacgcgcgggatgttgtccagcaggccgccaccggtgatgtgggccatggccttgaccgcgccggtgtccttgatcagcttcagcagtggctngacgtagatgcgggtcggcgccatcagcaggtcggtcagtggtttgccgtccagctggatgcnttcgat

SEQ ID NO: 635543 - DNA, 199 bp, Homo sapiens
tgagcaagatggaggctactgggcgtcagcgaagtcagtgcatagcggtcccgggctgatcggtagtggaacacaacacctgttacctccaagggcaccagtgtcctgctcatcctcgtatgcccctcacaacacccttaggctcactcaaacattctacatactcactctacactgccaccctgccagacttgctcag

SEQ ID NO: 635544 - DNA, 341 bp, Homo sapiens
  misc_feature (23)..(23): n is a, c, g, or t
  misc_feature (26)..(26): n is a, c, g, or t
ttacttgggaggctaaggcaggngantcgcttgaacccaggaagtgagccaagatcgcgccattgcactccagcttgggcaacagagagactccatctcgaaaaataaaacaaaacacacaaaaaaacatgaaaataagatattgtgggctgggcgcagtggctcatacctgtaatcccggcactttgggaggccgaggcaggtggatcacctgaggtcaggagttccagaccagcctgaccaacatggagaaaccccgtctctactaaaaatacaaaaacaattagccgggcatggtggcacatgcctgtaatcccagctaccgagaggcttgcagcagg

SEQ ID NO: 635545 - DNA, 854 bp, Homo sapiens
gattttaggggcgggcgggttttgcttgggtgatgctgtgtaggtcgtccctgtgggtgtgacgtggttggtgattgtgcaggatcctggtatccgctatacaggtcaaacatgcatgatcttcgtgataaacccattacctggcaagaccattcgacgccttgaggtggagcccagtgacacctatcgaaaatgtgaaggccagagattccagtgatacggaaggcattcccctcgacagcagagagctcatcgtttgcaggcaagcagctggaacgatggccagtacatctttctgactacaacatccagaatggagtcgaccctgacacctggtcctgcgtctgagaggtggatactgcaagactcttcgtgaagatcctgaccgggcaagatcatcaccctgggaagtggagcctcagagacatccaatcgaagacatgtgaatggccaggatccaggataacagaaggcatccactcccgagcagccagaggcttcatcttgtgcaaggcaagcagctggaaagcatggcctgcagtcttttcctgagtaacaaatccaaggaaggagtcgaaccctgcgaacttggggacctgccgtctggagagggtgggtatgcacgatcttcgtgaagagccctggagccggccgagggatcgagtcaagctcgtggaccgcttgggagctcctaatgtcacaacagtcgcaaatacggctggcaggcctgagaatttcagagatacaacgaaaggtcattctcgccgccgatcaggcagaagcggtatcctgtggcacggcaagcacgggtgggaaaatgggcgagacatcatagctgggaccacaaaatcaga

SEQ ID NO: 635546 - DNA, 306 bp, Homo sapiens
  misc_feature (233)..(233): n is a, c, g, or t
cgtccacacatgccataattagagacctagcgtttcttgccaagaacccaaaagtctctacaggtctcctggcatatccccacccctagatacagaatctgccgcaccaacctgtttttttccaccaacctaaggttctggacctcccggttataatctcatctgtctgcatgcaaacaaagataaatcagaaaacagccccacctgggccactatctgtaatgaaaatcagnccattcacctacattgcactctctcccacgcagggattttttttttttttctttttttagcttggattttggg

SEQ ID NO: 635547 - DNA, 893 bp, Homo sapiens
  misc_feature (250)..(251): n is a, c, g, or t
  misc_feature (386)..(386): n is a, c, g, or t
gaatagcccccttgcacttctgagtcccagaggttacccaaggcacccctactgacatccaggccttgctttcattctcacaatgacaagaaactatgccctccatctcatatcatataccaaaatcgtctctcctcacataaacagtaagcgcgttctccatcactcgtcttcaatcttaatccattcatagcaaggctaggttgagggtggaaataagagccaaaccacagccatacgactagaaatnnatcttagtcgactaacctccacctactacattctaacacgcgactaataccggatggaaactaactcaagcgatgattgcgtaacaccgtgaacaaaccactaaaacagtaaatcctactcttcatttacatttntgaaatctatattagtaatctattccctacaactaaactgatccggcattcccatactacgtcgaacattgatagacttccacagctagcacgacagacacactagctttactttatctctagcacgccatgaaagcacagccgtaagcaatggatctaaccactctctttaattctcctcgctagcctcttccatcttcccttaagtgaaggtccttggtctcacacctgactaaaagctcggggacttttttatggtccactaagatgcgggtcgcactataatccgaatgcaaattcgacaataagcaaccaattatgcctcaatctattcccacacacaatcgagtagcccatccatctacccgtcccttaaaccgtgctaactttcataacgcataacgccctaaatctaatcatcccgaccattcgaagtcactagctaacttcccccaattatctaaacaaacggtaaaaaatacaacaatggcaccaggtttggcaaca

SEQ ID NO: 635548 - DNA, 979 bp, Homo sapiens
  misc_feature (787)..(787): n is a, c, g, or t
aggtactgtctgttgttgagtggggaaagacatttttattacttacagggtagccataaagtttctaaaacggtaatatattaaagagggagagtggaaggggagaacagtatgaagtcaacaggaaatggctaaagatggagagctcaggtagaatagtttaaaaaatgaaaattgatagagtacctggtgtatttgaatacagcctagagagctttcattttccaaagagtgtggggataaattagtgaatgcatatttttcaaaattaagaaaacagaacatataattttgaacgctgagaaaaataaaaatttaaaaactacactgtatacacggtatacctcaactgtgaataatagtagtcatgtaaagtcagtcataattatgtaaatactgaatactgattttacaacaaatgattctataacgctgggaggatgggagaaaagagatgtgtgtgtgtgtaatggtggtgagccaatcaagatctgatatagaaaaatgcagaaaaaggagtatacacatgttttcttcggattaaaaaaactaataataaatcaccaagagtggtaaagttttaaatcaagatctgatatagaaaagtgcagaaaaagtagtatacgcattttttttttcaggaaaaaattaactaataaaccactaagaggggtaaagtgttaaccaatagttgcatgtgttctatattccactcatgtgtgtccagcaaacagtgttctatggctttaagtagtaaacatcttgcccccgtccaacaccatgtctnggcctaaagggtaatggtctttcctaagtctaatattcttgtctccaagcaaactccattggggcacattctcctatagcttttctacctgaaagatactctgggtttaaaagctaaagcataggtgcgctttttccattaaattttcctggattcccatggaaaaaaaaaaaacacaaaacaaacaaacaa

SEQ ID NO: 635549 - DNA, 699 bp, Homo sapiens
  misc_feature (356)..(356): n is a, c, g, or t
ggctggtgtggggttgagtcagttgtgggacccggagctgctgacccagcgggtggcccaccggaaccggtgtgacacgatgcggcagggcgttagggcgtcgggagcctgcgaggccttggccgtcgtcgctagagctctgggctgagcctgtggccgccgtctgtccccgcgtgccccgatgtcaggcagaaccctgcctgccggtggggcgcgccccgcgttctgcggcttgtctctccgagtgggcgtccggccttcaggggggcccatgtgcggaaagcaacgacagcaagaatcctgtgggtcccttcagaagtcgcggaccacaataagtagcccttcgaatatttatnactagggggccgccttttcacccggcagtgttcgggtcaatcttagcacagacttctttaaacgtgggcgaaagatccaattcgggacttacgaccacaggtggtgttcgcccaccacgctgacaggacctacgagggcatcctgcgcccgggtacgggtggtgacggccccacccggggtggacactccgtgtggcgcccggggctccgccgcgtgcccggttcccggtgcgtgctacccgcccctttggtctactgctcccggcttgacaccggggtaccccacgccggtgtgctggtccgggacacttcgttgctcccgcgagaggcgttccagattttg

SEQ ID NO: 635550 - DNA, 244 bp, Homo sapiens
agtctcttctcaccttctgtatcggcttccttagctttggtccgtagcgcgggtgtccaggcatgagcccgggctcgttcatctcttctcttgggagcctggcggccccgtccccgtgtctgtacaccacgatgcgccttacgccttcctgcccctattgtatgtggaagctatgactcaggacctcccatcagcccccaagactccctctccctaaatagtactgctttagagggaggcagtc

SEQ ID NO: 635551 - DNA, 1521 bp, Homo sapiens
gctgcgcaggagccgcaggccagtaggcagccatggtcgcccagccggaatggcatggtcttgaatgccccacttccacaaggactggcagcggcagcgtggccacgtggttcaaccagcacgggcccgtaagatccagcagacgtaaggcccgtgcaagccaaggcgcgccagcatctgcacccgaggcacaccagaagatcaaagagtatcccgatcacgggaaccaatctgtgcgcatgacactaccatacgagattacgagttaccaaacaatcagaacaagggatgccgccagcacggagaccagacaggggcttctacagtacccctgcggcacggaaagatcttacaaggagggactgaggcccagggacaatatttacacagcagaaagtggcacacgagatagcgaccacccagggaaccactaaatctggacgcaaactttattccagtgggtgttgaggacattcccccagaaggtgagtaactgagcacagcgacaaaaaccgaaacgggttgcacagacatggcagaacagaatcccccccatggaacaaagtggtaccgcacagcagcggtattgacacaaggtacgcgagcactacattggacaacaggggaaagctataaacgccgggtgttaccacacaagagcatcaacgtatccgtaatgtaacacccatttcacttaatacaacaccaacaaagagtggtgcaacatagggaccccccgcacagtatcccggagaggacacgacccaccacgaagacaacagacaaacaaagggagcgagaacacggacaacacgaaaggattaatgccaccatgggaacattatcgacaacaacaggaaaaacaagactcttgcgacacaagacacattaggtggagcgccacacagacggcccacacaaaaggaactgtgagggaaccagcacgcgcggaaaaccacagaggaggcagtccacaacatgtggcccaacccaagagaataccccacgggggacaaacaaccaagggaactcagccaattcatctttaaaacgacccaccacagcgcggaaagagtacacaacagacgggggcggaatccccgcagaaaggaatttccaaacatttcccacatacgcatttgggcatcagcgagggacaaaacatgggcaagaagccaaacaatgcgataacgaagagagttaagtggacaccacaaaacagaacaggagaacacacaattttagtcacgagacagcgagactaacaagagaatatccgaagatccaacgggagagacaaaatcgtggggagcacacaccccaggggatatgaagacccaaaagacagcgaggaaccacccccaccggagacagaacacccaactacaacacaagaggaagcacaacaaattacaacagggagtgagcgaccagcacaccagaaccacaaggacaaggagagcccacaacaaggcagccaaaaaatggcgcacgcaccgaagcaacgaagcaagggcaaag

SEQ ID NO: 635552 - DNA, 1057 bp, Homo sapiens
  misc_feature (151)..(151): n is a, c, g, or t
aggtgtcgcaggggcagtcttctggctgtttccgtcgcctgcgtggtccttgcagccccggtcttccattagcgtgcgcagacgttatgggcctaagcgctgggcgaggcgaggccttgcgccttccccgccaaagggcattctctggganctgtctttctggcgcgggagggcgatagacaagctgctgaagacggtgtcagcacgcacagagtctcctccgctttaatggcgctcccataagtgccgtcccccagtgggaaaacccgtggctactggtataatttggccatcttagtagcgagtaggagcaggcagggcttccttcccggggtcctaaggcggcggtgcagtccgtcgtagaagaattagagtagaagtcgtcggggtcggctctaaggacgcagccgcctcatgggggggtccaggggcctctggaagctgcctggaggtgctccggggcggcaggtcaagccccgaaagcgctggcaagggaagatcctggctgttggcatatcagcatttgggttaaaccaagcacttaaaggagtccggggatcgccagggaactcaatagaaattccgtcatctctcactgggtccatcgggtctgcaaactcctaaattcttccgcaattcagtccaataggcggggtaagactgggggaatgctccaataatggaagcaaacagaccttggggcaaacacacgtcgaacaacaggacttgcggtccaagaaccccaggaaacagaaaaaaacgttcttagaaaacctctttggcaaaggacaaaaggctataaaaggggggtctaaaagggccataacagttgcgccaacccccccttgttcccacattcttaaaaaaaaaaaaacccacaattttgtcgccctaaacacaaagacaataaaaaaaacctgcatacagagcaaactaataacattaagacgaacacacctcatcaccacaacttcatcaaaacatattacaatataaaggccacacaaatcatgacatgaaaaaaccccctccaaaattaaatataataaaaaacaac

SEQ ID NO: 635553 - DNA, 191 bp, Homo sapiens
ccgacatgcctgacagggaccgctacggagttccacctgagtttcctactggcttctgcccatgcccatggcacagttcaccatctttctgggtcctaacacgtgcgctcgtgctccacctccccggcgcggctgggctgagatgggcctggtggtgcgccctcgtgcggactgtctgggctagctcgggg

SEQ ID NO: 635554 - DNA, 1202 bp, Homo sapiens
gactagttctagatcgcgagcggccgccctttttatatttttttttatattttggaaacggagtctagtgctctgtggcccaggctggagtgcaggggcacaatcacagctcatgtgcaagctccgccctccggggttccagtgccgcatctatccgtgccataagccctcccaagttagcgtgggacacatacaggtgtgccacgcaaccagcagtatccgtttataatttatttggatatttatatagatacaacaatgtggggtcaaacaaccagaaagataacaaccacgagcgaaaatggatccatcgaaaaatcctccatgtgtaccacatcagcgaacacacacaacaaccaacaaaactacgcgacactcacaccaacacaacgcgccaagagcacacatcaaaaaagagcaaacaacacaaaaaaacaacaacaaccacacgaaacaaacaaaaacaactaccatactacaacacaaacaaaaaaaacaatagaacacacaaaaaaattatcaaccaaaatgaatacacaacaaatcactaacacaacacagcacacaacaatacaacaaagttacatcacacatataaaaaaaacgatagtagaaacaacaacacaattaccaagaacaaaaaaaaaaaaagaacaacacaacaaaagagaaagacaaaacaaaacagcaacaaaaaaacgagaacataaaaccagaaagaagaatcaataagagaaaagatacggagagcacaaaactagagacaacagcagaagaacaacaaactaataaaaacaaatcaaaaaacaactaatctaaacatcaacaacaaaaacttaatcaataaaaacaataaacaaaaacacacacactacaaataacaaacataaaacaaagaaccacgacaaaacaaaaaacaaaaaaaaaacaaacaaaataaaatacgaacaaaaaagcaacaagacacacaagacagccagaaacaacgacagaaaacagagaaggcgaagaagcacagagacgacaactaacaagagactcgacaacaaaagaagaaaaagcagagggacgaaacagaaagcaaaacgcgaccaaaacaatagaacaagcacaaaacaagaaaccacaacacaacacaagaaagcaacaaggcagaaaaacgacgaaacacacgagaagtacaaacaaaccgaacaaaacaa

SEQ ID NO: 635555 - DNA, 995 bp, Homo sapiens
ggacgcgtgggcggcgggtgcggtggctcacacctgtaatcccagcactttgggaggctgaggcgggtggatcacctgaggtcgagagttccagaccagcctgaccaacatgaagaaatcccgtctctactaaaaatacaaaattagccgggcgtgatggcgcatgcctgtaatcccagctacttggaggctgaggcaggagaattgcttgaacctgggaagcggaggttgtggtgagccgagatcatgccattgcactccagcctggacaacaagagtgaaactccatctcaaaaaaaaaaaaaaaaaagaaaagaaacgaaagaaaccccagctaggaatagaacaactcattggtcctcttggcctgtccagctggtgactgtaagccccagaaaatgctcaagggacttccccaggagagggacacccctcctaccttatacaccaggcggccaatgccatacatcctatccccccgggaggtaactataacacaacaaacccaccagtgcaacaacatgaacgggggggccacatccgagaacgagacgccggaaacctaaacacattcaaagacccacacgaaaccatatgatggggagaactgggcctagggaatagacaaccaactttcggacggagcaacaggggaaaattgggggacactccagaaggaaccccaccggatggaagccgacgaacagagcccaactccagggatggaacgtcggcacgtaagcaaccccagtggagaaaggccaccggcacgggcatataaagagaaagacaggaacacgaaacgccagaaaggacacacgggacgggagcacaagacagcgccacccaccccacaatcaatcaggaaaggaacagcgcacatgcccagtacaaccaacaacttagtaggcgccccgcatagataagtacacgaccatgagccgaggccaaggatcacaggtcaccacgcgctcacagacgacagcgaatagaca

SEQ ID NO: 635556 - DNA, 334 bp, Homo sapiens
  misc_feature (187)..(187): n is a, c, g, or t
tattttttgaaatagggtctcgctgggtttcccaggctggagtgcagtgagttgagcactgctcactgcagcctggacctcctcctgggctcaagcctctgcctccagagtagctgggacaacagacacaggccaccagcgcactaattaaaaaaatttttaaaaaaatttttgtattgattggggncccactctgttgcccaggctggtcttggactcctgggctcaagtgatcctccctcccaaagtgctggtattaaaccttaagataaagaatactgtatttgttttctgagattgcgccactgcactccagcctgggcgacagagggag

SEQ ID NO: 635557 - DNA, 101 bp, Homo sapiens
  misc_feature (98)..(98): n is a, c, g, or t
ggggtgatctagaggatcctctggtgatgatgtgggtgggtctctatgcctctcagtcttttttctggttgtcttgctattttttaataaaactaaanctt

SEQ ID NO: 635558 - DNA, 151 bp, Homo sapiens
agaaaacggccgccggatgagagctgggaaagtgagcacatttgggagctggagaacaggggttatcctaccctgtgactctgtacagctacataggtaccttactatactctagcatccatcatgacactggcagtctctgcatgtacac

SEQ ID NO: 635559 - DNA, 134 bp, Homo sapiens
gggctcactcacccaccacattaacaacataaaaccctcattcacacggggaaaacaccctcatgttcatacaacctattccccattcttcttctattcctcaaccccgacaatattacccgggttttctcttt

SEQ ID NO: 635560 - DNA, 363 bp, Homo sapiens
tatggtgcatatatcaacgattcagggttgggtttctaaccggactctcagattcatatatcctcacggactggccgtcgtttcaaatggacactgaggatgcagtgcgcaacacatggaggagctggggacaccgtgacagtggacaccatgatgaagcctgggcccacaacttatccaactacacgctcccggccttttatatggggaacttctccattcccagtgggatcccagacttgccccaggacacctttatccagtttcctggatggaccaagggccaggtctgcactaatggctttaaccttggtcgctattggccagcccggggccctcagttgagcttgtgtgtgccccagc

SEQ ID NO: 635561 - DNA, 468 bp, Homo sapiens
agcgatttactgtacgcatgataaccttgtccctttgtcgtcattggtccggctattctagcgcctgacccgccgaaaaggttgatcctgctcatgagccaagcccccctcgtcctggtggacggttcttcttacctgtaccgcgcctttcacgcgctgccgccgctcaccacttccaaaggcctgcctaccggcgcggtcaagggcgtgctgaacatgctcaaaagcctgcgcaaacagtacccgaacagtccgttcgcggtggtgttcgacgccaagggcgggacatttcgcgatgagctgtacgccgaatacaaggccaaccgcgcgagcatgcccgatgacatgcgcgtgcagatcgagccgctgcaccagagcgtgatcgccctgggcttcccgctgctgtgcgtcgaaggcgtggaagcggacgacgtgatcggcaccctggcccgcagcagcgcggccgct

SEQ ID NO: 635562 - DNA, 246 bp, Homo sapiens
atgttggctgaatccggatactggtatctccgagaatgggcagacccgatagcatgcccctctcgtggcttacacactgggtgtgaaacaagtaatatgtccgtgattacaaaatggattcctagctgagccggcctagagccagcaagagatatgaggaagtagttaaaggaagtctagcgcttacattaagaaaattggctacaaccccggtaagtgcaagggtatgggcccggtacatgcaag

SEQ ID NO: 635563 - DNA, 143 bp, Homo sapiens
acactctgtctggagagacaaaaagatgaaaaacacactacagatctggcagcagacactctgggcttgggctacttttctccttgtgttttcccagttgcgtcgtgtgtctttgtgtggatttcctttatgtatcctgcttg

SEQ ID NO: 635564 - DNA, 828 bp, Homo sapiens
ttcggaacccttgtgcgagcctgtgcggtactggcgttgttagacaccataggcgtgcttccgcagaagccggccacgactatggacgagcgccccaaatctctgtagctatcttgttagagtgtcgatgtagctctacgacaatgtcgcgggtttctcctgctgcctgcgaaagtgggtgtgttaggccgtaaacaaactaagggtgttaacaacggctttattgtgaaacggggcaacccccctgggggatctgcgttcaccatttgtagagggtgtatccccccccccccccccggcggcgaggcgcaacactcccccccggcatttggggaaacaaataaggaccaccccaaggtgaaacaccggtgtggtacccacaagagagggccccccaggggcaaccaacaatgtgctgggtacacacagagggattctgcgacaccaatttgtttggtcttaaaatataaaacaccgcggttgggatattttttcgcccaagttatagaaaaaagaaaagaaataatttctcgtgcgcaaaactgtaaaatgcttgggtggtgcccccctctaccccccaatggtactaatagaaatcagggcgttattacttggtggtgagttgcgtgaggcacacacagcttttggggcagaagaaaccgatatctaaacacacttggtataaaggtgagaagcacactttttgaaagatgggggaagacgccaaaaattaagaggcccccccaaccagtgctttcaaaaaaaaaagggaaaaaaaacttttcccgggggttcaaccccttaaaaaaaaaagaaaagggaaaaaaa

SEQ ID NO: 635565 - DNA, 431 bp, Homo sapiens
  misc_feature (8)..(8): n is a, c, g, or t
  misc_feature (28)..(28): n is a, c, g, or t
  misc_feature (34)..(34): n is a, c, g, or t
  misc_feature (74)..(74): n is a, c, g, or t
agttcganaacccacccctggccccaancatgantcctaacaaataaacattttaataaaagatgaatcccttncaaatacatattcctacagccccagttaaaaatgtgaaaaggcccatgaatcctacagacagcccatttataaaggtggatcagggcccggacacggtggcctcaacgtctgtaatcccggcactgtgggaggcccaaagcgggaggatcgcttgagcccaggagttcgagaccaacctggccaacatggtgagaccccatctttacaaaaaaatatatatatccaggcatagtggtgtgcacctgtggtcctgtggtcccagctactcaggaagctgaggcagttgaggctgcagtgagccacgttctggccactacactccagcctgggcatcaaagtgacaagaccaaaaaaaa

SEQ ID NO: 635566 - DNA, 486 bp, Homo sapiens
aaattcatcaatcaagtcagggtggcatttatgtggagcgtcggtctaggatctccattctggtcccatggttctaccatccaccaggtcaatgctacccggtcacaaggactgagattttttccttacggtattctcacgtagagcccagtaaaataatgacggggctgggagtcccatttctgcagggaatatagggggtgggaatcctgacaccagataaatcaggtatgcgggaaaaagatttcctatgtaaggcaaaagcttgatgggaggtgggcggcatcctttccgcatggtccatggcggtccagagggtggcggcgggggtgctataaatgctcccagcagctctcaggttttcttcccttcaagctagcctccccttaatttcccactccagccaaaaaaggatggccgggtatacgtctcggaggagggataccactcgtggagagggtatcattaagcttgagctttcagcaa

SEQ ID NO: 635567 - DNA, 803 bp, Homo sapiens
  misc_feature (659)..(659): n is a, c, g, or t
  misc_feature (679)..(679): n is a, c, g, or t
  misc_feature (693)..(693): n is a, c, g, or t
  misc_feature (701)..(701): n is a, c, g, or t
  misc_feature (721)..(721): n is a, c, g, or t
cccggggactttggcaaggctgctgcctacgtgaaatgatggaaaggtctaggctggccccaggtcctttctggcatggcctcaggatcttggcaggaggataacaatgccaggagggggtgggctgagtcatgtgcctcctctcaggggcctggctgcagtggtcaggggcagggtggctcatttagcgggcaccggtgccctgcacctggaggaggaccagcaacaggactagccaggtggccgcaggcccttaggacacaggggaggcccaggatttatgggaaggaaggagcagagcacctgagtctggggacatctcgggacaggcactgcccccagcagcctcagcttccccccataaaagggacagacgctgccccatgcctttagctccatcactgtccaggacagggactaaaccctagacccctcatccccaaggagtcttggactgcaggtccagctctgcagaggggctgcagggagcatccagggccatactcgtctgctcatctctcagtctctgtgtttatggaacaccaggggatgccagtgctgtgccaggaggggcggtcggtgctgagtgaggcctgcttcccaaatcaggcacattcttatgagactaagattgtccctgctcatggacattaaaaaantgtcaagacagcaggattangcggaatcacagtntcctgccnccagtcctaacagaataganaggaaaactagaaaatatcccagcgaaaaaaaaggcataccctttgaaattgtgcaagacaggtagtggtaagcctgaatca

SEQ ID NO: 635568 - DNA, 104 bp, Homo sapiens
gacctagaggatccccatgctgcgggggagatacatgatcacgaaggtggttttcccagtgcgaggcttatccattgcactccgaatgccaccccggatggggt

SEQ ID NO: 635569 - DNA, 847 bp, Homo sapiens
gcctggtgtgattccgtcctgcgcggttgttcctctggaagctagcgatgtctttatatctccgatccgtcggcttctctcgctacgctaatgtgcgtgccggcacccgatggaagattcgatggacatggacatgagccccctgaggtcgcccagaactatcttttgggtggtgaactaaaggtccgaacaaagattatcactttaaggtcggataatgatgaaaatgtagcactcagttatgcttgtagggaacggtacagatgtataggggctggtggaagaggatgagttcgcacgtcgttgaacgcagaggtaatagaattacgatagggcagctccaccttaaaagtaatcatctgggcatacctttctgacaaactgtctgtatcagctcaatcggtttatccctttgcgagggactttcgacaagtcataacatcccatcagctggatctttgagagtgtgagaccgtgtggcttcggggaccaggtgtcaatatttagttgggacgagcactttagctaaggcatcgtggggacgtgcaacggaatagtcacgaatgctgcccagaacggcgtcgcaacgacgggtagcgcagggcactgctgaaacacactctcttaaaggtactaaaacggggaaaaagccggtccactggtccctcgggaagagtggggacgccagggtttccccccgcgccagagagaaaagcccaagcacattgcgcgggtgggtcttaacacaccgtcgtcagacgagaacgactcccccttccgcccacagggctccacgttgtcaaccacatcagagcgccgccatctcccctgctccccgacgtccggc

SEQ ID NO: 635570 - DNA, 1109 bp, Homo sapiens
tcgtttcgcttctgtgaggtagttcaacaaaagaggagggaaaagagaaagacagtcaagtgttagttagtgagttgtcagaaagattgtgaccctcctcgagtcataagtgggttttcggcgcgacttttctgctatcagatgagaggttacttatgcccccccacaattctgatacgcgggataagttttgtgacctccccattcggcccgcgagatattctcgcgccgtgtatcacacgagacaacaaggggtagatggttatatgtctgtagatattcacgcgcggttgtatattcccccttcttcgtcttccttggcgcaaaaatagcgggtttataatgaaaggtttacacgccgcgcaatatggcaaaaaattttccccgtacgtttgttttcggtgttgggaaaatagaccccaagggcacttagcaaatttgaaagttgtataataaagctttcaggtgttacagaaatcgtagaccaagcacagggcacatgataacgtccaatagtgacccacctgaatagttactgctgcactttcactaagatgtaattgaacaccttggtgaatagggggtttatgttgtgttttttttcattatcgttttttttaattttgtggaagcacttgctatttagaactgcccaagtatatgttcacgcacgtgtgcccacggattgaaaggtgtaaatgggaccaaataaattgtgaaaggaagtgtagttgactgagaaactaccacgttgtaataagtcttccacctcttttataggatttttgaggcacaccattatcgccaataattttaatagtttattaaagtttacagtgggaattgtgaataagttttcacgtgggactattcttatcccttgaccaaaatattttgtcttttttctatgtaatttcagagtttttattttgttaccaaaagaccaaaatggaatatataaccacacatgaagttatttaacccagagttttctaaagcgtgaaattctttgtgtaaaataaggtattatcttgcaacttgttaaaaatatttattcagacattggatgttgtatttttaagtattttttaaaatattaataaaattta

SEQ ID NO: 635571 - DNA, 414 bp, Homo sapiens
  misc_feature (50)..(50): n is a, c, g, or t
  misc_feature (60)..(61): n is a, c, g, or t
  misc_feature (102)..(104): n is a, c, g, or t
  misc_feature (107)..(107): n is a, c, g, or t
  misc_feature (110)..(110): n is a, c, g, or t
  misc_feature (115)..(115): n is a, c, g, or t
  misc_feature (157)..(159): n is a, c, g, or t
  misc_feature (171)..(171): n is a, c, g, or t
  misc_feature (197)..(198): n is a, c, g, or t
  misc_feature (271)..(272): n is a, c, g, or t
  misc_feature (275)..(275): n is a, c, g, or t
  misc_feature (282)..(282): n is a, c, g, or t
  misc_feature (308)..(308): n is a, c, g, or t
  misc_feature (317)..(317): n is a, c, g, or t
  misc_feature (326)..(326): n is a, c, g, or t
  misc_feature (357)..(357): n is a, c, g, or t
  misc_feature (364)..(364): n is a, c, g, or t
  misc_feature (371)..(371): n is a, c, g, or t
  misc_feature (379)..(379): n is a, c, g, or t
  misc_feature (390)..(390): n is a, c, g, or t
gtcagatggcacaacagaagtcaccttgtaagtaaggcaaagaccttganggcattagcnnttctcattactaggtcaataacctgagggaatcaatggctnnntgncgntctanctcttgtgtatctctttgacttttctttctctgtctagtttnnntctgttctcagnttatattctatgctatcagtctctcnntccacagtccacaacatccatcctttctactgtgcaattctgtctctccctcttattatctttatttgtactnnttncttcctncctgtctaggcattgggcatgtgcancctcttagnctgtgaatnttgacacttaggactaatgataaattatttncagattnaatcagnccctggtnactaacccagntccaataagaagtatgttggtggg

SEQ ID NO: 635572 - DNA, 113 bp, Homo sapiens
  misc_feature (1)..(1): n is a, c, g, or t
ngtgtatcacaatgcgggcatgctccctgtaaagtatcgtcgacacgtgagcaccgtgcttgactcccaatatcgttaagctggagccctggtcgaactctatgaggaatcct

SEQ ID NO: 635573 - DNA, 149 bp, Homo sapiens
tctgtactacctaccctcgcttctcacagaaaggctgagaggctggcagaccccttgtatataccctgctcctttcgttttctttgagacagggtcttttaatgtcacccaggctggtctcaaactcctgacctcaggtgatccaccca

SEQ ID NO: 635574 - DNA, 481 bp, Homo sapiens
  misc_feature (5)..(5): n is a, c, g, or t
  misc_feature (118)..(118): n is a, c, g, or t
  misc_feature (131)..(131): n is a, c, g, or t
  misc_feature (133)..(133): n is a, c, g, or t
  misc_feature (223)..(223): n is a, c, g, or t
  misc_feature (245)..(245): n is a, c, g, or t
  misc_feature (260)..(260): n is a, c, g, or t
  misc_feature (268)..(268): n is a, c, g, or t
  misc_feature (270)..(271): n is a, c, g, or t
  misc_feature (273)..(273): n is a, c, g, or t
  misc_feature (275)..(275): n is a, c, g, or t
  misc_feature (282)..(282): n is a, c, g, or t
  misc_feature (309)..(309): n is a, c, g, or t
  misc_feature (321)..(321): n is a, c, g, or t
  misc_feature (323)..(323): n is a, c, g, or t
  misc_feature (325)..(325): n is a, c, g, or t
  misc_feature (418)..(418): n is a, c, g, or t
cactnaaaaaacttcttagagattcattgcacttctgagatttaatgtttacaacttggagttgtcgaccttcttaaaaaaaacattttggaagacaaaatgaaagttttctgtgaanttttagaagagtnanacaagaaggtacttcttggagccacacttgaaaatgacagccatgattacatcttttatctcaacccagcagtttcagatcaagattgtnctacagccacctccttagaatnggacaaacacctgtngtaaccanannangnatcaacncaactcagtaggtgtggctcccattanacatataacacntntntaatatttaaaaaccaactctcaaatgaacggttccaaaaaagtaatgctccaacagttaacagtgatcaaagtgatgacaacccggatattntcagtcaaaaccgagttccatacaaaggagcagaacagagatgtaataaaaattctcatagaa

SEQ ID NO: 635575 - DNA, 689 bp, Homo sapiens
  misc_feature (273)..(273): n is a, c, g, or t
  misc_feature (304)..(304): n is a, c, g, or t
  misc_feature (463)..(463): n is a, c, g, or t
ggctgtacggtccgagtttttggatcgacgcaggcagatcatgaggtcaagagacagagtccatcctggccacatggtaaaaccccgtttctgctaaaaatacaaaaattagccgggtgtggtggcaggcgtctgtggtcccagctactcgggaggctgaggcaggagaatctcttcaatcggggaggcggaggttgcggtgaggtgagatcacgccactgtacttcagcgtgggcaacagagtgagactctgtctcaaaagaagtaaaatanagatggaggtcatgctatgttgcccaggctngtcttgaactcctggcctcaagtgatcctcccgcttcagccttccaaactcttggattacaggcatgagccgctgcgcccagccagaaaataaacctttttattgcgaagcacccagtccatggttctttaatatggcaggctgagcagactgatgcanagggaacgtccttttacatcacggattgtgtccattgttggacacaatttccactcctccttatcgccttgcacatgcctgctttactcatcaacattgcctcaattctcttgacggtgtgtgagttatacctactaaaaaggctacttgtggacaaggtaagaactaattccatcttccaccaagctgaatgccaaactgttatcatcagggtgccttcccatca

SEQ ID NO: 635576 - DNA, 137 bp, Homo sapiens
tacatccatgtcaccgcagaagacatgatctcattccctatataataggctagcatagatatatccataggtagtatattatagacacattctaactttattcacgtactatcattgatagggcatttgggcataga

SEQ ID NO: 635577 - DNA, 274 bp, Homo sapiens
  misc_feature (69)..(69): n is a, c, g, or t
  misc_feature (103)..(103): n is a, c, g, or t
  misc_feature (222)..(222): n is a, c, g, or t
ataacagctcattctgaaaacaaacccctttctggcctggggaccagactgcctttttagggctagcanattagccacaagattagaaattacagtttaggantaatgcagctagaggccacaagattctaaacctccccaattgttcctaatggataatatcactattgtaaaacccaagattggtgctttaagatgtttttcagaccccgcactcatggntcagctggcatcactcagatggataaacttggctcatcctagtcctgtaggc

SEQ ID NO: 635578 - DNA, 263 bp, Homo sapiens
  misc_feature (142)..(142): n is a, c, g, or t
aactatttaaaaccaaagggtgtaatgtaaaggaattgttccattttgtagattggtatcattcagcttctttttttaaaaaaaactttagtggattgtgaaaataactgctttaaggacaaaattcttaattttaaatgcnacagaatttaagagcttgtttgaattaatgcaggacccagaactcattactgaacagtcactgagtatatatgatccaaacggcaaagggggtttattcttgaaaaagcaatcagcctagt

SEQ ID NO: 635579 - DNA, 392 bp, Homo sapiens
tacactcgaaaacaatacaattacatggcaattgaataacccactcctgaatgacttgtggataaataatgaaattacagcagacataaaagttttttgaaactaatgagatcaaatatacaacatactggaatctctaagacacagctaaagcagtgttaagaggaattatattttttgatctgggcatttagtgctacaaatgtttagcactaataaatttagtgctataaatgcccaggtcaaaaagttgcaaatatctcaatgtaacaacctaacatcacaactaaaagaacctggagaatcaagagcaaaccagttccaaagttagcagaagacaagaaataaccaaaaatgaaaactgatctataggagtggtgggggatcctcta

SEQ ID NO: 635580 - DNA, 104 bp, Homo sapiens
aatcgagtcggtcccctatgatcgcgcgcgtcaggccagtgactgaccatttctatttttagaacaagttcggtgcattttatctggataattcggatcagaaa

SEQ ID NO: 635581 - DNA, 480 bp, Homo sapiens
ccccccctgatcaagaggttgggccggaaaacgcccccgacgttgttccggggcagctccctgcagcagggggtcccgcatgggtatgctttttttcaagaagaacccggagctgttagtcaggaagaagtcatccgtgcttatgccccccccaaaaagaaatccaggaagaaataaaacatgaattttcctgactgattttaggaaaaaaattcagtttgttgcccccagtgttaacacatttttgtcagagaagacgggggtcagcagccaaaacaccaggaaacacttttttgtggccttagccaagcagtttgttagttacatattccctcgcaaacctggagggcagcccccaggggaagctatttttgcccccccaattggtttgcagggcttaccctaacttttgtttatgtcgttatgaagcattcaactgggctttgtgaggggtgaaattaaaaacattatgtttcccca

SEQ ID NO: 635582 - DNA, 237 bp, Homo sapiens
gctctagtggatccccttgggggtctcatactcgaatgggatacggggactcagcatctgggtggcctggctcctcaagggctattgctgtggaccagattacttctgcttggtcttctgctgtggctggttgctggttgtgactatatgactgggcagggctcagtgcaccttgttgttggcatggatctgtgaaccttgtggctggcagtgctacaggcactattggggtaggca

SEQ ID NO: 635583 - DNA, 131 bp, Homo sapiens
tcgactctagagatcccctgctattcatcggcaccacaggtgtagttgagccctagcaactccatcctcagcacccacaccaccctggagcactctgatagtgccttcagtggtagacagatgaggccgat

SEQ ID NO: 635584 - DNA, 106 bp, Homo sapiens
aaatggcacgaacagtgagttagccggctgcccccaggagctcatattacatggaacgattgattggtatgatgtacaggcatgtaaattaaagatagattgtgat

SEQ ID NO: 635585 - DNA, 181 bp, Homo sapiens
tcaccagcacaggctactatcacctacagtgccccctccaacacatacattgtagactgtggcagccctgtctctcagagggcgctgataacacatcatgaacgcccctaaaagattgggcccagagcaccgtgcatgaagcagaggaggaggaggaaggctctgtcccatagtactgagc

SEQ ID NO: 635586 - DNA, 1373 bp, Homo sapiens
ggcctacccgccgcactactgatcattctattgccccctctattggatccccacgctccagattatcgtcatctaatcttaccgactaatcaccagcccatacaatgactaactcaagactagacctcataaaagcgaaatcaatatccatacacaacactaagaggacgaacctgatctcttatactagtatccttagtcatttctatggtcgcacaccaaactaattcgctccttcgcgaacatcctcgtccctcaacttcatttctaacaccgcaagcttcaaccgcgaacgtactgctcaatacaagcccttagcgccccataggtccgaatccccctcgttagttgacgccgcggtgacgacccgttgcaccttcatatgccgtcggtttgtcctgcctccataagcagtatacagacgatgcccctagcgcccatgttccttagccgacgaagggccacaatccttaccaggccccactttagtccccgcagtaacgtaggcttctttaatgcggataaccacatcggatgccctatcgtcagtttcgacacccaaacctagccgcctttggcgcggctagcggccttatactctgctagagcactataacctgccaggccaaacctgtacatccattgacaatgcgtggatcttgagaaacagtctgccaagccccttagcaagagtcatcacaccgagttcacaactcgtttcgcacatcattacagcttaacttcagtctctcgaacgagattacttaaacttcgttacctgggacgtaatcgcgttagcaaaaatcggggtgctccggcccatttaaatcccgaaagccctcaagcttagtgaacaccaaccttccttaagtaaaggccgcgtccatactcatggcactgaatcaaaacgaacacaattaggagatgaaacacaaatctcttgaagccaaaaaccttcccaaaccaggcgtcttggtggttggggcccccgcgggagggcccttggcgcgcaatgaaagaacgtagtggttattacaatacactcactgcaaagatgtggggtccgccctcggtcgctacccccgacgtaaatcgttacaggagaggccaccatatctggtactgcccccaaggcagaacggttcccctgaagggggaccccctttgtccagctgattaccagtaggcgggcgtttgatgtccctaaggccataattacactacccacgccccggtgtagaacaccaagtgcgtttaagagaaatacccataaccacaaggtcatgtgtgtaccctaaggggtgacaatcataggagacttttattgaaccggaggcacacacacgcacgcacaagccatgtatcaaattgcg

SEQ ID NO: 635587 - DNA, 373 bp, Homo sapiens
ttgggcaactcaggtccctccgctcgcaagatgcgcagaaccaaaggacacgcagcagaattgtctcccaatgccaattaggcacgcatggaatgttctccaatcctcatctccttgacttaaaaagctcggttttttttttaaaagcagaacttcgcagttcctttagcggcggaatgtggcttagtgaatccccagcagaaggacacagaatgcagtgcttcataacccgtttttgacagaacatctattaatatctcccagaagaatattccttggatcacagtttggaaaatctggggagagtttatagcatatgcccaacaccatcattctctcttgtacaaggttagctaatattaaaccatttatt

SEQ ID NO: 635588 - DNA, 174 bp, Homo sapiens
cccctacttggatgcatatcaatgtggcatactgaagacatagttatgaagccagctaatttggccactgcgtacacttcctcaggtgaagcactagatgtttccatataagaggtagtaatatatagtataatggaagaggacagcatcctgaggtaccactcccactgccct

SEQ ID NO: 635589 - DNA, 620 bp, Homo sapiens
gcccgacactgaaatgtgttggagatgattatactgctgcctcaaggatgaagaacaatgaagtaaactcagcaatgctgggtaggtttgtaccgatatctgctaccaagacgagcaaaaagctcagggtgtgcagtccttttaaatagtttttcatctaacgcaagagaaatacacttcggcaaagttcaattttgaaccgcctcctgtggcttttacataaaaaagctttatgcatttatgtcgtaggactcaggcagttcatattagttgctgttttaggcactgctgtaagtactaaactacaacagactcaagaaatccagtttttcaaatatgattattaaatggctctcaaaataacgttatggaagttacactgtcagaaggatggtgacttgacatgtgatgcactaaacatgcaggttttaaattctgccttgtcctaaacatcatataatcaaccaaagtgtagatttgataatggacctcaacaaggctcacatttgagaaatgaaataacagagatgaatagacttataggttcatcatatcaaagaggtaatcatttgtgactttccaatattttaaggatacaagatcggataaacttacttcat

SEQ ID NO: 635590 - DNA, 475 bp, Homo sapiens
  misc_feature (63)..(63): n is a, c, g, or t
  misc_feature (113)..(113): n is a, c, g, or t
  misc_feature (120)..(120): n is a, c, g, or t
  misc_feature (132)..(132): n is a, c, g, or t
  misc_feature (146)..(146): n is a, c, g, or t
  misc_feature (165)..(165): n is a, c, g, or t
  misc_feature (187)..(187): n is a, c, g, or t
  misc_feature (210)..(210): n is a, c, g, or t
  misc_feature (219)..(219): n is a, c, g, or t
  misc_feature (288)..(288): n is a, c, g, or t
  misc_feature (445)..(445): n is a, c, g, or t
  misc_feature (466)..(466): n is a, c, g, or t
catttgtaagccacctcaacactagcccttacaaggttccatgaaaggaggaaaacattaaanctttcctgcctttgcctgatataatcccacatagtaataatttaagctanaatttanttttaaaatgantgcctcttgggaancttcttttctgttcctaanagttccctgttaaaatgaaaancttaggccagtgcagtggctcanacctgtaancccagcactttgggaggctgaggtgggtggatcacttgaggtcaggagttcgagaccagcctggccaanatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccancctaagcaatagagcgagacnccctctcaa

SEQ ID NO: 635591 - DNA, 1166 bp, Homo sapiens
gacttccgggcaggcttcctgcgctggtgagtgcagtgtgggcatcccagcacgtgacgttctgccacgggagaatgccgagcccctcccgcaattacagccccgaccctgaattaacatccaccaaataataatacaaacaagaccatcttagccaccaaacaacaaaagaaaataagaaacacaaaaaaaaccatgaaaaacaaaaccaacaccaataatagacactatgacacctaccacaaagacacactactatcctaccaaacacacacaaaaacaaaaacacgacacgcccccaaaaccagtaaacaaaacaagatatacatcattatatcccaccatatcaacaagcacacacctaacaaacatcctaacattacaccccctcaccaccaacaccacaaatgataataatagtacaagaacaaaaacaataccacataaaactacactaacactaacaataccaaaaccccacctcgaacatctacgtatccacacacacactacaccccaaactcacagccaccacaaacaaccaccgacactcataacacaaatactcagaccactcaaatacaagaccaaacaacatgattacataaatacatagagaataaccacacttcaactaacaaccccaaagcaatcatgcataattctctacaactcgaatagaatcgaccatcatacacagcctatacagcacaaagtacagtatatcaactagcatcttctcagcacacaatcattacatccatcgatcagccaacggagactgagacccgaggtaagatgagaacagatacgtaggacaggaaagagaggagacagggcgggaggagcagagaggaagacagaggaacgaagcgggaaaacgcgcgaagcacagcacacgaacacacagagctaaaggcgacacaaaaaagaggacgagagaaaggagaagcgagacgacgcaaccagggcgccaacacacgaacagagagagcgacgcgacgaggagacaacaagcagaaagagacagagcgggggaggcaatcaaatggacagagaagacagggaactcggatcgaaagcgacgcagtatgcagacagagcggagcagggacgagcgactacggagcaggagcagacgcgcggctcgcttgagagatgagaga

SEQ ID NO: 635592 - DNA, 469 bp, Homo sapiens
  misc_feature (16)..(16): n is a, c, g, or t
  misc_feature (79)..(79): n is a, c, g, or t
  misc_feature (117)..(117): n is a, c, g, or t
  misc_feature (252)..(252): n is a, c, g, or t
  misc_feature (267)..(267): n is a, c, g, or t
  misc_feature (270)..(271): n is a, c, g, or t
  misc_feature (275)..(275): n is a, c, g, or t
ggggagggggggggcngggggggggggggggcggcgctccccctccccccccccccgcgtggcgggccgggcgggcganattttttgttgggggcccccaccaataataaatatatnctttttaaaccacccgcggggggggggtggggtgttaaaaaaaaaaaaagggggggggggggggtccccccgccccccccccccgtccgtgggggggggcccccccccccccgcgggggggggtggtcctgtttnccccccccccccccnccnngcgnggggggaggggggggggggggttttccccccgggggggggggggggggtgttttttccccccccccccacaaaaaaaaaaggagggggggtggggggggggcgcccccccctggggggggggggggggagaagaagcggcccccccccccccccgccgcgcgagagagagagggagattgttctttttttttat

SEQ ID NO: 635593 - DNA, 295 bp, Homo sapiens
gttgtcaggtatagacagaaaaaaataatcaaatgtatagtaggtagggattgttaaacctaaaaatcattaaacgaaaaccacgcaactagattcaaaagacgagacaaaaaaaaccgaaatgacgtaattaggattcaaacagaactacgggtattacaatcctactactctgttttcctacctaatacgcacgaaatgcggactttacgactgccccttactgtcctgtagacccaggtgcatctcaaagtattagcacaggtctactaggtatggacatataaatgaactt

SEQ ID NO: 635594 - DNA, 374 bp, Homo sapiens
  misc_feature (32)..(32): n is a, c, g, or t
  misc_feature (66)..(66): n is a, c, g, or t
  misc_feature (117)..(117): n is a, c, g, or t
ttccccccagggccttaactgtaggcccaggnaaaataatgcctaaagcacccaagtgtgtgcccntccttcattaaagcctcacaacacacctgtgtggtacatccttatcatcanccccattttacatttgggatgatcccccatttgcatttgggaaccaaggcttaaagagtgtaagtgacttactggacacagagctagtggaaccaggaaataaactcaggtctgagcttctcccagcattcccaccccacctgacaccatgttggcaatgtcttaagtcctggcccagttgagagctggtattcctaaattctctggggtgtctgtgggaatttactcccctgccctttttctctgggtagctggag

SEQ ID NO: 635595 - DNA, 1150 bp, Homo sapiens
tttctgagagacgtcgttgcgttgacgtccttgagtgctgattttggcgctattttatttaacagctttgtgtagagagttgaggcttgcgtgtgcggagttatgtgtcactttcgtgatctcacgtattatagcctggcgcgttcagagtgttgtaaaggtggggtgttgtagcattgttactcatgagcgccaatttgttggtgtctatttgtagcccgggcaagggtcatgagttacacttcgactgttcaagccgtaacaccagggcaagggttgagtaatgggtaagggtcttatgatacgttatgttcgtgaacttcgtcctatcttaccccgcctgttaaccttaatcatcacctctagcatcaccagtattagagtcaccgcctgcccagtgacacatgtttaacggtccgcggtaccctaaccgtgcaaaggtagcataatcacttgttccttaagtagggacctgtatgaatggctccacgagggttcagctgtctcttactctcttaaccagtgaaattgacctgtccgtgaagtaggcgggcatgacacagcaatgacgagaagaccctatggagctttaatttattaatgcaaacgagtacctatacagaagcctcatcaggctccgtaaatctacctataaccatgcaattaataaatgttcggttggggcgacctcggagcagaacccaacctccgagcagtacatgctaagacttcaccagtcaaagcgaactacgtatactcaattgatccaataacttgaccatacggaacaagttaccctagggataacagcgcaatcctattgctagagtccatatcaacaataagggtgttacgaacctgcgatgtctggattcaggatcatcgcgcgactggtcgcatgccgcgtatctaaagtgttcgtttgttcaacgagttaaagtcctacgtgactctgagttcacgatccggagtaatccaggtcggtttctatctacttcaaattcctccctgtacgaataggacgaagagaaagtaaggcctacttcacaaagcgccttcccccgtaaatgatatcatctcaacttagctactatacccacacgcacccagacggctgtgcggggggggggggggtggggtggggggtggg

SEQ ID NO: 635596 - DNA, 686 bp, Homo sapiens
cccacgcgatcgcaattttataatctgtaaaatggggacaaatatcagtgcttatgttaccagaaaaagttcacgatccagatcccaagagagggttcttggatctcacaaaagaaagaattcggtgcaagtccaaggagtaaagtaaaagcaagtttattcagaaagtaaaggaataaagaatggctactccataggcagagtagcagtttgggctgctggactaaggatacttatagttatttcttgattatatgctaaacaaggtgtggattacttatgagttttccaggaaaggggtgggcaattcctggaactgagggtttctcctctctttagccatatagggtaacttctggatattgccatggcattcgtaaactgtcatggtgctggtgggcatgtctttagcatgctaatgcattatatttagcatataatgagctgtgaggatgaccagacgtcacttttgccaccatcttggttttcatggatatgggcaaggcttctttaccgcagactgttttatcagcaaaatttttttgacctgtatcttgtgctcacctcccatctcatcctgtgactaagaatgcctcacttcctggcaatgcagccaataggtctcagccttattttacccagcactatccaagatggagttgctctggtttggacgccctggaatg

SEQ ID NO: 635597 - DNA, 491 bp, Homo sapiens
gcattcgacaatcgtgtcgacgccgagcgccttgatggcctgcacacattccacccagcgcaccgggccgaatgcctggcggtacagcgcatcgcggatgcggtcggcatcggtttccaccgccacatcgatgttgttgaccaccgggatctgcgcctgggaaaacaccgtattggcgagcttttctttcagacgctcggcagccggcttcatgaggctggaatggaacggtgccgacaccggcaatggcaaggcgcgcttcgcaccgttggccttgagcacctcacaggccttgtcgaccgccgccttgctccccgcgatcacggtctgcgcggggtcgttgaagttcaccgcttccaccacctccaaagtgccggcgccaaatgtggcttgggcctctgcgcagccagcaatcacgcgctgggcgtccatgccgaggatggcggccatggcgccggtaccgaccggaacggcttcctgcatggcggccg

SEQ ID NO: 635598 - DNA, 120 bp, Homo sapiens
cactgcttcaactcgtagccattatgggcatcacaatgatcggtattcgtcgaggtcaacgtcgaaaagattctgctggcggcggaaaaggttttcagccgagaagggctatggcagcac

SEQ ID NO: 635599 - DNA, 543 bp, Homo sapiens
agtcggagcagaacggtgtacaacgagctctgagttctccgtacgcactttgagtagttgaatggggctcagggcaagagttttgctgccctccccagcgtggtcacagggttactggacggccgtgcacttgtttctcatgcaactccagcattttccccagaagttgaactatggatagcagcttggtatggatttcctaaatcttaacatttgaagcagcttcttgaggctggcaactatcctggtttctgtcttggagggggtggtttgtttgctggggcccaacgtctgtcccaagtggtggggtgagagtaagttaactttggtgccaggtgagaggtgggggctctttgcttagactccctatcatggaaagatgggagttttctatgcagggcactggggaaaaggatggctgattctgactgaccctgatcagagagattaggatggtattttgacataggatttggaacccatctaaatgttgaagttccctgagacagctctccagctgctgagcctgcgccaggggctacg

SEQ ID NO: 635600 - DNA, 108 bp, Homo sapiens
catagaggactcgaggaggggagatatggagagggagaggaatatggaagggagaggacatatggagaggggagaggacatatggagaggagagaggacatatggaga

SEQ ID NO: 635601 - DNA, 465 bp, Homo sapiens
gggaggcgaggaggcagatcacaaggtcaggagatggagaccatcctggccaacacagtgagaccccatctccactaaaaatacaaaaaattagccgggcgtggtggcaggcgcctgtagtcccagctactcgggaggctgagccaggagaatggtgtgaacccgggaggcggagcctgcagtaagccgagatcgtgccactgcactccagcctgggcgacagagcaagactctgtctcaaaaaaaaaaaaaaggattggtttttccctcggcaggtgggttgtgggaattgaagaaaaggaatggggggatgatgccaaggtatgggcgctatgtacggggaaaggtggcgagcggaacgggtggggggaggaaattgaggagtcctttcctctcggggtttccttgccttccaattcaagggccgggaattttcaacagctaggcaggatgatggtctcgggg

SEQ ID NO: 635602 - DNA, 210 bp, Homo sapiens
  misc_feature (155)..(155): n is a, c, g, or t
  misc_feature (197)..(197): n is a, c, g, or t
actgttcatcagtagctctgtatataggcagagaggtcacaatgaatgacagttcagcgtgagtatgtagacttagcagaaggaacatgtttcgttgggagctagaactcaaggtgccctggtgtccgtgttgaaggagccaacgtccaagaggnccagaagatactcaacaacagcggactccccattacttcagncattgcactccgg

SEQ ID NO: 635603 - DNA, 323 bp, Homo sapiens
cctctgctcgtacaccagcataatctctgccctacaaccagcacaatctcttcccctacaaccagcacaacctctgctactacaaccagcacaacctctgccccgtacaagcagcacaacctccactccacattaccagcaaaacctcagctgctacaagcagcacaacctccagttctgaaactactcccagccacatcagggacaagccccacgctgccaaaatcgaccaatcaggaactgccaggaacaacggccacccagacgacaggtccacgtccaaccccagcaagcagtacggcgccaaaggttaccgagctcga

SEQ ID NO: 635604 - DNA, 110 bp, Homo sapiens
  misc_feature (12)..(12): n is a, c, g, or t
  misc_feature (102)..(102): n is a, c, g, or t
cccttggtttcncggctttgccctcttcctttttgttgttttttttcccgccctttctcccccttggcccttgttttttcggcctgggtttggggttggggntgtccttt

SEQ ID NO: 635605 - DNA, 325 bp, Homo sapiens
  misc_feature (163)..(163): n is a, c, g, or t
tatgcaaaccatgttacaagctttattaaatctatgctccaaaggccgggcacggtgctcgcgcctgtaatcccagcactttgggaggctgaggtgcgcggatcacctgaggtcgggagttcgagaccaggctgaccaacatggagaaactccatctctactnaaaatagaagaattagctgggcgtggtggcacacacttgtaatcccagctgctcgggaggctgaggcaggagaatcgcttgaacctgggaagcggaggttgtggtgagccgagatcacaccattgcactccagcctgggcaacaagagggaaactctgtctt

SEQ ID NO: 635606 - DNA, 155 bp, Homo sapiens
ggctcgcatgttggcaggctgtcttgaatgcctgtcctcaaggacacccacctcagcctcccaaggtgctgggattacaggcatgagccaccaagcctcaccagagtcctttttttttttttttggaaataaatttccactctgtgtggcccagg

SEQ ID NO: 635607 - DNA, 946 bp, Homo sapiens
aaattccgaatgtacaaagtagaactgatgtggtggtgtggtcgtgtctcgtgaaatcgctagcgtgtgcatgtgtttgaccagctgagtgaagatcagttcgcagatttcagatgactgctttggcactactttgacgaacatggtgatggcactataaacaacaatagtgatttgacgaactgtaatgagtatcgtcctgtggaggcagtaatgccctaccttaagctgtagtgtaccggcatcatggagtttctgaatgttagctttgctggcagtgggttaatggcacaattgtacttccctgaaattctcctcgtaataatggaatggggatgaataaaagaatgggcggacacatcactgtgacggaaggacaatggttatacacgctttcctcggtgtttgctaagggagggtaacgcctatattagtgctgcggaattttcgcctcgtgaatgacaaaccgcttggagcagaagtcctcgaggctgcaagcattgttggtgtaactcgcatcaagtggagaggcgagatattgagtggctagagtgcccaagtggagctagtgacgaagttcgtcattgatgacagaagtcaagacccgtatcagaatgtgttgaatctcttgtgctacagttgtttagtagccgtcccatgggtggaacctatcccttggggttctcccttcttgtcttcacactctgcaggtctcgtaattcgattcatgctcatggtttgttcctttctcggcatgtctgaccttctgtgacctgatgccgtcccggtgccggtggttacctggcttttagccgtgtgcactagtagtggggggcatagtacactggtggcgcgaaatttgcagacgtgggggggggtctcggtcggcgccatttggcgtctggggttccacttggcggccctggtgtggtcctccccccctctt

SEQ ID NO: 635608 - DNA, 602 bp, Homo sapiens
  misc_feature (520)..(520): n is a, c, g, or t
cccggggagagggggtctcaccagtgtcagacgggtctcgaactcctgacctcaggcaatctaccctcctgggcctcccaaagggcggggataacagacgtgagctactacacccagcctcagtatatttttaaaacatacacttattcgaagttttcctgaaagaaacagataaccgggtaaaggctaaaggctaagggagtacatgaaagtaaatgtcacactccaggcaagccaggtttttctttataaacagagagggacataattaacccaatatcatccattcattctttccatagacatttactattctcagcaaaaatccaaagaccacaaaattggagttctcttacggatattggggatgtaacactaactggtagatattcttactctctcagggtgggggggcttatagctatctaggttagaagagaaggtagctgtaaagtagggtaaaaagtaacaccggtatttcgccacttacttagctgaaggacttcagatatgatgtggntctgtgtctccacccacatttcatatgaaattgtacttcctaagtgtgggggagagacctggagggagagagtgtacgggcc

SEQ ID NO: 635609 - DNA, 546 bp, Homo sapiens
  misc_feature (546)..(546): n is a, c, g, or t
acccttttttaatgttattcagggagggggcctggttttgttgggagggtttgaggagcgagaggtttttttttttgttggggggcacaaaaaagccctttattaggttggacctagaatgcggggcgggcccccataagactaaagccccgttgtacttgaccccgtcggggacagacccgggcattttgcccttttacagggggaaatttttttttaaggcctgggtctttcgggcacccctcaatttatttcacagatttggtttttaaaccccggcgcctagtgtgtgaccctttaaaggacacccctattgctgcacaccttagtttttttcaaatgttctaagcccctcttcataccatgggttcccccccaggacagtaacgggaaagggcctccccccaacctctttgaagggtttttcttgggctttggagatgccaccccggaagggttgttttttcaagtggggggggcccccctcaggggttttgaagaatattttttgggctttggccaaatatttcatccgcggggttcacn

SEQ ID NO: 635610 - DNA, 366 bp, Homo sapiens
  misc_feature (22)..(22): n is a, c, g, or t
  misc_feature (39)..(39): n is a, c, g, or t
  misc_feature (49)..(49): n is a, c, g, or t
  misc_feature (54)..(54): n is a, c, g, or t
  misc_feature (74)..(74): n is a, c, g, or t
  misc_feature (78)..(78): n is a, c, g, or t
  misc_feature (115)..(115): n is a, c, g, or t
  misc_feature (210)..(210): n is a, c, g, or t
  misc_feature (232)..(232): n is a, c, g, or t
  misc_feature (263)..(263): n is a, c, g, or t
  misc_feature (266)..(266): n is a, c, g, or t
  misc_feature (280)..(280): n is a, c, g, or t
  misc_feature (293)..(293): n is a, c, g, or t
  misc_feature (296)..(296): n is a, c, g, or t
  misc_feature (316)..(316): n is a, c, g, or t
  misc_feature (341)..(341): n is a, c, g, or t
  misc_feature (346)..(346): n is a, c, g, or t
  misc_feature (356)..(356): n is a, c, g, or t
cgacgttgcatgaaccacaggnaacagaaactagttaantagtcttcantctgntccctatcaaatttaatacnaacnaaatgagataagtatacagtggtctcttcttcctgangtctaaatggactgagccatcttggatcctagagtggcagtacttgcttgatgatagaaatgagtacagagaagtcttgtcctgatgaagtcatnatcaagctcctgggggacaganctgtgcctattcaaaaaaaaaaaaacttttnaantgacctttatgtanccttctagagatnacntcaaggcctatgaggactcngtcacacctctcctaaatatccatnggctncaatactacntttcgtccac

SEQ ID NO: 635611 - DNA, 245 bp, Homo sapiens
aattttgcctcacagaattgagagtttgttcttacacacaagtttaatgccaccttcctcttgtcttgccattggaccaacaagcaattatattgcttgagttaaacttaccccacaagactcaaggcccagaaaggttcttcaccttcatctcttcctccgggattgtcttgtcacgggttcacctctggcatcaattttgcccctagaaccttaggtctgcctcggagttattctctctgctt

SEQ ID NO: 635612 - DNA, 363 bp, Homo sapiens
atttttcaactctacaaacttcccccattgttcctagaaccaggggacctgggactccttggggttgacaatcgagtagtactcccgattgaagcccccctttgtataataattacatcccaagaggttttgcccttatgagctgtccccccattagggttaaaaacaaatgcaatttccgggggtttaaaccaaaccccttttccggctacacggccgggggtatactacggtcaatgctttgaaatttgtggagcaaaccccagttttatgcccctggtcctaaaattaattcccctaaaaatttttgaaataggggcgggttttaccctatagccccccctttaccccctttaaagccca

SEQ ID NO: 635613 - DNA, 1649 bp, Homo sapiens
  misc_feature (697)..(697): n is a, c, g, or t
  misc_feature (1137)..(1137): n is a, c, g, or t
  misc_feature (1226)..(1226): n is a, c, g, or t
  misc_feature (1327)..(1327): n is a, c, g, or t
  misc_feature (1329)..(1329): n is a, c, g, or t
  misc_feature (1365)..(1365): n is a, c, g, or t
tttcgtcctgcttctctatctctctcctggtgattacgtgtcttacttgttttttttatgctctccttctctattacattctttatttagtctgtacttgcgttcgattgttttgctaggatgtgtctgtcgtgggtattgtactcatgtctatggtctaggtcttgttgctttaggatgtattcgcgtatttgtaatttatcggtcgttctcattgttgttgttgtcagttactgcattatgtctcgtttgttggcattctcttagttgtttgtgcagtgttcctgtgtcttttctattggtcttcttcattttttcttactatttctctgctgttggtggcgtgtgctacttcttacctgctggtctggttcttgttgcgtgatgtgtctgtctcgtcctgactgtgtcgcgtgggggttcgtaataaacagagatcttcctttttaagtgggaaccccgttcgaggattcctgccgctgtgggtgaaactcctccattcgccaccgcccgtggtttttgtgagaacccgttctccccgattagggagaggaaccacgccccggggggggctccgaagttctccacacgcctcttctccgggggactttttttagggctcttttaggcctccccctggggggacccgggaatttacacccaattttgtccgaccgcccacagggggtacaaccangcctttaattggacggctcattttaaagggcccctttaatattttaagggttggcacccactttatttagggtaacacaaagattttgggtgcacccaacaaaatagtcccagcgcccttgggtgaacacacgggttctctcgggaatatttcccccgggagatatttcttcgttctgaagcgcacacacccgcgggttctccgcgttgtaaaaaagcgcacatctttttttcgcacaaatagtggttctcgctcaaatgccccgcgccctctcacttggcgtctcgcgccgcaacaagctctgcgtctttctctcgcctcgcggcgcgcgctctctccttctctcgctccgtctccgccggacatctccggccagacgatttttatctgcgcacagagagattccccctgtagacatcttctcgcgcttgtctctgttnttttaatactccccctgtcgcatctcgggatctcacactgtgcgcgtgcgccccgacaccagtaggtctcagaacacgccagactccgnttagaacccccagcgttcccgaaattccacccacccacaaggagctttaaaaggtaggataagaaaggagaagtttttttggagaagagaggccaagagananatatgtgagatagaagaccgcccccctctgctctanatccgggagatatgctctaatatgagggagaaatatggggaggcacggagggctcgagccacatgagggtagacgcaaagaaagaggagaagaacgcgtggggagggaaagaaggaaggagggaaggaaagaaaggtgaatggtgaggaaagaaggaatggaagaatgaaagaatgaaggaaagctgagagtcagctacgggcaaacgggcaggctgaagatgatgaggatgacgatgtcgataccaagaagcagaagacccccgaggatgaactagacagcca

SEQ ID NO: 635614 - DNA, 945 bp, Homo sapiens
  misc_feature (898)..(898): n is a, c, g, or t
cgcgcatgttatatatcttcccgcttatttcaccacgaaagctacatatattatggtacccccgctaaatctaacaaatccggctcgcattccgtcgcttttatctttttgtaatcaacatctcctatcgcgtcggaccgcctcaattatatcccaccatctcgcctaatcttttttatctcacatctatagaaaaacgccccgcattacttaattaacccgcccaatcgaaaactttcgccagtctacctacagattccgttattagaatcccgggtcaccccatccccttcccagacagtgtaaggtgactaacaatcttcacggcgcagccaggttgtgtccgccgatgtcgtgtgggtttgcggttgccatagtaagactataccggctaattggtccccggggcagtccctcgagagtgggcggaggatgcacgctggagaagtgggaggtggggtggtcggggcgtgtagccgttccccacaatgtcggtgatacgcggccagtgggaagattgcggtccgttggtggtgtgcgggtgggtgagtgccacgatggcgttgattgagaggagggggcctcagaatgagccgcccggggggtgtacaaggaagcgggagggagagaatacagggacagctcaggaggacgggcgcgtgtcaggttaccggccggagaaggtatgtagaacgtagtacgtgagctatgggagtagggatataggttgcacatgccggagtacacccaataccgaaccaggtgtagcgtgtgcatgcacgcgcgggacacgatacagaatgaggagataggtggatggtgacgtgatgcgatgagcatatcaaagtagtgattcctgaccgtgatgtagtgttacaatgaggcgcgattgaccganacttctagcggctgttatatatgtatgggccagggagtgtggcgtgt

SEQ ID NO: 635615 - DNA, 304 bp, Homo sapiens
actatttaggtttcattgaattttttttcttaattgccagtctggtgaagtttatccacggtggctatgcaaccttgattatttatgctcgctattttgctggtgatggtggtctggtattatggtaataagcgacgggaagccatttcaaagcaagatgattatgtgtcattgaaggattatcgtaagcaactcatcaacctgtcaaaggatgacggcggaccaatttttgcgcgaatttgtctacattgcgcatatgcatcaaaatatatgctaaagcggtcaatgatctattcaattcttg

SEQ ID NO: 635616 - DNA, 838 bp, Homo sapiens
  misc_feature (404)..(404): n is a, c, g, or t
ggccatcgatggtcggtgccagtcgggaaagaacctttaccaggatggattgatgacttaaatggaccaagtggaacttgcatttattgctgggagggataggacattcgttcgaactaatacgtgctcatccatacgaatgcgccattagtcaggaatcattgttccatgctagatgtcatgtctcgtcaacggatgcagtcttgctggcagctctaggtattcctggtaggttaatagaccaagagaaaccatcatgggtggtatcaagttgtacaacgagtgcagcgacgtgaatccatgttccgagctggtgggtcgaaggttggaagtacctattgtacatttcgcgagcgtttcgaagcagcgaatcgcttctcagagagcgaggccttgtcaggacnggcccaatactgtataatcttaatcctctcatatcatcgttatagtatatcgagtgtgacgtgtggatttgcgtgtaaagctcaatatagggccacaagctatttccgtagtaattgattattctaccgtgcgaggactgagctgggaaggaaggcccgaaggtatgcactgaaaacaagtaacgtcgtcttcagcaaatgctatggatgtttctttgcaatcatttcacaacgtaattctatgggtatggaagtgactgagcaatgtcacatatgtgaaggaatcaagtaaaccctgaagataaggagagaccttcaagtattgatgtacggcagttggcttgggcagaatatagtggagaactactgcttgggaactaagaaggtacgtattgaatggaagaaatgtcttgggctccctggaggcaggaaaa

SEQ ID NO: 635617 - DNA, 145 bp, Homo sapiens
gacaatcatggaccaggaagtcatacatcacatacatagcataaatgggagagtaatatgagacctagagttaaattacacccatgaaacatcaaccacatgtcatatcaattacacgtgtgtaacattgatataatcgggtaca

SEQ ID NO: 635618 - DNA, 194 bp, Homo sapiens
tggctctgaaaacactttattacacaaattactttcagattctggaaaatagtggtcctaacagtgtacccatctaaaaataagacatcccaaaaacacaccaactggaaagaaaatttaaaaaaagaatttaaatagagacttttttattcccttcatggcaactataagtgttaggtgattttaaaaaaaaa

SEQ ID NO: 635619 - DNA, 974 bp, Homo sapiens
  misc_feature (541)..(541): n is a, c, g, or t
  misc_feature (589)..(589): n is a, c, g, or t
atggatcgtgcgagcgcaagtaggtctgccagaggctacgtccctgtagtcatagaaagagcttatcacctttcatgatcacgcccgtcagtggaatcatttgcacttatctgcttccatagttcctgtttgcccttgtggcctaactactcagcgaagggagatctgatagctaactactaacatctcgagtacgctcatggacatagaaagcgtctgacatcttagtcctgtcgccgtcccactcattcctattgcgcgtgcatactggtcgctgcccggtcacctgacggcattcctatgtatcaatataactagtagcagaaggatactcacgatactctcatctcactttatccattcataatcaatgggtgcacccgatgggtcactgtaactctacgagtgatcatcgacatacgagggggactactcgtatctaatcttccttacaaatacgtgtctcccactattatttccgtatgagacgctagtgctgaccttgctgagatcgtttgaagcgctttgacgagtcagatgntaagatacatctcctgatatccgaaagaccaaccatattccgtactcnatggttacatttttgacaagaccagtcttttgtcagcatccaattgatgctcgtctccccaagctatttgaggcgctcattatatataattaggattcgatagtttactcctgggaactgttaataataaacggaaacctgtttatttcaccggcataacagcatgaaccgggtgggtgatacataaggaagtgctcattgctccttgaagatgctggttggaagctaaaacaccgactagttctttatcgccccatcggtacttatgaactttgtagttaccccttttgaagtccttctgacaataggggcccggaattttaccctaattagaaccccctttttaccccccttctaagagaccagaaaaaattttttaaaaaga

SEQ ID NO: 635620 - DNA, 321 bp, Homo sapiens
  misc_feature (85)..(85): n is a, c, g, or t
aaggctactctcccagagcatcctttcctcccgcctggggcattatccatctggtgttgaaggtcatatcaacctgactgggganaggggaccatgcctaagaggacggagaggctgatgatcactgcaaagagctcccattgcatcatgccaggattgagaacatgtctctgccggtgcccgtgcgaaccagcgctattagagcatggatgaggggtgcataaaaaaagatctggggtccagaatggagggttcctccaagttcacatgaggctactcctcttataggcttagtacttgttccttagtaacaataagagc

SEQ ID NO: 635621 - DNA, 92 bp, Homo sapiens
  misc_feature (89)..(89): n is a, c, g, or t
gcggccgcctactactactactgctcgaattcaagcttctaacgataatctggggacatgtaataaaggtgtttattgttttgttcccnttt

SEQ ID NO: 635622 - DNA, 405 bp, Homo sapiens
  misc_feature (26)..(26): n is a, c, g, or t
  misc_feature (75)..(75): n is a, c, g, or t
  misc_feature (121)..(121): n is a, c, g, or t
  misc_feature (136)..(137): n is a, c, g, or t
  misc_feature (199)..(199): n is a, c, g, or t
  misc_feature (208)..(208): n is a, c, g, or t
  misc_feature (214)..(214): n is a, c, g, or t
tgggggaaggaagcccccccccccanaaccccttttctgggcgggtctgcaggggctgggagaagggcagggcgnttgtgagagagaagacctgttccataaggaggacaggtaacttctntgccctgggaactcnnttggcgggggggaggggggaccactggcccagaggcgctactgaaatgtatgagaagctggntgctgggcntggggnggaaagggggttgtggcagaaacagggaaggaggtaggtctcttcccccaggaggggtgggaccggcaggggtgacttgaggggctcctactcctgccccacgttgacaatcagtatgtctgttatgtgcgatttttcaccccgttgtgttttgggtcaggattttaaagaaagatatttttatggtaaaa

SEQ ID NO: 635623 - DNA, 126 bp, Homo sapiens
agcacgttaccacctcaactcccaaagcgctgggattacaggtgtgagccaccacacccagcccaacaaagattgatcttattatcccattttatagatacgaaaattgaggcctagggaaatttg

SEQ ID NO: 635624 - DNA, 246 bp, Homo sapiens
atccctgcccgcaggccagtcatagtggctgcagcatcacgttcgttcctgcaggccacagtgagaagtaccctgtgatttgatgaagagtaggacgtcggggaagggttttggcaggcagcaccatgtctggtttctgtgccggctgtggtcaccatcaccacttggttccaggcaagttgtactggtggcctgcgctcagcgtgttgccacagagggcacaggtactctcttggaggcagatta

SEQ ID NO: 635625 - DNA, 833 bp, Homo sapiens
  misc_feature (497)..(497): n is a, c, g, or t
cgcggtggctcacatctgtaatcccagcacttgtgggaggccaaggcgggcggatcatctgaggtcagttggagaccagcctgcctaacacggtgaaacccctgtttctattaaaatacaaaatattagctggtgtggtggcacgtgcctggaatcacagctactgtgggaggctgaggcaggagaatcgctgtgaacccgggaggcggaggttggcagtgagccaagatcgcgcatgtgcactccaactggggcaacgagagcgaaaattctgtctcaaaaaaacccaaagaacaaaaaaacgaaccaaaaaaaaaaaaaaaaaaaaaacctggggcttccctcgagtttcccatttcaggttatggtttactcatcctcttctagtcatttcccttgtgcctcagaatcgtttacagaaaagacagtctaagtttaaaagttcagctatagtaagagccttgtttattaaaaaattatcatttcccatgcttganaagaaaactagagtgaaactcaaaaggagatattcaagtcacctcagtaagtctaatatgttgtaatgctgtaagtttaactttttaatccacttggaagtatattaccaataaatcatttaagatcaaggaaaactcattctatgtgacagaaccattaatttccagtggtctcaccttgttttaagggaagatgtagaagttacactttttggttaagaaaggaatttcccggtgaagataagagccaaatttgggggaagcgggacactcttttggtcaaggggtgggggggagtatagcgcacacacgggaaaaggaaatcctgggcaactg

SEQ ID NO: 635626 - DNA, 133 bp, Homo sapiens
ttgttgctgacaagaactgttcacaactacacttcatacctcctaatatttattgttgtgatgctgggacagctgcagacacagacatgacaaaccagctcatttcttccaacctggagctccactccctctc

SEQ ID NO: 635627 - DNA, 336 bp, Homo sapiens
ctctcttcactcctgagatactgcttctggaagcggctgtcacttcctctctagtacctcttctcttctctgaagtgtgtgactatctcctagtgtttaaatttggcagtaactcgccatgtatgtcagcatataaaaggaaatgtttttaccttatctcctggctggatgatagaacctttaatgaaatggccattagggttcaatatccctggtttaaaaaatcttgttcatagattaaaggtgctgctgtggacaggagggaaaaaaaaaccctctacatatcgaaaggcaccaaatgtaatatctgacactgataagatgcccaaatgagca

SEQ ID NO: 635628 - DNA, 135 bp, Homo sapiens
tgttgtactgtggtggtgagtgagcccattgtgtcgtgggtaatatgtagagggagtatagggctgtgactagtatgttgagtcctgtaagtaggagagtgatatttgatcaggagaaacgtggggtaccgagct

SEQ ID NO: 635629 - DNA, 332 bp, Homo sapiens
  misc_feature (161)..(161): n is a, c, g, or t
actagaggatcccccaggcgcttgtggacccatatggggcaccgtgatgttgcctatattgtggtgtgtccagaaaatgagtgcttgtccgaagggagcaaaactttcttcagggacttgagtgccgtatacgagatgtgtaggcttgggcagcacacgcncatctgcaaagtactacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcaagcgcctgg

SEQ ID NO: 635630 - DNA, 521 bp, Homo sapiens
  misc_feature (68)..(68): n is a, c, g, or t
  misc_feature (70)..(70): n is a, c, g, or t
  misc_feature (74)..(75): n is a, c, g, or t
  misc_feature (80)..(80): n is a, c, g, or t
  misc_feature (89)..(89): n is a, c, g, or t
  misc_feature (93)..(94): n is a, c, g, or t
  misc_feature (97)..(97): n is a, c, g, or t
  misc_feature (111)..(111): n is a, c, g, or t
  misc_feature (147)..(147): n is a, c, g, or t
  misc_feature (259)..(259): n is a, c, g, or t
  misc_feature (274)..(274): n is a, c, g, or t
  misc_feature (289)..(289): n is a, c, g, or t
  misc_feature (300)..(300): n is a, c, g, or t
  misc_feature (321)..(321): n is a, c, g, or t
  misc_feature (347)..(347): n is a, c, g, or t
  misc_feature (355)..(355): n is a, c, g, or t
  misc_feature (357)..(357): n is a, c, g, or t
  misc_feature (376)..(376): n is a, c, g, or t
  misc_feature (402)..(402): n is a, c, g, or t
  misc_feature (408)..(408): n is a, c, g, or t
  misc_feature (413)..(413): n is a, c, g, or t
  misc_feature (416)..(416): n is a, c, g, or t
  misc_feature (418)..(418): n is a, c, g, or t
  misc_feature (447)..(447): n is a, c, g, or t
  misc_feature (460)..(460): n is a, c, g, or t
  misc_feature (462)..(462): n is a, c, g, or t
  misc_feature (487)..(487): n is a, c, g, or t
attcttccttcccccaaaacggaaacttgttagcaacttccaaccaaaaaattttgccagtgttcacnangacnntcagnggtcatgtntggnnatnagtgcccagggatntgcccaagtatgccttgtcctcttgtcctgtttgcntttcactgggagctgcactatgcagctccagtttcctgcagtgatcagggtcctgcaagcagtggggaagggggccaaggtattggaggactccctcccagctttggaagcntcatccgggtgggtntgggtagacaagctntggttttgtcncccaggctggagtgcagtggngcaatcatggttcaatgcagttttgnccttttgngntcaagtgatcctcccaccncagcctcctgagtaggtgggaccatnggctcncaacnccncncctggcaaatttgattttttttttttttncagagacggggtntngcaacattgcccagacttcctttgngttagttaataaagctttttcaactgcaaaaaaa

SEQ ID NO: 635631 - DNA, 953 bp, Homo sapiens
  misc_feature (496)..(496): n is a, c, g, or t
  misc_feature (515)..(515): n is a, c, g, or t
  misc_feature (550)..(550): n is a, c, g, or t
  misc_feature (738)..(738): n is a, c, g, or t
atagtcaagatatgaactaagaaattttaatgcaagatacatacattccctgtaacagacggggaacttacaattactaagtattattatcttgttgtaaaatggatgtacgaggtggtgcccatgaacgtggagaaatagtgtgtacgggagtttcttaagatctcagagcagtatatcgccatagtggcctgtgacgcattgttacagaccattcatgagcctagaggctcaaccatattcgaagaaggcgacaattgtacctgagtagataaattgtactgcaagaagctatagtttcccgtaattatcttgcacaacgtatttatcaaaattagaattacatttcaataaatttaaggaagtaagaatagaacgtgatgtgagagcactcgaggtcaggcaaaatgcaggtatttacatatacgaaggtcaataccgcgtggtttaattttctctctataacttggtgaaattgtttggtgaactttcgttntctctatcagatgcctggngtagcattttcggggctggatctggtactgtattnggaacttcagcgtggagtttttgaagagaaggcgattaagtagtggccgtaatagctggagacaggggaatacgagggcgtggttgtagagttcacgggagcttttgtggagaaagagccaagagacacgtggtgacgagctgttatttaacgagggcattacactaagcaggggaaagagataatcncatttagatctttgaaggcgttgggcaagatgcggggtaacaagtactgggaataatcagagactcgtgggacaaagcgaccgaaaactttccctttgtggggagaggaggggatttccgtgatctaatataaagcgacaatattttttagaactttaacaatattttatacattttcgcaggtaaatggttgacctttggtaacttatatttaa

SEQ ID NO: 635632 - DNA, 173 bp, Homo sapiens
tcgataatcttctggtcttgggatataggttcttcaaactcctggtagtgtcatggccagctagtgcgccgatgggcttggagcatagcgtgctcaaaagcctggataatcggaacggtttggacggcaccagcctcttgaagccagggcaggcagacctgagcaagccaggc

SEQ ID NO: 635633 - DNA, 760 bp, Homo sapiens
  misc_feature (214)..(214): n is a, c, g, or t
ttgggccctagaagggggtaaagggggtgctatagggtaaatacgggccctatttcaaagattttaaggggaattaattctaggacgatgggcatgaaactgtggttggccccacagattttcagaagccatttgaccgtagttatacccccggtctcggtgttagcggtgtaaaaggtggttgggttatagaacgtctccgggaatatgtgcntctcgtgtttttataagccctaagtggttgggaacagcctcagtgagtgtgcacagaacgctctgggtgagtgttaatttatttattacaaatgtgggggctctcaatctcggggagagttacatacctcgaatgtgtgctcaagcgtctcagaggaagtctcgccaggtctccgccgtggttctcatagagaaattaaagtcgggggcacagttaatgttagcgaagtcttgaagaatttagtctcccgcccgatagtccaggggtgatcctctcgtataagagttctcaggatcacccatgtgtgggtgtgcgcccatgtgtgatttgtggacgtggatacagggagaagggaactccgtttgagcacccctccggtcgtggtatatgtgttacaagggagagtcgcgtataagggaattgtgagaaggggcgagaattagagcgcaccctaggggatgtgcagtgcgcgggcgccagagaatataggtctcaaacacggggttcccatattttttcccgtgaaagcgggtctttggaaacttt

SEQ ID NO: 635634 - DNA, 1459 bp, Homo sapiens
  misc_feature (344)..(344): n is a, c, g, or t
  misc_feature (485)..(485): n is a, c, g, or t
tctgggaggcaaattctccctttgtcaccagggtggagtgcaggtgggtgccatgtcttcgtgcttcagtgtggaggcatcgtgtgtcttcgggcctcagtgtggagcctctcgcgccttcccgttatttcaaggcagattcgtcctgttgtcctcaggcctccgtgagttagcgtgggaacatacgaggtgtgttgcaccaccatggcccgcgggcataattgttgtgagtatttgttaccgtataaacaaagcgaggtgtatttcatctgtgtgtgtgtgtggcacaagagatgtggtgtcctcatatctctctcagacccctctcgtgtgtatctctctgnccacacctctgtgtggtctctctctcacaaaaggtgtgtgtgtgagagattataacagggggtgtgtgtgacctctacacacatgtgtcccacaggccaccttatatgttttatctctcttatattctcccacagctcttnttctgtatctctcacatatatagaaaacatctctcttgtatcttatatatcttcgtcgcctgtgtaaaaccccatatatgtgtagagatagatagatataatagtctagcgcgcgcgtgtgagagagtgcgtgtgggcccacgccgagtgtgggtcttcacctcctccacaacagagaaagtataatttctcccctgtgtgtgcgtcagaaatatgtgagacaactgtctgtgtgcgtcccccaaatgatgagacagtgatgacctgtggtgtgagagccgattctctacacaaggagggtgtgacaccaaatttgtctccctgttgtgtgtggcccccagaatgtgtgtgtgtgtccacgtgggagaacaaacgggtgtgggtttccccccctgtgtaagaggggcctagaaagtggcccataagcttgtgtcgccgaagaaagaaaaagctggcgcaatagttgtcacatagtttccccaaacccgttgtcgcggaaacgctgtgaaataaccgcggtggggctatccgtagggggacgatataaaagggccaaattgtgggggtgtaaacctgtactataaaatcctctgttgtttccccccaaaatagtgggggggggtgggcgacccctttatatcccgtagaaagatgtgggtcacaaggtggaattctcccctgttttggaaacatcttacctataaaatctttaaccataattttcccaagactaaatttgggggcaccttggagtagttgccccccttggagaggtacattcccaacgcgaaacaccgtctcgtgtgggcacctctaattccgagggggaaataaatgtgtttgggacaaagcctgaaaccttttcgcggataataacacagttgttccatgtaattaacgagagaaaccaaaacagagctgttccaaacacaagaacacacattgcgctacacatcttcagctcgtcacgaacg

SEQ ID NO: 635635 - DNA, 447 bp, Homo sapiens
gctaacgagcaccctcctctttcccccaacacttgcaggcacgtgtgcgcgcccaaaaacacacacacaaacacaggcacacaaacagatgcacagtctggtacaccccgctggtgcgtccatgactgctgggcattgctgggaaaatcctttccaccttagggatctccccagggccagggccgggtggtcattgctggaccacgccactgcaggtggggttctggcagggttcacattcccctgggatggccatggctcccagaacctagcacttaccatattttcctttaattctcaagaggatgaaggctatgaagatgagggagccaaggaggagaattcccagaacgatggaggggatgaggagcattagctcccgagattccttgtgctctattttcactgtcacagaagattctggaaactagaattccaattcaggaa

SEQ ID NO: 635636 - DNA, 149 bp, Homo sapiens
tgcctctccagagactcgtcgtgccgcgcaaagactccaggtcgcaggtcaaggactgcaactggcgccgtgtagtcgttggcttcgatgcttggcctggcggagcagctccgcgttgcgggcagtagtgtctgtcaggtctgcaaact

SEQ ID NO: 635637 - DNA, 1024 bp, Homo sapiens
  misc_feature (308)..(308): n is a, c, g, or t
cgcaggcgtactgatcattgtatcatcgccctcgattgatgcctctcctccacatatctcatttagcaaccgtactatttaccacaccaactctgactagtcaaacttaacctcaagtcaaatgtttggcttccgcaaacacatgggggacgagcaccttgattctcttgtcctcttatccttaatcgcttgcctcgtgtcaagtagccacctcgaaactcctacctcatgcattcccctgcatgcagccaaacaatctattccactagcacatggacactcacccttccactagaagcggagagacnagtgatttggttaataatagcttaattggcatctcaatgattcaatatttgtgctcgtagtcgctcgacatgacgtgtgaagcgacaaagggaactaacgtgatcatacacgcatatgaatcccgcgcaaatatctacgcatggtaatcagtaagacctagtcagtctctacatcattccatatccgaataatgaccgtgcgatccgtatgcctctaatgcaatgacattacttgctgagccatactacatccgtgcatcccttgtcggagagcgccacctcttagacctgatcatagcactcttatttcttcgccttcttactggcattatctatccgttcaccgagaactaagtatctcctggactatcctatgaatgtctggtgtcggccttacatcctttgctgacgttatctgtgttttgttcagcctctaccgtgcacagacacgcttaagacaagaagttgggtgggtggcactgcgttgcctgttgggccgaaaagttctgaaaaccggtgggttgccaaggggggctgagggcgactgttttaaagatgtactttctcaggattgtaatggtctacctatggaaattgcgattgggattgttggaagagggtaattggggggggattactgaactccgggaatggggtctggtagttcaattacgttgtggtacaaccgaatgcggttggagtggcgattttagatt

SEQ ID NO: 635638 - DNA, 282 bp, Homo sapiens
cctgtactctgtcacagcttatctcgggagcctgaggcaggagaatcgcttgacctgggaggcggagtttgcagtgagctatgatctgcgccactgcactccaaccaggcgtacagcaagactccatctcaaaaaaaaaaaaaaaagaaaattcacctttaacttggttgttaggtgctatttgaaactcagggcttgcttaatatccgggttctcccattttttctccccttagagtgaaaaagttcgctgtgaggaggggctctctctcttaaagtctca

SEQ ID NO: 635639 - DNA, 868 bp, Homo sapiens
cgatgtcaacgacctgttgaagtttattcggccactgcacgaaggcaccctggtgttcgtggcatcctacgacgacccagccaccaagatgaatgaagagaccagaaagctcttcagtgagctgggcagcaggaacgccaagggagctggccttccggggacagctgggtgtctgtcggggccaagggtgtgcacgaacaagagcccctttgagcagcacgtgaagaacagtaagcacagcaacaagatacgaagtgctggcccgaggcgctggagatggaaggctgtatcccgcggagaagcacgggccaagctatgcacggtccagatgccaggaccgggccgaggtgaggccagaccatgggaggcgcgcgcgctgccgggcggacagaggctgaggctcacaaccccaggaaccctggagcaggagacgctccctggctcccaatcaacatctggtgctccgagtgcagtgaccaagaaccgtggtctcaaggtggtgggggctatgggtgcttgcagggggtagtcctgccgtactttgttcacgggagcccagggtacccgctccttttcgtaagactgttcccccccggtcaggtccatctagccctgtgctccgattccttcacgccagtctccgtccccgatcttgagtcctgtgtaacggcccttggtgcctgcccctcagtgtgcaagtctgggagcaggcctggcgggttggggctgtcttccagaaacctctcccttttgagcactctgcgctgcgggctaaacctgtttccgtgtgattccttcagtgagccgaacccggggggtggttttgagccttgattgctctcgcctggtcttcagggaagggcgcctt

SEQ ID NO: 635640 - DNA, 246 bp, Homo sapiens
  misc_feature (86)..(86): n is a, c, g, or t
  misc_feature (100)..(100): n is a, c, g, or t
  misc_feature (191)..(191): n is a, c, g, or t
  misc_feature (196)..(196): n is a, c, g, or t
  misc_feature (234)..(234): n is a, c, g, or t
ggacaggcagtgttcctcccgatcagatcccggagcccgagcgcagcaggagcgccatgaagagtgatggtgtgtgagtctgattntgagctgggagagngcagataagttggtgcatggcggccctgcgcaagcatctcaccctaccaagtgcctctacaatgggccattgtctgtggtggggtcttatncatcntgtgggtctacagtgccactgaaaaacgatcttcaggnttctgggagata

SEQ ID NO: 635641 - DNA, 852 bp, Homo sapiens
aattctgttgatcctcatcatcaccttcatagtctggggatcgtctgagagaactagtgagagggactcatgccctggctatcaggtgtggtgaagattgtcgtggttgacataggacaacgcacgtggaggcgacggaaaacgcgaagatgttggatagatgacttgcctgagggtcgctcgcctcgctcactgatacattgaatggcaaagagagcgagacatagctcgcacaaggtctgctggacgtccgtcgtgggtgtgacccggtcgcgtcttccctcccattcttgtccacgcggcatttcatccttgttgtgttgtgcgcgaggatggaatgtagggtaatacgagaataagacacgggatcaaaataacacggattcacatccagaaacgtaaactatgaagacgggacctcttctcacacgcgtcatgtcgtggggcaagaaggagccagctggttagtggaaatgaaagttcccacttgtttctgctccacggtgcgatgtgtgtgtgaacagcacctgggatggcttccaatgaacttcctttagttcgcgaagggcttggataaggacaattacaaggtgttagatgacgatgagctaatcgcatgataccagggaagatgggcgtgttcgtatgcgaaaatatggcgatgtgggtaaacgcatgtacatcggggcaagtggcttaggattgctcgggacatcatttggacattatttccttatagggacttgtgggggggcatacatagggaagcatgaggttcctaattgaaggggaaagaagtaaggggccaagatgtcccccaatggttgtgaaaggaattgcctttattaataa

SEQ ID NO: 635642 - DNA, 352 bp, Homo sapiens
  misc_feature (73)..(73): n is a, c, g, or t
  misc_feature (325)..(325): n is a, c, g, or t
  misc_feature (328)..(328): n is a, c, g, or t
attttattctttaataagagcaaccatttcttttatcaacagactgtttcttagcaaaaagggaggacgtatngatgtcactgctttccattctactaagttggtatttgtgttcagatttagggattcctgtttgcccgaaccgttcatttatcttttaccttgtaattgtcccaacagccctgtgaggtaggataattatccctattttaaaattaggtaaggaagactaggagagcataaatgactatgtaagaccccttagcccaacagcagtggggcccaaggttcaaatctagacttcctgggtgaggactctgggttngtngttaaacttaagctgtgggtggca

SEQ ID NO: 635643 - DNA, 498 bp, Homo sapiens
atcgtagtcggtagcccggacggggcttaataagggctctggtgtactctgtgttagagacacggagatggcttcaacgtcatggggtttcccagcaattagtctcagagcaaacatgcagcaaacaggattactgagttccttcctgcccctcctccaccccaagtgaccacttggtcggctgccactagggtcagagctggatgtggttcccaacccctcctccataggaggaggacagtcttgagagcagggaactggcttggtcaagaccaggtcaaatgtactcaccactggccttgtacccacaaagccccttttcgtacctggtaatacctggctctccagccacaggaaggcagagagggaacacctgaggctcaggcctgacttcccacactgctccttagctgccaagggaggaggaccgcgtctagaacacctcacattgaattcccaaaaagctctacactagccccaagtgacccctctatacgg

SEQ ID NO: 635644 - DNA, 274 bp, Homo sapiens
ttcctggagaactgagggtgaggggagtagatgctcgcagcacaggggcattcagagtctagaccattgaagatggaaacaaacaaaacaccttagaaccagagatcgacccctcaagcaatacatcaaaatacccttcacaagaaacgtcggggctacatgagtatctgtgtagaatgcggtctgaaatgatcctatggattatcccggctggttgccactgctgtacaacattcagtgaccacatccacctgtgccattacgcttatatgag

SEQ ID NO: 635645 - DNA, 448 bp, Homo sapiens
aactctcatagtgtccagagagcagctcctagaaggtcccgcagagaaatgaacgagcgtatccataggggtgtggacacatgtttgaagctgatcccagagtaaccgtgatcaaccagcagagctccaggctcggtaggataggcgcctatgcgcatagattatcacagcagtttgctacataaacggacgggctgacgtagctgatctgagagagctagtaggctcagagagggcaagacattggctgtcagagcgtcgtagtccatagggaattcagtacgcagtagggataagggttagtccaagcagtacaaagcaggggaatgggacacactctcaccgttgcagaagagtctctatcgcgctagcgctctctctctctctgtctctctctctctctctctctctctctctctctctctctctctctctctctctctctctc

SEQ ID NO: 635646 - DNA, 1331 bp, Homo sapiens
  misc_feature (474)..(474): n is a, c, g, or t
gagagaactagtcttgagttttctttttgtttttccattgggtccctaaaaaagggaattgtttccaagaaaaaataaaataaaggggccttttcaatttataaaaggcagagttttcccttggcgaggatttaactccattcccagttcaccatccgtgggttgcagtctcagagacaagtttcacccgcgtgtggcttcagagagacattcgtgctatcgctttgtgccggagaaggcttgaaggcagccactccttgaagggtcttggggcaaacgcgcggaaaacttaccggtgcctgtcaggtggtgtccacgacctgttctgaacacaattatttgttctccctggacatggggggcttcgacaaccgagcggcgttaccacaagcccggttgtaaaggcccatttccttggaacagttacattctccctttaaagaagtcgctcgagaccacaggcagtgtgcgccnaatattcgcgccatacttgccctctcacgtgctcttaaacgggcccgtgagaagagaataaggcagggagcactacaatgcccgcgggtgtgtggccccaccacatgacggggacacagtgttttctgcccaaatcaagacaaagatatcatggaaatttgccggggctcacgataaaccttatctggtcgacaagttttgcaaacgcggctggcctgcacaccgtctggcaacggtatttgactccttctgtatcccccgtgggcgaccacacagtactcctccttaccaccaagggtaagaacctagtcacacgcccaccaattcacaccagtatgacaacgcccccagagccctctgggcatggtctggtacataccaaccctttccccccatcaaattggtgcgagcattgtcacgacatcaagtactctcttccccacgaagtagaactacagctggccatcttcacccttccgacgccacccagtccgatgaggcaacacaacggtatctaacaggccccccctttttacgaaccgcgcccagcctagcaagagtgtttaccacaaacatctcacaccttccccattccgcagaacggcccccccacatgtgtctaagcagaacaactctcgttgaacaaggagatagataaaacacccttcgggaacacacgtaggagatattcccccaacttcgtgtgccaaaataagtgggagcaccaacgagaccacacccgtttaataacccccgtataatagactactgcagccgccctgcaaaatgctgccattacccccacaagaccaccaagtgaggagtccttggtgtatatgaagtaacttaccacaaca

SEQ ID NO: 635647 - DNA, 1181 bp, Homo sapiens
atgagcccaatacgcaaaatataaacccctaatacaataaatataaaccactacaactacatcagacctaccccaccccatccaaacatctccgcatgactgaaactatcgagactcactacctatggcagcctgacctgatcctaccaaatacaacacaggactcattcctagacacaatagacactattttcagccagacgacctacaagcggacaaattcatcaatcgcaccacatacactacgcagaccgtaacataatggctgaatacatacacgacataaacttacacgcccactggcggcaccatcagagtcataccctttagtcatgcacctccttccctaacacattcgaggccgagcgcctactaatatacggcatcaatattcgtcatactcacgcaaaacccagaaacaatcgggaacacataagcgctacctgcctagcaaaactactaagcacaccaagccctgacaatcccgcagtaaagatacagccacgagggagggccacagagaatcaagaaccgcgagagagggccacacaagaaccaacaacccgcacagaaaacaacaacagacaaagaccagatgacaaggaggaccacgcaccaaaacaacaaaaagaaaatcggaaaacaagcaaacgcggaagaaacagaggcaaaaaagcaagaaaaggagacgaaaagcagaagccacaacaaaaaatgaacacacaaaaaataaggacgacgaaggacaagactacagagagaagaaaacaggacagcgaaacaaccggaagacaaaaaagaggccaaagagagaaaaacaccaaaacaaggcagagagaaacagacacaaacacacgcgaagaaccaacaaaagaaagcaggaccacggaggaactaagacaaacataaacagcggaaggaaagcagcaaagaaccaacacaacccaccagcgagcaagcaggggcgcccggagcagcagagaagacaggcaccaagaaaccagccagggcaaggcacgaaagagcgagacaaaaaagagggaaaagcagagaaagaaagggggaacgaaggagagaagaaagcagaaacagagcaaaaaggagacagaacagaagaagaaaaaaaggaacaacagcaaggcagaagaaaaacagagacggcgaaggcgaagagacataag

SEQ ID NO: 635648 - DNA, 277 bp, Homo sapiens
tgccattcaacccagcaatccttgtaatgtgtatctacgcgaaggaaaagaagtcgttaagtcaaaaagacaactagacatgtatgttgagcaaagcacaatgcacaattgcaaagatgtggaatcaacctaagtgcccatctgacaatgattggatatagaaaatatgatatgtatgtatacaccatatctatacacgatatatatatcatatatataaccatatatatcagatatatacccatctatctatttcatgaaattgtacttcgctgta

SEQ ID NO: 635649 - DNA, 150 bp, Homo sapiens
tctatatacggtagtcacttcaacttcgacaaggagtcataataaccactggacaatttgacgttcatgaaatttagttcaaaaacatcccctacaggagtgaaggatgtcttctggaggacagtggctctggaagcaacagatttagca

SEQ ID NO: 635650 - DNA, 152 bp, Homo sapiens
ctcggaccggatagacaacctggcagaagataattaagaaaatagaggttggggctgggcgcagtggctcacgcctacaatcccagcaccttaggaggccgaggcaggtgaatcacgagctcaggagattgacaccatcctggccaacacgg

SEQ ID NO: 635651 - DNA, 149 bp, Homo sapiens
cgactctagaggatccgccgagctggcactcgagggggcagaaggacaggtggagggaagcgccccagacaaggaagctggcaaccacgccagagcagcgtagggaccacctcgtcttgatctgacttgtcagagctgacgagagactc

SEQ ID NO: 635652 - DNA, 174 bp, Homo sapiens
gtattcccatgagcagcagagtcgagtgttagagtgcaggatcagagcggggagaggctgggcggagttggcggcctggaggctgcgccctgcgttacttggctgacgtgcagagcctctctctgggcgcgctgcagctcactcttggggcggagcctggcactcagcatgccc

SEQ ID NO: 635653 - DNA, 753 bp, Homo sapiens
  misc_feature (1)..(1): n is a, c, g, or t
  misc_feature (157)..(157): n is a, c, g, or t
  misc_feature (184)..(184): n is a, c, g, or t
  misc_feature (187)..(187): n is a, c, g, or t
  misc_feature (189)..(189): n is a, c, g, or t
  misc_feature (207)..(207): n is a, c, g, or t
  misc_feature (213)..(213): n is a, c, g, or t
  misc_feature (245)..(245): n is a, c, g, or t
  misc_feature (268)..(268): n is a, c, g, or t
  misc_feature (312)..(312): n is a, c, g, or t
  misc_feature (319)..(319): n is a, c, g, or t
  misc_feature (348)..(348): n is a, c, g, or t
  misc_feature (351)..(351): n is a, c, g, or t
  misc_feature (365)..(365): n is a, c, g, or t
  misc_feature (372)..(372): n is a, c, g, or t
  misc_feature (378)..(379): n is a, c, g, or t
  misc_feature (381)..(381): n is a, c, g, or t
  misc_feature (385)..(385): n is a, c, g, or t
  misc_feature (388)..(390): n is a, c, g, or t
  misc_feature (398)..(398): n is a, c, g, or t
  misc_feature (403)..(403): n is a, c, g, or t
  misc_feature (412)..(412): n is a, c, g, or t
  misc_feature (416)..(416): n is a, c, g, or t
  misc_feature (427)..(427): n is a, c, g, or t
  misc_feature (430)..(431): n is a, c, g, or t
  misc_feature (434)..(434): n is a, c, g, or t
  misc_feature (439)..(439): n is a, c, g, or t
  misc_feature (450)..(450): n is a, c, g, or t
  misc_feature (456)..(456): n is a, c, g, or t
  misc_feature (460)..(460): n is a, c, g, or t
  misc_feature (475)..(475): n is a, c, g, or t
  misc_feature (482)..(482): n is a, c, g, or t
  misc_feature (486)..(486): n is a, c, g, or t
  misc_feature (499)..(499): n is a, c, g, or t
  misc_feature (505)..(505): n is a, c, g, or t
  misc_feature (511)..(511): n is a, c, g, or t
  misc_feature (524)..(524): n is a, c, g, or t
  misc_feature (527)..(527): n is a, c, g, or t
  misc_feature (529)..(529): n is a, c, g, or t
  misc_feature (612)..(612): n is a, c, g, or t
  misc_feature (614)..(614): n is a, c, g, or t
  misc_feature (644)..(644): n is a, c, g, or t
  misc_feature (732)..(732): n is a, c, g, or t
ngggaggctgaggaaagcagcattttcaccaaattggtgtaaaaataaaatggggtccacacgtgtacactggcagctacagtaaatttaaaaatctgagcagcaatttgaaccatttcttggaaaaacaaacactgacaaacactgagttggtgcntggcgcggcccgcaggcttgggaggcnagnancgcatcatgggtgcagcnccgcantgtgggcctgcatccggggaatccagcaccanaggggaggtggccgggtgaccgnccacgcaggcatgagccaggcctggctgagagggggccgcagcnagcaggnccggatggcctcccgcgcctgcagggganatncaggaaatgggtgnagtgtgngggaanngnatgntgnnngaggagtntttgnagggtgganaggnttgggagtatntannagnaatgnaataaataagnaaatanaagnggagaaagaacaagnacaaacnccantggcacacaaggnccagcncggttnctgcgggcgtcanggntntacacagaacaggagtatccaagtaggcggctccggtgttcccgacgtgccaagggaggcggcgggtgggtgggacacgcctnangcccacgtctagcagcctcggggggcagtngcactgggcctggcagggtcccatcggcaggacccttccagctctgctgcgcggcggtgaggtggggatggcggacgggtctccagtngcaggtgggggcgagggccta

SEQ ID NO: 635654 - DNA, 164 bp, Homo sapiens
agcgtccatgtgtgtacacacaaattgctctgaatcccagtgtccatctgtgcaatagggcagtgtgcagtctttctgtcagggtcagcaacagacagcctcactcacccagccacacccagtcagaccccaaccagttgcaaaaaccactagatgaccagcac

SEQ ID NO: 635655 - DNA, 373 bp, Homo sapiens
aggagtagaaaactaacacttattttatatgtgacagatataccacaaggatataacatcagtgcaatataattcacaataatctatattacagctagttaatcagtttatgaattgttcccgtcagtcacattttttgtccctcataagttcattccttatgatttcaacctactctctatttctagctaccttgaagttaataatgattattagaagctttcctaaggagttctgaaatctttgtataccagaggccaatctatcatcacctctagtctgctctcatcaactgcccttgtttttttcagggagtattctctctgatgaaagtccgacaccaatgtagtcactatctcccatgtcaaatcta

SEQ ID NO: 635656 - DNA, 435 bp, Homo sapiens
  misc_feature (108)..(108): n is a, c, g, or t
  misc_feature (123)..(123): n is a, c, g, or t
  misc_feature (126)..(126): n is a, c, g, or t
  misc_feature (140)..(140): n is a, c, g, or t
  misc_feature (146)..(146): n is a, c, g, or t
ggagactgccttttgcaggtgcagagatcggccttgcagtttgcaataatgtctgaaccaatcagagtccttgtgactgagcagctggtcaaattgcatattcactgntgtacagtattgganatngatctgtctttggnaaagancagcccatcattcttgtgctgttggacatcacccccatgatgggtgttctggacggtgtcctgatggaactgcaagactgtgcccttccccttctgcaggatgtcattgcaacggacaaagaagagattgccttcaaagacctggatgtggctgtcctaagtgggctccatgccaagaagggaaggcatggagaggaaggacctacttgaaagccaatgttgaaaatcttcaaatcccagggcacagccttggagaaatacgccaagaaaatcagtttaaggtcattgt

SEQ ID NO: 635657 - DNA, 384 bp, Homo sapiens
  misc_feature (375)..(375): n is a, c, g, or t
gcgcaccgagcgggtcggcgccctaaggagcggcactttttaaaagtgcaccggagaccagcctaagccgctgcatctgtatcagcgcaggtctgccagtccagctgcggcgcccccagtccgcacccgttcggccaggctaagttagcctcaccatgccggtcaaaggaggcaccaagtgcatcaaatacctgctgttcggatttaacttcatcttctggcttgccgggattgctgtccttgccattggactatggctccgattcgactctcagaccaagagcatcttcgggcaggaaactagtattaataattccagcttcttcgacaggagtctatatttctgatcgggagccgggcgcccgtcagtgatgngctggtggg

SEQ ID NO: 635658 - DNA, 723 bp, Homo sapiens
gggacttgagcgagccagtgccggattattctatttcccgctccctctctcccgccccggtatctcttttcacaccttctcccaccctcgctcgcgtagccatgggggagccgtcggcggccatcagtcgcattccatcctccatcgtcgtccttcggagccgagccgtccgagcccggggagcagagagagagagccccaggagcctgacccctgaccatggggacgaagagctgctagtctccgtcctgctgcggtgcacagatgctgattctcatggacgacgatgtgaaggaacgagctggagattcgctgccatatcacagagccagaacccaacctgtcggttgaattccatggcgttggtaagtcaccctgagcagcgagtatcgacgtggtacatcgagaggtggtagctgtaacctcatcactggctcatatctcatctgatcaccactgcaagcttgtcagagatctgaccaagtccgatcatcccaagctggtacagcaaggtcagaaagaaggccatcgccattcaaagcctaccttggacgtagacgattactcatgtccatcagaagctttcacataattacatgaatgctagccatggtgcacatcaaaagggccctgaaacactcaatattcgactcattactggtagaacgatctgctgagtaccttgaagctggactgtctatcatgtggctgatgcccatatgt

SEQ ID NO: 635659 - DNA, 410 bp, Homo sapiens
  misc_feature (100)..(100): n is a, c, g, or t
acattttctttatccaatccacatgatggacactaggtgatccacgtatctgctatcgtgaatagtgctgtgattagcatacaagtggcatgtctctttngtgtaaattatttattgtcctttgggtatatacccagtcatgagattgccgggtcaaatggtagttccattttaaattcttggagaaatctccaaatggctttccacagtggctgaactagtccacattcctacgaacagtatataagtattcccttttctctgcagccttgccaacatctgttatttttggacttggtaataatagccattctgatgggtgtgagatggcatcttatggtggtttggatttgcatttctttgatgttgacataatcaccaaaaacgtaaacatttcagtagctattggt

SEQ ID NO: 635660 - DNA, 197 bp, Homo sapiens
acaacccgttgcagcgcacgctggtccacagcacgagctgcgggtccagcttgccggcttcttctcgtggttggggatcctgcagcggacacagtaggggtacgtgtacctcagcgtacgccttcagcttgtgccagctgctccttgtaaacgctgacaccacagtgcgaaacatgcccttccgcgtcttgaaggcc

SEQ ID NO: 635661 - DNA, 1698 bp, Homo sapiens
gctggtgcgggggcggcgagcccgggatcgagctaccgcggtccgagcgcgccggccaccgcctgcaccgccctttccgcccgccctccggacggccgcagccctgcgggtctccgcgtccagacccacccaacgagaccagcccgacgcgccttctgaacgacctcattccagagaaccacagaattgaccgcagccaggaaacgcaccgaacagacacggaaagaatcgaccgacacgaaacggaagaaacacacacgaacacaaagaattacagggcacgaccgagaacacccatccgcgcgacacagaggcacacaaaaccgaaacatagggaaacacggaggagcacaaaggacaaacgacccaggcagagacatccgagcacacacgaagacacacagatgagccaacgagaacgcaaaaagacacaagcggcagaagtagacagagaccacaggcacacaacacccgagacacaagcacaaagacaaagcaggacagaagcgagacacaggaacgaaaatacaacgggggcggggcagcaccgaccgcgccgcgaggcacccggccgcccggaacagcacggggacagggcgcgacagcgagcgacagccacgggccacggcgaccgacgcagcacacacaaccggggaagcagcagacagaagccgacgaagagagacgcgaagcggagcagaagcgcgacggagagggccacagagagggagaagacaaccgcagagcagcgcaagcgacggacctgagcgagcagggggacagaacgaagcacgcggaacaagcaggcgaccgcacagcgaagacaaaagaagagcaaaaccagacgccgcacccggaaacacgacaggcgaaggacgacaagaaacacaccagagcagacaagcgagatgccagaccgagacacaatgacaaccgacacaccgacacgacgagaccaggcccgcgggcgcgacagcgaagagagggcggccaggcacgagccacagacaagaaggagccgaagcgaggagcacgacgcagcagcggacgaagaagcgacgagggagtcaccacacgagcggcgcacggagaggacaagcacgcaccggcgagcgagacggaggcggagaaggcgagggcgccaaaggaacgaggcgacggaccagcggcgcacagacgcggcgaacgagcgcggagagagacagcagcggcaggcggcgagaggaaggcgcgggacagaacgagctggacgcacgatgaccgaacaggagcacggacacggcgcacagagcgccgcacacacaccacagacggccgagagcaggcaggctcagcgcaagcgacagtccaaggcagacatcgaagatagccacaccgcccgcgctgccaccgctccacccgagctccgcgccgaccaggagggagagaagagaacgccacgaaccgccaccacgctcgacgccgacgcggaagccgagccgatcggggagcaccatatgagacgactacgccgaccgcccgcagcccgcgcacaacgggggagacggagagtggcgaacaggacgacacgcgaggaaggacagagagacgacagagagcgccgcgagctacgaggcgcgactagcgacggcaagcagcgccacgcgaggcgcctctaggaggagccgagcgggcgcacgaagagaccgagacagagac

SEQ ID NO: 635662 - DNA, 1306 bp, Homo sapiens
atcgggacaacaaggccgacctagtcagataaaagagcacgtacgattgtccaggacagcacagtccctcatggcgagacatgtacaactcaggtttttattgattcgatggcagcagcatccgctcatcaagcatcgaatgactgctgaaatgcaaatattctactggcccaattatggtctgccatatcatgtgccccaagcacatgcaaccgacaaaagtcccagtgagcaacattctgtgcagaggcaagcacggaggatacgacccttaaccgagaccacaacactaaatcaaaccagggaactcagtgcttgctacgtacactaagacctgtctagatttgagatctagtctgggaactatgctcttttctggctttccttatacattgtttaactataccaattggcaaatttggcagacagtattgatagcccagtcctcgcgagatagtgcaacgtatccccaaaagcaagaggacgttactgagtagcagatcacaagttgacgtaacatagcaggagagttaatgcttatacgctggtattcgtaggcctttaagttgttcgcaagttaagcaatggcactggcgttccccgtccgttgacttacatggtttcaacgcgaattcaggcgaaacacacacttgagtaaactaattgtggaacaaatgtgctttcctccatcacgcgacacgcggtctcacgcgcgcgggcacaactacaatatttccttcaatccaacctaagggcaacattataaggcaacccacatggaagtggtccttggggtgtccccctagacaaccaaagatgtagaagaccaaggcgcccgatctatcgttcgccaaacaactctcggagttttaccaaggaactaacgctacgaacccccttggttaggacaacatacaaatacgaaacaacatttttcgggagacattgtttacccataaagacaataattcgtaggcaggaggcacttttcatctgccacaacaaaaatcgccatctatcacatcttcgggcatctacataacagcacaaaccgggggaaagggatactttgcccgtaacacacggcatataagactgtcaaactagctacggtcgacaatgacaagggctcccactattacgctatcatttgcccaagcggcgaccaaacaaagatttgaccttcccagatatgctgcctacccccacctgtggttatgccccgatgggcttcatttctctgaaacacacacttgttcataaccgatcatttccccaacgaaattggcatcgaacctcaccacat

SEQ ID NO: 635663 - DNA, 245 bp, Homo sapiens
  misc_feature (168)..(168): n is a, c, g, or t
  misc_feature (178)..(178): n is a, c, g, or t
tgaactcgtgccgaacttgatgatgaccggcatgccgatgcccaaccgaagcgtcgctgtagagcatctcgacgacgttgacggcgccatcgatgctcttgatgtttttggtcaccgtcgttgtcgagccagcatgggggtcggtattcgagagaggtcgcagcgacngtgtaagagngtcttgagactccaaggtttcgacgggggcacactgcggtccttgaaaatgccgtgacttcgctgcc

SEQ ID NO: 635664 - DNA, 1008 bp, Homo sapiens
gttctgactccactgcaaagctgaagcggatcctgccctgccatgcctacgtgaaccaaggtcgagaacctggagaccgattcagtggctggcagaagctgatcatgcagtctgatcccgcagcagctgctgaccaccctgggcccctgttccggaactcccagttgggacagttccacttcaccaacaagagactgcggacatcgtctcatataggggctcgtgccggctatcgatgggcttacggcttcgtgggctgtcatggcatgttcccactcatcgatctccccctgtgagtgtgcgcgatgctcatgctcctggtattcttcctacataagcaagatctttatgggcctcatcccctactaccagagcggcttcttcagtgccatcccggtaggtttatcaccacccgctaagcaggcagttgtggacctggttggtgtcaactcagtgcccagtccagatctgtcgaacaaaccaagtattctgggcgatggaagtggtgtcatggagtggtcgaggaagcgcaaggtctgaggaccaacagtacggtccaagaggtgttgccctcccacgtctacttgaaccaggtgatagatcctgatgaccgagcttgtggcccaaggaagttgtacatgcagctcatcccgcagcagctgtgaatcaccctagtgccggtgttcaggaacttgcgcccttgccaggttacacttcgaccgacggaccgttgtgatactgaaagctttcctgatatgtacactgtctccgatgcgtcattcctacgagcattgtaagcagggtgtaatgcctgcgtctaggacggaatatttttgctctccccatgcggggagttgtaaaggacgggggtgtcacaagacgggttcatgaatgcgcgccatcaagggggtgtcccgggcctaggagtagggcgcaatgaagaagcgctaagaaggagttgccccccttgaaaacgtgtgtgtctgctttgtctcaaggaacataaag

SEQ ID NO: 635665 - DNA, 154 bp, Homo sapiens
attggatgcatttggatcttgttgttgactggactatgagccaaaaggaaattacgcaggcctttcctagtatctacaactgattgtacttatgcattttgtaccagtggacctttttatactggagattaaaaaaaaaatggacatttctgtg

SEQ ID NO: 635666 - DNA, 1410 bp, Homo sapiens
gtggcgaggccgcgtcgctcagttctggccgtctagtgtgcccctgtaaggatgagagcgcagaggacgcagtggccgctggagtgcgcagtgtaactgaagctagtgtgtgcggttgtggacctgcgtgctgagctttttcctgtggaccctgtgtgtgcttgaactggatgagtgactggagacgaagcctgatgcctgctggctcctagcggcaggcgccgatgctctgagctgtagctgccagtgcgaggatgtgtgtgagcgcatggctggcgcggggtaaatgagaggtctcgggccccaaggaccacactggtggcccggggatgaagtaaggcgagggacagggacgcaggggggcacaagaagcacgaccgatgacgggggccgaagagcagaacggacagaacgggccggcaccaggacaccagttccaggtgcaagaaagcaaggatgagtcacattaaccagaaagcaccggaggcggacatgcggacgaacactgggacccatgggaaggaaacaatcgaagggtacacaggcaatcaaaaaagcaagaggggaaagggatgcgtaaaagtccatgaaagggcagcgggtgggatggaacggcacgtggaagggactagagaaacgctaacatgggagaggcaaagcaaaaggggagcaggaacaaaaacgcgaacagaaccgaagaatggacccccatccggtacgccgaaacgcagatctggagttggggagaggacgagcaaacacgcagcagaccgtgaggtagcccaggagcgaggagccggcggggatgggagatggacccaaaccgccgtacatagcaggagaacgggtgggcggagacagagaaaagaggacaaccaaaggggtgtataggagagaatataagatgaggaaccaggaagggacagcgacagcagccagagcggaggacaaaagatgagagacgggagggaaacccgggcgacgggggatgaaacaaagcaagaaagtaagacgcggaaccgatcaggaaagtggagaaaaaaggccagacgacatggggggccacacggggaaagatggagggccggacgggcacagggcggagcagcggagccagagagagacagaacgaagtagtgcagacaacgaggaaggagagcgcaggagattagaccagcgtagccgcgcacgatagcgtaaggcaggacgtagcgagacacaaggcgagaggaggaggcagagtaggcacgagcgcgggggaagatcaacgaaggagagcgacgaacggagggtgacaagcgcagaagggagaagaggggaggggggggcacggagaaggagtaaagaggagagagtgagagagagcaaagaagaagccagagactagctttgaggcgaagcagacggcag

SEQ ID NO: 635667 - DNA, 548 bp, Homo sapiens
  misc_feature (317)..(317): n is a, c, g, or t
  misc_feature (515)..(515): n is a, c, g, or t
  misc_feature (539)..(539): n is a, c, g, or t
taccattgttgtgaagcagaagtccatatatgtgtgggtctatttctagatactgttccattgatctgtttgtctgtcttgatgccattaaggcactgctttattattatagttatctaataagtgttgaaatctaataagtgttgaagtcatatagtgttagttctctaactttgttctttgtcgaggtgttttggccattagaggtcctttgcatttccatatgaattttagaatcagtttttcactttctacaaaacacctcctgggagtttgattgggattgcattgaatataatgaccaatttatggagaantgacaaatatacagagtcttttgacccatggacatggtagagctccccatttatttagatatttattaatttccttcagcaatgttttgtaatttttactgtgcagatctttcacacttttcctcagatgcatctaaaaatttcatctttttcatgtataaatacttaataacttatgatacttgtaataataaacantaaatttccagtttttgctgaaanaaaaaaaaa

SEQ ID NO: 635668 - DNA, 853 bp, Homo sapiens
  misc_feature (195)..(195): n is a, c, g, or t
  misc_feature (199)..(199): n is a, c, g, or t
  misc_feature (378)..(378): n is a, c, g, or t
  misc_feature (399)..(399): n is a, c, g, or t
  misc_feature (425)..(425): n is a, c, g, or t
  misc_feature (428)..(430): n is a, c, g, or t
  misc_feature (432)..(432): n is a, c, g, or t
  misc_feature (760)..(760): n is a, c, g, or t
  misc_feature (849)..(849): n is a, c, g, or t
tgtcttacggtacgatgttctttctttgcaatacttttaatatttaaaccttttgagtattatacctatattaatttgttttttcttcattttttaaaatgaggaaggcagttcttaaagtatattccacatgatttactgaggaagaaaaaattccatggttaaaaaagtttagaagaggtgtacatattgtcncccncttggagagtcatttggcacattgtgagggttctgagaagtcctacaattaaaaaggaaggtaggaggggaggagaagagagacttctttacctttattcgacttaatttacctgaatttgactttaatttacctgaattcgacttcttttttttttgataacaaaaacatttgtattnggggaattgctttcttaacanacctttgtttttggattagatataanaannnanacacataaccaaaatggaaaaatcctttccccctttttttgagacggagttccatcccggtcgcccaggctggagtgcggtggcgcgatctctgctcactgcaagctccgcctcctcggttcagcgattctcctgcctcagcctcccaagtagctgggattacaggtgcatgccaccacgcccggctcatttttgtatttttagtagagacaaggtctcaccatgttagccaggcaggtctcgaactcctggcctcaagtgatatgcctgccttggcctcccgaagtgctgggattacaggcgtgcggcactgtgcttggcctatatnactgatatttaaacattgattgaaacaagatgaaaatatggagaaacttagtacatttctttatctttttgtttaaaatgtagcataanaatc

SEQ ID NO: 635669 - DNA, 1219 bp, Homo sapiens
agcggactcgcgccgtgggggagtatctgtcctgtcgccttcgcccacgccctgcactccggtgaccagtcccttgtcgcgctcctgtggtctgcatccttgtgccctgcggggctgtgctggctgctgcttgctcttcgtggctgcttgggtgttgctcggtcgccgtccccggatggtggttgtcgatttatcctgatgtcccttcctgaccaattgatatacaaggatagagcccatctgcaactccctcgagagatagatccctaggtggctggtgagcgattgcacgttttgcatcgtgtagggagatagtctggtagttgtgagtcggacgtaaccactgtatcgtagctcctacttgaagacaagccgtacaccgcaagcgcctaagagctcgtatgcctcgaagatccaagaactcgctacctaactctatgtgttcgctccgagtatatgcgtcttgtctagaattgccttgaccttgccggaaattggcgcgcttaccaggggtggagatacggaaacaagggtagtgcaagatgtatgagttgtgatggtcaggacgcatcgaagtggatagagcacagggggaataagatgggccagagtctggcttgccagtgcggcttggtcgcgcccagagggaaatttggtagcgcggcggctttgtcaggcttgtgtccgagaccggagttgggcttagcgaatagcctattcttccttacgcgtttcaattttgcgttttatcccatgatacataagaagaaaaggctaattggcgtttcctaaatgccataaaatttgcattgaatacaaccgggggggcacgtggttgtgagcgcaatttggttaggaagggtccatctccggggagacattttggcccaagagcagtccacgtagggccccgaagactttgttttctcgagggctggttaacgtaccatcttctgacgcaggaaatcgctttagtcaagaggcaattcggatccgggcgaggacaaaacaaaggccgcccaagcggccggtttgggggcgcaggccaaagcggtggttaagaagacaagtagtggcccctgtaggggcctcccttccccctgtgtacacgggggactaactcgttgaccttggatgaaggccagacagcgcatttggaacggtcccctgcttgtttcaaccggtcggtgaaatttccttatggggtttatagaagttg

SEQ ID NO: 635670 - DNA, 970 bp, Homo sapiens
gctcctgcgtactgacgggtttagataggtggtgcgtgcctagtcccaactgtccccctctctgtctcgcttacctggtagatacccaaagcctgtgtgagctacagttgatggagagtgagcagtttgagatgcggagtaccacgattgtgatactgggcttcgcgtggaatctcggagcatcagtttggcacgagtctagctacagtaggatgtccttgatcgagacttctaggtatcagatcatatgcaagcgaaatacgctcagtggaatgctcgactatagccgccaacagattggcctattcgtctactgttcgtatgttgacaggggacgatgaagtgctgacttacgttggacaaagcatgggggtatctagtgactagccagacatcgaatgagacagcaccattgtatgctagcgtctgctgatagcaaaggcttggcacacggtggttgcacttactggctgatgtggtatctgccagtcccggctaacagcatgattgacgtcgcagatgatcagcgcgatggcggtccagttgtgagactggaggacctgaagctgcgtgctgatccagagccagtactcaagcgagatgattcatgaagcggcttaccagggagaacacagtaggcctccagcgtttctgacccacagaaaacgtagcaaggatcaaccgagaggtgcctgcattcctatctgaggaactactacactcccgaccggatggtgctggccggtcgtgggcgtggagcacgagccatctggtggactgtgccggaagtacctactgggggtccagccgggctggagggagcgcagaggccgtggcatattggccagatcttgtggccccagtccactggcgggatagccaacgctatgaaacgagaattgtcccatctccagcctgggccgaaccccattcccggactcaagcaccatcacatgagacacctgaaaag

SEQ ID NO: 635671 - DNA, 606 bp, Homo sapiens
cacagaccagttctcaccctatgcgcactactaatctaacttactgtctctatggacttgcctattctggtcctttcttataaatggaacgacgcaacatgcagcccatagttttctggctgctttcactgagcataatattttcaagattcacccatgttgtaacacatatcagtgcttcattcctttttatggctgaataatactccattgcatggacagaccatatttgtcttatctgttcatcactgacagacatttgggtttgttccatttttgggctgtcatgaataatgctgtcagcatgtatgtatgtacgcggtttccttagtttttatctaatgtcattttcctgttccaggatccccttcaagataccacattatgtttagctgtcatgtttctaggctcccttggctgtgacatttctcaggttttcattgtttttactgaccttgacagttttgagttctggtcaagtatttcatgaaaactccctcaattatggtttatctgatgttttcctcatgattaagctgggttatgtatttctgggaggaagaccagagaggtaaagtgccaccgtcatcacatcatgtcaggagt

SEQ ID NO: 635672 - DNA, 318 bp, Homo sapiens
  misc_feature (285)..(285): n is a, c, g, or t
gcgctgtactgcattatcacattcaaatcacacctactatattttcgctgcttaatgatactttcaatctttgcaattctgattatctctacatagctgcttctaattatcactaattcactttcaccacccctactcacctatttactgtttctttctcctaacacattttttaaaatggtgttagggctatgcgactaaatacagattcatttagataagctattatgtccaatcatcgaatggcttagcattattcattttcttctttgaacatcttacttnatgtgttttactatgtgctactggcccattgtg

SEQ ID NO: 635673 - DNA, 492 bp, Homo sapiens
acgacggcagtgtatcgtcttctcggtcatatctcgattgcccgaggtgtaatgcccgtccgtgtgtcccctttcgatggtcttctggctatccattgtcaccttggatggagccgactctggtgacgtgagtcatgatcctggtccctgcgtcgggtggtgttaactagagaattccgactgtgctccctgggactaacggaatagaacatagctgtgtggctgacttggagggctaacctgggagcactgaggccgtgatgagggacacacatagatccccttacagagggctcaccctggtggcatgggaacccactggcaatagctctgaacttctggcagagagaacctcaggccactgcgggatgggggctcccttttctaggccaaggcaggaagagcatggctgacatttcgcccacgagcaccaacagcctggacaacctgttctcacctctgggcatgggccatcggggtccgagctcgaat

SEQ ID NO: 635674 - DNA, 279 bp, Homo sapiens
tatcgcccaacacaagaaagcaagtacatgaatgtttttggttcccaatgcatataaaagtatgtttacactatactgtagaccagcaagagtgcaatagcattgtctaataaaacaatatacatacctaaatttaaaaatactttattgctaaaaaatgctgattatcaatctgagccttcggcgagtcgtactctttttgctggtggagggtcttgcctcgaggttgatggttgctgactggtcagggtggtggctgctgagtgttggggataacat

SEQ ID NO: 635675 - DNA, 238 bp, Homo sapiens
tgggccacaccagcctatgctatagagctaaagttctcatttgatcgacttaattttcacttaacttttaagcagccacatgtgactagctggctaccatttggaaagtgtagttctagccttgaccactaatacacaagatggcatattttttttttgtgacaaaatttggctcttgtctacctaggctgaattgcagtgcctcatccttagcttcttcctgccctagacaaggagt

SEQ ID NO: 635676 - DNA, 888 bp, Homo sapiens
  misc_feature (530)..(530): n is a, c, g, or t
gcccggggggcaatcctgccgtgcttatgaggacggggtcggaatagggtggcgcggagtggtcggacgcccgcagtgtgtgtgcaagggccttgggagtgatgtacagtagccaaagtgcgtccaatccagcgaatgagtggttaggttgtgacatcacacagcagcgggggactaatatcccagggacgtccctgggtgcaagccccatcgcatcatttggtacacagacgccagtacatttgatggcataagcagggtgagttgatgaagggagaccattgtgaagtaagtctagaagcgagtacccgtcgcttgttcctgggggatgtcccaatcgcacaagtaacggcggatgcatggaccgggaagctggggcgagagatcattgggggtctgggtccatgacatacctgatcctcttaggaatggtccaccatgatgtggtgtccgcttaggaagaaacattggttctgcgtgccaaagcaagaatgaagctaaaaccgatggtatgcaacaggattcgcttngaacggtgttgaaggggtcgtccgttggaagcttccaggtggcttcacaaattcttggcacgatgcttgccatggatagaattcaacctacgttataagaagtgggggttttgggcgtacacggtgaaaggatttgctcgtctctgcttatagactttagcctatagatatgattttccccgtcgtacataacgcgctgttcccggttcccacagcgttccggccatttggacattcatggagggtctccccaataggtgtgggccggaggggggatgaaccatggctaaggtgcgagcaccgaatgctccaagtgagtccgaaaggtggagcaacaaacctcgcagggccacgcagt

SEQ ID NO: 635677 - DNA, 344 bp, Homo sapiens
acggatcccggcactctagtccagttactggttgaacattgtttgttggtgtatatattgtaattgagattgctcgggggcaatcaggttcatgtgcattcaggcagtcaggtttcaggcatgcagtgggcaagcaagcaaagcagcaggcaagtaaagtttcaattcatgcctttttgggttgaggtgcatgcatggcaggtggcaggtttggtgctgtgcaaattgttttcaggtcacatagcttttctagtcaggttcaggtctaggaggagtaggggcaggttttggctcgtaagcaaggcctagatatgggcattgtgcggtgtgtggactagcagtgg

SEQ ID NO: 635678 - DNA, 873 bp, Homo sapiens
  misc_feature (592)..(592): n is a, c, g, or t
  misc_feature (601)..(601): n is a, c, g, or t
  misc_feature (611)..(611): n is a, c, g, or t
  misc_feature (679)..(681): n is a, c, g, or t
  misc_feature (684)..(684): n is a, c, g, or t
  misc_feature (689)..(690): n is a, c, g, or t
  misc_feature (692)..(693): n is a, c, g, or t
  misc_feature (696)..(698): n is a, c, g, or t
ggagattccggactggagctcccatggccgagcagaccttgggacctgtgagcgctgcatccaatgtaacgcatgggaagggtcagcaccagccaccagccccattaggtgaggactctgcctggggctctgctgatggttccgaatcatggagctgcagatgagctccttccatgcctggagacgttcttggtgaaaggcgtgtggtctatactccagccgtgctcttcgctgcgacattgtacttccatgaggggtgcctgcccccgctgactcacggagctcctggtgctgcagccggcacgaatggggaggtgggccctctgatgtggccttatcgtggaaggcggtgttgaccctggggctggtgcttctctagctacgtgcttcgtccatcgagcatcaccttactacaaactaagtgagctgagcaaagagacttccatttacccccgtcttcatgacgatgctgcacctggccgtgatcttcctcttctccgtcctgtccagggcgctggttcaggtgctccagccacagggcccgtgtggtgctgagctgggccgactacctcagaagagtggctcccacagntctggcganggcgcttgangtgggcttgtccaactggagcttcctgtatgtcaccgtctcgctgtacacaatgaccaaatcctcacnnnccncttcnncnngannntctctctgatcttcaagctggaggagctgcgcgcggcactggtcctggtggtcctcctcatcgacgggggtctcttcatgttcacctacaagtccacacagttcaaccgtggagggcttcgccttgcgtgctggggggcctcgttcatcggtggcattcgctggaccttcaccac

SEQ ID NO: 635679 - DNA, 542 bp, Homo sapiens
  misc_feature (105)..(105): n is a, c, g, or t
  misc_feature (117)..(117): n is a, c, g, or t
  misc_feature (168)..(168): n is a, c, g, or t
  misc_feature (187)..(187): n is a, c, g, or t
  misc_feature (263)..(263): n is a, c, g, or t
  misc_feature (354)..(354): n is a, c, g, or t
  misc_feature (358)..(358): n is a, c, g, or t
  misc_feature (365)..(365): n is a, c, g, or t
  misc_feature (388)..(388): n is a, c, g, or t
  misc_feature (441)..(441): n is a, c, g, or t
  misc_feature (519)..(519): n is a, c, g, or t
tttttttctttccacctccttcctgatctgaatttcttggcggtgatgggctcggtgttgggcttttggcctttttgaccggtacagctggtgaccagtttgtanacggtgactganactggacgggggatggaggtgctgggggctttttagctgctggctcagganacccggagacagatcgggnggatgagacccttcttacagactgtgggcttggggaagcagccttttttatctttttaggttccggagtcctgganactctcctaatgggcctagtacttggagacggggactgccttctttggggtgatgacgacgctcctcttccaacgggttggaggacttgangaangtctgangaactcccaagcccgtggttganggcgaaatgcccgtttgtttggttgttggttgatccgggcctccccgggtttnaaccggcttggggaaaaaaccctttccctatgccttggaatgaataatgaaaggttgaaacgtctccttgggttgaantggggaaacttcctttttgtttc

SEQ ID NO: 635680 - DNA, 214 bp, Homo sapiens
taatcttgtagattgacctttccatggtgtgttgtttgtgaaccaaaagtaagattgagtaccaacatagcatggtgagagcgtgtggattgtcctgattaagaggcaggagtggaacttgggacaagggagctgggttagtcccgaatccaggaattggtagtccgtggattggtaatcaatcatctaggctctctgaggtctggtcctggcc

SEQ ID NO: 635681 - DNA, 155 bp, Homo sapiens
agctcgatagtcttgaaaagcatgctagtgaggttatcgtaactgttccgtggtagctttgaaagaagcccttccttacctggtgtgtagtgctataaatcttcataggtggtaggatgctctctctctctctctctaagtgtttgaaaaataaa

SEQ ID NO: 635682 - DNA, 219 bp, Homo sapiens
  misc_feature (1)..(1): n is a, c, g, or t
  misc_feature (16)..(16): n is a, c, g, or t
nattacaggtacccgncaccatacccttaagaaccatagacctacaaaagctttatcttccctagcagcatgaggggctgttttcttaacataaaacccgctccagactcctggaaggtgtgtggtgcctctgtatcgcacaaagtacaaatacaaaacacatgttcagtaaaaagaccctggcttaaaattaaaaaaatgcatggattcgatatagaa

SEQ ID NO: 635683 - DNA, 438 bp, Homo sapiens
  misc_feature (310)..(310): n is a, c, g, or t
  misc_feature (318)..(318): n is a, c, g, or t
  misc_feature (326)..(326): n is a, c, g, or t
  misc_feature (343)..(343): n is a, c, g, or t
  misc_feature (434)..(434): n is a, c, g, or t
gtaactacagtattaaatgactcaaaactacaatcctatgataaggtaaataataagagtagttactggtatttgatcccaataatcatgaaagtgacagcacccattaaaggatctgctgaaggcctgagccaaaacaaaaatgaagacaagcactgttttaaactcagtatcacattgtataaaacaggagactaacaccttccaaagcatggaaagtataagcaacattaacaataaaatccttaagtaacacagaaggactgttcagagaagtgaataaatggacaacagaataaatggacaacanaaaaggtnagggctanaaagaaatatgactaanatatgatggattgccaggtagacagctatgctttaacagacgaagataattcacaaggtagttccctttaaatatttgacttatcaccagnaaac

SEQ ID NO: 635684 - DNA, 446 bp, Homo sapiens
atgcactttcagctcactgcaaccttcggctcccgggctcaagcgattctcctgcctcagcttcccggagtagctgggatcaacaggcatccgccgccatgcccagataatttttgtattgttagcagagatgaggttttgccatattggccaggttggactcaaactcccggcctcaagtgatccgcccacctcagcctcccaaagtgatggggagactgcttgaacctagaagtttgatcattctgggcaacatggtgaaaccccatctctattaaaaaaaaaaatacgaaaaactcgccaggcgtgatggtgcacacctgtggtcccagttactcaggtggttgggatgggaggatcactcgagcccaggaggtcaaggctgcagggagccgagatcgcgccaccgcactccagcctgattgacagagcaagaccctgtctca

SEQ ID NO: 635685 - DNA, 365 bp, Homo sapiens
ccaccatgcctggccgagttcaacttttttagattccacatgtaagtgagatcatgtggtatttgtcgttctgtgcctggcttatttcacttaacataatatcctccaggctcatccatgttgtctcaaatggcaggatttccttctttttgaaggctgaatagtattccattgtgtacatacaccacattgttgctggaagtttaatggaggccagttgggggaggatggggagaagattcactctaagtctagatgctccagtacccacccaggatgtgtgcaaggaagtgcaggatgctcctggtcttgcaaactgtggtttgtgggactccaaagcccctatccttccacgatgctttctg

SEQ ID NO: 635686 - DNA, 393 bp, Homo sapiens
cagccatgagaaatcataggttctccacatgccccggtgacctggggtagaggtgaccctgacgatgaaagtggccagttggtagcacaggcgaccagaaggttcagatttcatactacggacccaagactccaccagtcatagctctactctatctcaccgaggtggtaatctccttgtgcgcagacatcacccgcaccggcaaagtgaagccaaccagagctgtgaaagatcagaggacctggacctggggcccttgtggacagggtgccatcctgctggtgaactgtgacagagacaatctcgaatcttctgccatggactgcgaggatgatgaggtgcttgacagcgaagacccttgcaggacattgtcgctgattaccctgagcacga

SEQ ID NO: 635687 - DNA, 281 bp, Homo sapiens
tccatagagagacgagtctcatgatgttagcccaggctggtctcaaactccttaccctcaaaagatcttcctgctgcttgagcttgggaggttgaggctgcagtgagccatgactgtattactgtactccatcctggtcaacagagtgagaccctgaaaaaaaaaaaaaagttcttcctactttggcctcccaaagcattgagtatcaaggttgtgacgccatggtgtctgggcccttgattcttttggtcagtgcttaagtccgggtaagggatcgctgg

SEQ ID NO: 635688 - DNA, 370 bp, Homo sapiens
tccttcgttacccgggcgcttctggattctcagttcagctaccagcacgccattgaagagtctgtcgtcctcatttatgatcccataaaaactgcccaaggatctctctcgctgaagggtacagactgactcctaaactgatggaagtttgtaaagagaaggacttttccccctgaagcattgaaaaaggcaagcatcaccctttgagcacatgtttgaagaagtgccgattgtaattaaaaactcacatctgatcaatgtccttatgtgggaacttgagaagaagtcagctgtggcggataagcacgaattgctcagtcttgctagcagcaatcatctggggaagagcctccagctgctgatggaccgg

SEQ ID NO: 635689 - DNA, 557 bp, Homo sapiens
  misc_feature (439)..(439): n is a, c, g, or t
ccacaattgtcagggaaagggagaaaaaaaaaaaaaaaactaccacgtggcattatacaaagccaagatttcacaacatttttgaaaattccaaatgacttacatgtttacaaggaccaaaaactttttgatattttaaaataagctttatcctttttaaccaccatgcagcatgctgtgccatcatgatggaagcctgatggctaatgtgaaataatgttggcatgtcatttaaaaggttaacagacatgaaaattgggaagtttaatattgtttaatacaaataaaattgtttttgaaagaaaggcatctgtgttgagcgtggcttgcttgaaaacttctcctgtctatcatctctgaacattattttgctcctcttgactttactcaaggggcctaatcctacagtgattcagggaggtttgagaaagcaggactnatgagactaaaaattaggaaactacataatcctgccaagcaatgggacacctctaaggctaccacctcacctaaaacttcattgaatcagaaaattagctgaactttccacaccagtc

SEQ ID NO: 635690 - DNA, 414 bp, Homo sapiens
  misc_feature (16)..(16): n is a, c, g, or t
gtacggccgggcctgnccatggcgctgagcgggtcccccaagccctgggggcagctgtccatttcctccatgggggtagtgggcccccccgaggacaaccgcagccccagggcccccttttttgagtttctcccccaggagctagccctggggcagggccggaaacttatccgctttttccccttggggtcctggccgattggcaaaataggggcggtcatggcttttttatgattgggcccggaggggtcccgggcatctgtgaactggctgctttttccagagaggtctcttggcagagggaggggctggggataaccagctttgggttttcccgcaggcccccttcctgtggtcccataatcctttttttcatcctcctatgaaataaatgaaaagagcttcctcattcca

SEQ ID NO: 635691 - DNA, 471 bp, Homo sapiens
  misc_feature (130)..(130): n is a, c, g, or t
tttttggcggccccccgttttttccctttagtttttttgtccggtttttagacaccaggtttgtctttgaactgggatggggcttcgtaaacagcccatgaatgaaattgggggccccttccctagactnctaaaagtttttggtccgttgttcaaatcccggggtcccttttgggacagaatgaaaaagcccctgccccttttgggttggatacatgtattttttataaaatatgttgagaatccccccccagtttttaattgtgaaaggagaaaattttccaatttctgcctggatgctgtttgtggttcccctgtttagcccccgttttttggctcgtccgtagcaggcccacccccccctggggatttttaatcttttccagcttaatttgaacgggttcctttatttctgtgatatcctttccccccttttttgttttgttaaataaaaaccccgctggggcccca

SEQ ID NO: 635692 - DNA, 265 bp, Homo sapiens
tatatgcgccatctacatctgactatactgcgtctgttctcatactgatgccctactatgcactggatattccgtgaccctaattcattgttcactcatatgaaactgtaaagagtgggggacatccacatgaaagatataaattattacttggagatgcaaataacttatagagcactctcctcccacattgtcaagagcttggtgtattctcattcatgatcgttctgcttcaaatccagagatgagactgagaagttttagt

SEQ ID NO: 635693 - DNA, 559 bp, Homo sapiens
ccagtagatgtgttggccactctgaggccagaggttcatcagcgtgatctggaagcccgacgggggcccctggtatgaaactggaagagcataggggaagagaagacaagaacgaggtaagaagacgagtaagacatccgagtgcacgagagtggagccggagccacgtggagtgcaggggcggcccgtctatctgttgttgatgctgtggagagccggtaccatcactcctcttcctccttgtcatccttcatgccttacaaggctctggcgagcaaagtcctcaattacaatgtcgtcatcacttggtgggagagacaagtaaaatgtggtgtgtgtgcaggggcctgggagagtcggcttatccagaggccctgacagatgtgactcagagttatggctctgggtgcggggagaagcagcctctctgagttctctggcctctgtggtgctgaccatgagcagaaaggcctgtatggctggcactatgtggatgccacctgtggcggtgggggacagtcactagtccgtagtggcccggggttccgagctcgacttc

SEQ ID NO: 635694 - DNA, 169 bp, Homo sapiens
gggggttttttttttttcccggggggggccggggcaggggggcccttttgttccccttttgggggggcccgggccccccctttgccccccctttttctcccctgtttttgtgggggccctccaacctttgccttttggggtttttaaaaggggccccccccccccccca

SEQ ID NO: 635695 - DNA, 131 bp, Homo sapiens
tacaggactctaggtggtgtggtaggggcgagtgggatcgcctcaggaagacggtgagtgtggctgtgaagtgcctgaagcccgatgtctgagccagccagaagccatggacgacttcatcctgggagggt

SEQ ID NO: 635696 - DNA, 166 bp, Homo sapiens
  misc_feature (24)..(24): n is a, c, g, or t
ttgatacggggcagagctcacagntaatgctctgtgcagtggggctggagctcacacatgtaatgctctggcagggtggctggagctcacacatgtaattgcttgtctgggcttgcgtgggcttgtcggggcttagtcgggggggggtacctgagctcgaaattcg

SEQ ID NO: 635697 - DNA, 450 bp, Homo sapiens
  misc_feature (44)..(44): n is a, c, g, or t
  misc_feature (54)..(54): n is a, c, g, or t
  misc_feature (91)..(91): n is a, c, g, or t
  misc_feature (299)..(299): n is a, c, g, or t
attgttaaaaaaaaatgttttgcatgcctgtttctagtgttacnctgtaatccncatcaaagctgagctggtgtccttccatcttcaaacncctcaggggcctcgagcaatgcctggaatgtgcttgttaataagtatttgttgagtgaatttgcgagcgcacaaagactcgtgcagttagaaaacacgttttaccaagatagagagttgcctggtggcttccaggattttttttctctctctagaaagcattatataatctctttgaatgtaatattatttaaattttaaaaataacncaagtttaatatagatcttcataaatgattgcaaaagatagcagaagctttgtgatctttcaaatgataatagagttcaagataaatatttgcactatttccatagtgaatgctatgaggaaatgtacagcaataaattttgatgctttca

SEQ ID NO: 635698 - DNA, 575 bp, Homo sapiens
cgccctctccattataccggagaatgcaagtgtcccgcatctcaagattaaactgagcctcggttttactgacgtaaccagtaaccctatctacttctcacactgcggaggccggcagggcagcggctgccgccaagcacaccactcatcagagcctgccccgttccacccccgcgtttcagtcatgctttccagaaatggggtcactcactcagtaactattacacacacgcagcctatcatcctgtaatcccctaaagtccgctgcggggagagaaggcagcaaaaagtcaagaaggaagaatcacagacgcgccaccatcaggaattgattttccactccggagaggagcggtgataccttggaacgggtcttgtctggattattttcgcagaccccgagttgttctgggataggggcggttcaggaaagctcggtgtagtgatgcgcccggggaaattctgttttgccctgtttgggtatattgtttgggttttgggcactaggatgggtgactcagggacggtcaccagatcccgggcgaggaaaaccagaaagccttttacggcggccg

SEQ ID NO: 635699 - DNA, 164 bp, Homo sapiens
cgatgcggccacgcgtcgcctgggcgctgctggtgccgcggccctggggcttggggccgcggggtgcgcggcgcggtggcccttgccgacttctacccgttgcggccgagcgcgcgacgccgtcacccccaagcaggacgacggcggctcggggctgcgggcgc

SEQ ID NO: 635700 - DNA, 150 bp, Homo sapiens
gctctgaggatcccggaagatgtgggcggcgtgatggctatgtctgtatcccacactttggtaggctaaggtgggcggactcacttgagtcaggagttcaagaccagcctaagcacgtggctataccctgtctctactagccatgcaatt

SEQ ID NO: 635701 - DNA, 215 bp, Homo sapiens
tagcagagaactttaaaaaataaaaatatcaagtcacgattactttttttacattaattcaaatgtccaaagcacagtacagtagggtctatttaatagttcacataatttaagatttacatatacacttagcacttgtaaccaatattagttggctagaacagggatttaggaagttactcagacatttggctattgaaacttctaaaactagg

SEQ ID NO: 635702 - DNA, 249 bp, Homo sapiens
tctaatctatcagcaataccggtggtaatattacgttatcgttggttttatagtagttatattggatttttaaaaatacttatgaacatatgatctaatacaatttcaatgtcttctgaggattttatacataaactgctataggggctatagataagcgtgctacatagaatttatacttaggcaagggaaggacagaaaagtcgagtgtctttacctgtcagattctaatagaactctgctttaggc

SEQ ID NO: 635703 - DNA, 249 bp, Homo sapiens
ggcaggcacggaatgagccaggatgaagccagggcagcttccgagtcagggcaggtcccttccgccccacactggaaaagcgtatagctccaggcaccagcgagaaaggccaggtggagccatctgcgctccagctccatggcacatggcggttgctagctgagagccacatccacctgcctccccccctagcctgggccaccaagtctgaagaagagcagagagccatggtccagagagagcagggtg

SEQ ID NO: 635704 - DNA, 1060 bp, Homo sapiens
  misc_feature (33)..(33): n is a, c, g, or t
  misc_feature (153)..(153): n is a, c, g, or t
  misc_feature (155)..(155): n is a, c, g, or t
  misc_feature (171)..(171): n is a, c, g, or t
  misc_feature (176)..(176): n is a, c, g, or t
  misc_feature (250)..(250): n is a, c, g, or t
  misc_feature (276)..(276): n is a, c, g, or t
  misc_feature (279)..(279): n is a, c, g, or t
  misc_feature (284)..(284): n is a, c, g, or t
  misc_feature (313)..(313): n is a, c, g, or t
  misc_feature (368)..(368): n is a, c, g, or t
  misc_feature (374)..(375): n is a, c, g, or t
  misc_feature (420)..(420): n is a, c, g, or t
  misc_feature (426)..(426): n is a, c, g, or t
  misc_feature (432)..(432): n is a, c, g, or t
  misc_feature (482)..(483): n is a, c, g, or t
  misc_feature (492)..(492): n is a, c, g, or t
  misc_feature (782)..(782): n is a, c, g, or t
  misc_feature (829)..(830): n is a, c, g, or t
  misc_feature (911)..(911): n is a, c, g, or t
  misc_feature (968)..(968): n is a, c, g, or t
  misc_feature (1038)..(1038): n is a, c, g, or t
aaggcaacacaagtggaagcaaaagtcgcaacnagcgagggattctcattcaaaaagcatggtgggagccgccagtcattggaaaaggaaggcagcagggacgtgtgatcagagtacaagcagtttgaagtcagggtggcagggacgtagtgnanttgctctagagaggancaccngcgcacacagcagcgaaggactcccgaggaaccagagagctcatgtacgtcgcggtagagcggacagcacgcanagcgggagcgtgggaggaattaggcngancaggncggtcttcagcacttggaaggcacaaaangtcggaaaggcgcaaaaggagcgtgcgcgtggggagaaacctattctggtgtgtngttganncgtccaggtcatacagaaagcagtcacggtggcgcgtggtgaggnaggggngggtcncagcgttcgtgggtgaggccgcggaatggaacaggtgggaggtgacaggnnagcaaggcntctgaggccagggtgcacacgcaccttgggagatgacccactgggcctctggacaggagaatgggatttcgatggagaaagctgaagctgaccacctgctagattgaatccagctgcctcccttgaaactctcttcccaatcaagggctcccaaggagctgcaggccaagtcctctgctcctatttagcaagaggcaggcggcaattcgggctgatctccccatcacccttcatttaaccgcaaaaaaagtcaccaaccaacttctcagaccccctgggcaatccagggnttcttgtttcctaagctcctatggaacaagcaatcagttctttcttnngacttttggttcaattccttctcattcagaggaaatatggttgccgtgtaggcagatgtctcctaggagcgtgtgtgtgtnagagcctgtgtgaaattcagccaggttagcaccaaggcctggctgatggggaaccanaaatgtgccttcaggatgggtacagcctctttggcaatgaagaaatatatttatcagtgaaaaaggggantctggctccatctttgcaggac

SEQ ID NO: 635705 - DNA, 668 bp, Homo sapiens
tgggggttttttttttaacccctctttagtttaatgcgttccaaaaaccaatttaaacccccccccaatgtaaccgggggggcgggcaaaggcaaaaacgcgagaaccgctgggaaaccacaagttctggcccccggcaattaattggcccggagtggaattggggtattcaactggtgcaccctgggggcatggggatagcgctagcaggaggtggacgccgtcggcggggggagacactgtcgccacgggaagcccctctgtggggagaatgtcccacgagggggagtcgcgaacaagcgccaacgtgtcgggcgacgtgagcattcttgggggacaccagggcgtggggccccacaaaaagattatgtggagaggggaggaagaggaggggggtattgagccaacgagggattccactctctacgagggtgcatccaggagaggggatgcactcgcgagagcgacccaagagcgagagaggggggcactcacgtggagagagacccttagaaggtaagtgcccacgaacagaagacaacgagcggggcctcaaacacaggggtagtgttacaacacacaaaggggttccccaacacagtgcattggtcaccatgaggaagtaccgaacatcccggaaaccacattaaaaaaaacacttcccctac

SEQ ID NO: 635706 - DNA, 430 bp, Homo sapiens
aaaccaaccctcaaaagttttttaaaatttgaattcatctcagatatcttttcggcccacaagggaataaatttagaactcaatccaagggattttgtggaaccggcacaaacacgtggatattaaccacacaggtctcttgaatacccattgggccattgaagattttaaaagggaattttaaaaatttctgggccaatatgaaaatagaaaaccacctccccaaaccccttgggatccacgcaaaaccggttataagaggccggtttataccaataaccaatggttttcaaataaccaccctaccatggcttttaaaaaaaacttggaataccaagaaaacccaacccccaatttagtaagggtaaagaaatattgtttcagaaaagaattgaccaaaatagggcccaaaaaatacaaaagatgaaca

SEQ ID NO: 635707 - DNA, 129 bp, Homo sapiens
tcattgagtcatcctttttgcctgctgctgtaaggttttttttcttctagtaactgtatgatccagagcgacccagcaaggactcaatcgatcaccaactgatgcagaactgtttcatatctagaaatg

SEQ ID NO: 635708 - DNA, 100 bp, Homo sapiens
gctgcgaccgcgctccctgtgaggtggcaagcggcgaaatggcgcctccgggagtctttcaagttccccttggcaattccttggtccttttgcctttggg

SEQ ID NO: 635709 - DNA, 209 bp, Homo sapiens
tgtacagtgaaggaagaggggtgctgtccctgtggatgctgaggaaaggtggtgacaggaagaggggtgatgtgacctgtggattcttgaggaagtgtcggtgacaggacgaggggtggtgtgacctgtggatacttgaggaagggctggtgaccggaagaggggtggctttgaccctgtggactacctgaggaacgcactcgtggtga

SEQ ID NO: 635710 - DNA, 856 bp, Homo sapiens
gcaacatccactcagctgcttgatgaaggcttttgttctgagaaaatttataagagatcaatgaggacatggcgttgcagagtggcagggataacttctgatgctaatgtgctgactaatgaatctaaggcctgcatatgctcagaaggtatttatatacagtatcaggagaccaatatcttgtgagcagttggttacagcgcggtgtgactatcaaagaagttttataactcaattatggaggaaaacgtcccgtttggtgtatcattgctgtagattggtctgggataagcactatggctttcagctctatcagagtggagcctagtggaaattatgggggattggataggcacatgacttaggaaatagtagcgatgcagctgtgtgcacatgttgagacgtagattatcaaagaaggagaaatgaggcttagaagtccagaattgtgtgttttgctatcaaagtggtagataagaccatggatgtgagtaaactgctctgttgaaatagtggggatagataataacatgagagaagtggacggacgagcatttagaggtcctcatgcaaaatgcatggtggcagcactggatcaaacacgcaccgcaggagtaaagaacccaccggatgacggctagacggcccgcaaaggaacacaaggcaccgggatactttgaaccgaagaaaagcacgcatgggggcccatccagcgcgaccagacactctctcccttcgaggcccgtgcaccgacgggggcacagctactccgatggccgcaccgccaagcacaaggagcaggacgcagacaccgcagacactggaagacagccgccaaacacaacacgccccaaac

SEQ ID NO: 635711 - DNA, 189 bp, Homo sapiens
gacgtgatgggaaagttgtgagacaagaaagctatggaatttagtgctagatacaaaattcacacagtgaaaaggcactggactctggggagactgggaatgtgtcctcagccattcagcaccatgctggactgagctcttcatagtttgatacaaccatatgctgtcctcatgccctgccaccagggt

SEQ ID NO: 635712 - DNA, 236 bp, Homo sapiens
ccccccccaaccccccccccccagggtttggtggagaaaaggaaagggcaaggcccagtgcctgtccctcaagcgggggcatgggccccatccccctttgttttcctttcccagggtccaggggatggggtgggccaggggagggatgttagggagggggtggggggccctgggggccatgggttccaattcatggggggggttgagcccccccccccaataaacccctttttcca

SEQ ID NO: 635713 - DNA, 3538 bp, Homo sapiens
  misc_feature (3237)..(3237): n is a, c, g, or t
cggcgcaggactcccacaccaccaccacgacgaaggactcctcctcctcctgtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635714 - DNA, 3194 bp, Homo sapiens
  misc_feature (2893)..(2893): n is a, c, g, or t
ccgagctggacccggaagagcggcggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635715 - DNA, 4087 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagtaaaatacaaatacccagaccgctctaccgggtatcactcggtcgtatca

SEQ ID NO: 635716 - DNA, 861 bp, Homo sapiens
  misc_feature (34)..(34): n is a, c, g, or t
  misc_feature (41)..(41): n is a, c, g, or t
  misc_feature (66)..(66): n is a, c, g, or t
  misc_feature (81)..(81): n is a, c, g, or t
  misc_feature (83)..(83): n is a, c, g, or t
  misc_feature (85)..(85): n is a, c, g, or t
  misc_feature (91)..(91): n is a, c, g, or t
  misc_feature (109)..(109): n is a, c, g, or t
  misc_feature (148)..(148): n is a, c, g, or t
  misc_feature (157)..(157): n is a, c, g, or t
  misc_feature (160)..(160): n is a, c, g, or t
  misc_feature (168)..(168): n is a, c, g, or t
  misc_feature (170)..(170): n is a, c, g, or t
  misc_feature (173)..(173): n is a, c, g, or t
  misc_feature (178)..(178): n is a, c, g, or t
  misc_feature (183)..(183): n is a, c, g, or t
  misc_feature (187)..(187): n is a, c, g, or t
  misc_feature (190)..(190): n is a, c, g, or t
  misc_feature (200)..(200): n is a, c, g, or t
  misc_feature (209)..(210): n is a, c, g, or t
  misc_feature (226)..(226): n is a, c, g, or t
  misc_feature (230)..(231): n is a, c, g, or t
  misc_feature (236)..(237): n is a, c, g, or t
  misc_feature (241)..(241): n is a, c, g, or t
  misc_feature (243)..(243): n is a, c, g, or t
  misc_feature (246)..(246): n is a, c, g, or t
  misc_feature (252)..(252): n is a, c, g, or t
  misc_feature (257)..(257): n is a, c, g, or t
  misc_feature (263)..(263): n is a, c, g, or t
  misc_feature (276)..(276): n is a, c, g, or t
  misc_feature (300)..(300): n is a, c, g, or t
  misc_feature (317)..(317): n is a, c, g, or t
  misc_feature (333)..(334): n is a, c, g, or t
  misc_feature (346)..(346): n is a, c, g, or t
  misc_feature (350)..(350): n is a, c, g, or t
  misc_feature (352)..(352): n is a, c, g, or t
  misc_feature (354)..(354): n is a, c, g, or t
  misc_feature (357)..(357): n is a, c, g, or t
  misc_feature (361)..(361): n is a, c, g, or t
  misc_feature (366)..(366): n is a, c, g, or t
  misc_feature (371)..(371): n is a, c, g, or t
  misc_feature (378)..(378): n is a, c, g, or t
  misc_feature (382)..(382): n is a, c, g, or t
  misc_feature (390)..(390): n is a, c, g, or t
  misc_feature (395)..(395): n is a, c, g, or t
  misc_feature (397)..(397): n is a, c, g, or t
  misc_feature (418)..(418): n is a, c, g, or t
  misc_feature (421)..(421): n is a, c, g, or t
  misc_feature (430)..(430): n is a, c, g, or t
  misc_feature (471)..(471): n is a, c, g, or t
  misc_feature (502)..(502): n is a, c, g, or t
  misc_feature (601)..(601): n is a, c, g, or t
  misc_feature (621)..(621): n is a, c, g, or t
  misc_feature (635)..(635): n is a, c, g, or t
  misc_feature (644)..(644): n is a, c, g, or t
  misc_feature (710)..(710): n is a, c, g, or t
  misc_feature (837)..(837): n is a, c, g, or t
ggacgcggaccggcgctggggacggcggcgccangtctgcnggtcctcccgccaacccggccgganaaccgaagccgctcngncngcggcngcggcggcggcgggagcngaaacgcatctcgcccagaaaccggaacaacggcactgnctggtaaanacngcgcccananccnctgtntttanaganagncagcggcaanccttaatannctcactgccgccccgnaacnnctgtnnaaantnatnaaaacnccccngaagcngggatcggaaaantcgcacagaataaacacgggtttntacacgcagatgggggnggtgggtgtatttttnnaagctcctcacngggnangngangggnggggnggggngggggcnggtnccgcaacnctggncngaaaataaaaagggcacgganggnaaaattaanttgatgtagggtaagaaccgcacacagaattacagcaacangctagctttgttcggcatggccgcgcggganggggtgcttcccgccactggggggagggcgtcctcccgcgttgattcatcttccccggagcgagctcaacgctccactggctccactcgcactactgancacactcgccgtcacacaancagtgtggcacaanttccggggngcgatcacacaacaccgcgttcacgcacggggcgcctcatttcctcgagtgaggccacaggtctancgcacacacacaatggctgttggtcattccattagactcatacacacggccacctgtcacccagggtactgggtgggagccttgcgtacacacccaggcacagctacgcactcaaaacagccatcgnggatcacagcatggacatcaactc

SEQ ID NO: 635717 - DNA, 4102 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
  misc_feature (4001)..(4001): n is a, c, g, or t
  misc_feature (4007)..(4007): n is a, c, g, or t
  misc_feature (4060)..(4060): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcagtatcattgatgtcctatggtttntacggntaaggctgcgttattaatttcgtctattatataaaggattcgtaatgatggangggcaataagaattagaataatagcgggtaggattgaccacg

SEQ ID NO: 635718 - DNA, 3989 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggcggatgtggattgggggatactctagagctg

SEQ ID NO: 635719 - DNA, 3725 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (3424)..(3424): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggcttttatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635720 - DNA, 169 bp, Homo sapiens
ttctgtctgctacccgttctatcagactctagagccggaggcataaggctgtaaggctccattatacaaagtactctatggaaaggagtgtcaataccaatagtagagaaccctgacagagaaaatcattcaaagtctggaaggattacaccactaaagatgccactgt

SEQ ID NO: 635721 - DNA, 3172 bp, Homo sapiens
  misc_feature (2871)..(2871): n is a, c, g, or t
actagtgctactagcagtggtagggatcctgctagggtgtagaataggaaataaagtcctgcattgagtcgttctgtttggtttcctcagcgtgtgatgatgattagtgtgggtactagtgttgctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggcttttatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635722 - DNA, 3184 bp, Homo sapiens
  misc_feature (2883)..(2883): n is a, c, g, or t
acgcaatactcggggacaacagacacactacttccatcctcttcatggccacattgtttcaaaacacgtatttctctttttggggtgatgaaagtgttctaaaattgattgtgggatggttgcacaactctgccaatatgctcaaagccactgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggcttttatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635723 - DNA, 3140 bp, Homo sapiens
  misc_feature (2839)..(2839): n is a, c, g, or t
acagttcacccggaataccacacacttaaaatcaactggctcaaactaaactcatcataccctactctcccttcatgttcttatatttgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggcttttatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635724 - DNA, 2617 bp, Homo sapiens
  misc_feature (33)..(33): n is a, c, g, or t
  misc_feature (2316)..(2316): n is a, c, g, or t
actcgtactgtggtgtacgtgtcgcacatttgngtgtctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635725 - DNA, 225 bp, Homo sapiens
gagcactgagtgaacgagactccgtctgcaatctcggcctcccaaagtgctgggattacaggcgtgacacccgcgcccggctagacaatttttttgtagagacagagttttgctgtgttgccaggatggtctggactcctgggctcagcaatcctcacacctcagcctccaaggtgttgggattacaggcgtaccacttgtgcccagctcagttttcattaaaaa

SEQ ID NO: 635726 - DNA, 666 bp, Homo sapiens
aagggtcccagagaagcttggtgccggacacctccttctcacctattcttagctagaggtcaccttttggctcttgcattcccaacctcaagtccgttcttggccttgttccacctttaatccttaggtaggtgggaggatcagggttaatccaggggcaacagctgtccttccttctgagcacctaactgctgagagagcaggcatggaatctaacccctcacttgtcaaccaagggctgagtcccttctagttcttcacatcccagagtcctatggcttccatccctcaacgcatccctaggcacgctctgagccttccctgagcacggttgggtcctgtctgtatttctgctgtctctagctagctgcttcttccctgccacctgactctggctcctggtcacatccctctacaacactgcagtatgggtccctttgagagagggctgtcccctgctccaggtcagcccacctgagtaagccactgctggctctgttctcaccacaccctctcaccagcattcacttggtgtatggtggctagctggatagctctttgctctgttccctctgggcctttctgtctcccatccccaccccaggcctgactgaggattcctggacttgagaaagcttctgtgctgactcaagagaacacaccaaa

SEQ ID NO: 635727 - DNA, 209 bp, Homo sapiens
ggtaatggtagctgtcactggaagttgtcacagaatagtcttttatccactgtgaacttaggcctaagaataattgtcctgtgtgacttcattttatgaacttttactttttaccgaaatcataacaatcggtctgtatctttagaagatactaatatctatgctttacaaagtgagaggagttgaagagggggctttcgttcatccct

SEQ ID NO: 635728 - DNA, 729 bp, Homo sapiens
tctgccatgcgtcgcaggtgcatgcctggtgctgatgtgctggatgcatgtgggtcccatggcctgttgacaggagagtgacacgtggcccttttgggatggtggggtgcaaaggtgagggtgcccccgatggaagctgggagaggtcctgtgatggccacctgtcaaagtggccactggtgtctactgaggatctgtgaccctgcttggtccggagaacatgtgctgggggctgatggctggttttaaagccaggagggatgagatccagtctgaagtgtagtgtcacttggtcctatttcgtataccttctctgtgggagtatccagctctctcagagggcatgaagacccgggataataggagacatgaatggaagggaacgcatgggaaggggcctggtgcacgtgcggaacgtgggaagagctcacgtggctgctgtgccagcaggggagccatgtgtgcacaccctccatgcggcagctgccagcgatggccccctgtgcttggcacaagcggtgccaaatggcctgcctctgctttcctctaacaattgtatttctgtttttcacttggttttccctgttctctaacactgagtgtcttattagactaaaactggatatagccctacccagtgactgtagagtcacggacggccttaaaactcttttcagcacttgaaactcttctgggcacctgctgtgtgttacgagacgagaggcttgc

SEQ ID NO: 635729 - DNA, 824 bp, Homo sapiens
ggcggcgaggacctgggcggctgttggcagaagctggccgagctggatgtggcccgccaggtgagtgagctgctgcgggagaacctagcgcttactgggatgctctgcctggtgctgggcgaagaatggggcccccgcggcggcccagctggcgccgggggatcagtgagccgggcagcacccggagctttgtcttgcccccgtgctgggccccgtgacctagtgcggattgtgaagctccagcactggcatggatgtgggcatgtcctggatcagttgcccctggcctgttcccccgatgatttgacaaggcaacttgttccctccaatgcatgacgcccgccgggatttgctccccgagtccccctgggtggaactgctttgtggacctcggggacttggactgcctgtccttggcttgctgcatttggaggggcctgctggcattggggttaataaaatcctggacaccaatgaacggggacccctctgacttctttgctttggcatgtgccatgaatttgtgaattgaatggctggagcggatgggagttgctgtggggtgggattgtggggtgaattcaagccctggacggaagcgggaccaagacaaggaacgcaaagactctgaacgtccaaagaaaaagaaaaacgaccgaaaagcaatagacaaacacagcgaataaataaagagatatcacgcgaaaaatatgagagacgcacacaagtatagagacgctgaacaaaccacaatgcaccaaccacatgtaccagccagagatgggaaaagacaatagacaaaagaaacccgaagtgaacagagg

SEQ ID NO: 635730 - DNA, 1507 bp, Homo sapiens
  misc_feature (449)..(449): n is a, c, g, or t
tcgaaaccagccttctgcttcattgggatgtcacaataagcctaatgcccatgactcaccatagaattgtcagagacccaccattatagactgtgctctgtctttcggagacacgaagcgtttgagatccttttataaacctggactgttaaaaaacaaagataaccagagtggcaatttcttctagaacgcacctggttgtccagagaaactctcatacaagagtgtggtcatcgtcacactaattacgctgtgaatatatatcgctcttaatactctctcacacagacaactggggtgagcatacttccacacactgtcacaatacacactggtgtgagagaggtgcacccatagatttgtgatctcacacagaggagataagtgctgatatcacccaaagtgtgtctctgtgtcacactcatcactgatgtgcgagtggcgcatgngatgatggtcacaccaactctataaaaatgtgtgtgtgagtttgtgtgccccactctatatacagacacatctgatgtgagaaacggccaaagaaatgagggcacaactccacatcccacctgcagggttaaagaaggggcgcccaccacacttttattataagattcccatcatacacttggtgctgcgtgccgccacacaatcttttttactatacacaggcgtgtcacaactcgtggtcacacaggttatgaataggtgctacaagcgagacagacctgtcccaataagacccagacatacccctctacaatacggcgtgtggaggatacagtggtgtggtcccgttgttgtgctccaaccgagatataatcttctgtatagaacgaaaacacgaattgttttggcgggaccctttattttcgcaacagcgagacggtggtttttccaaaccccagaggaaaaattgtttctgtgggcacgacccctcttatatacactaagtaagcggcttttatcataaccgcagcgtcgagtgtggacaaattctcccccgtaaatctttctcttcataaccgcgcgagaaaactccaacggctaacccgcaagggtgtgttctccataacaaacactctctcataaaaccccccttatgatatggcgaggtttcccccggacacacactagggggaggatactccaccgacaagactaatccacccccccaccttcatcgttggcaaggaccggccccctctttctctagcccgccctcccacatacaccaccctgtacgggcgacacctcctacgcacgcacagccatcccaccccagggccgcgccctccacgcgcgctggtaaccaacccctctgcctcagacaagtccctccgacacagctcattactcaacgtgctgccgtcggcccccccgacaaaagcaaacagcgcttctgtgccaacaccaaccactcctcccctgcgactccccccccacccaccctaatacacagcggcaacaacacacccatcgcgggccctctccctcaacaacctac

SEQ ID NO: 635731 - DNA, 121 bp, Homo sapiens
atgtgcacaaattattgtggtacatgtaagacgtgactggaacagaaatgtagcagcagtatacgaacatgtatactatttcaccatatgccaataaaaggcgggtggagagctctcaagg

SEQ ID NO: 635732 - DNA, 314 bp, Homo sapiens
  misc_feature (10)..(10): n is a, c, g, or t
  misc_feature (63)..(63): n is a, c, g, or t
acggctgtancccacctctgcggataggcagagtttgtatgctttttgaaatatgtaaaattnacaaacaaagctcatcagtataatataattaaaagggccatttttccttggcactggtaattggaaaattttttggcctaaccgtagccctgtgctgtatcatgggcatagtatattgtaacctttgtctaaatcattggatttattgtgtcacttctgaagtttcacagacattgattgaattttattccatcctatgataagaagtgagataatttatgggagtgggaacgaattatagaccttgaatt

SEQ ID NO: 635733 - DNA, 141 bp, Homo sapiens
gtaacgccattaccgtccgagccgcgagagccttagccgacggaaactggacactggagcggcagcgcccatgagactcctcccccgtcttgctgctgcttctcttactcgtgttcccgtgccactggtcttgttcctgag

SEQ ID NO: 635734 - DNA, 1023 bp, Homo sapiens
  misc_feature (168)..(168): n is a, c, g, or t
gggcgggagtgtccgcggtggtggtcggtgcagagaggagcgtgaaggtgagcgcgctggaggagtcgtcgcgaagattctcaggctcgagtcgaagttagcgccagctgcaggcgagctggcggtcgccgagtcgcgtaatgacgtgaacacctgagatggctcgcngtagatgtgcagtcgagtcaccacgtggaccatgaagagtgcaatcttatcgtgttcgcccaaaccagcagatcaagaacacaatggtttgtggtgctaggagcacagcgagcccgagtcgccctggcgagcatggttttggcgagatgagtgcagaagcgggtggggcatctccgcgccgtccaagtttcgatcactcgcttgcacagcggggcttctgaccaggtatgatgtagaatgttcacggggctaggcctgtcagtggcagagctctgatcggaggggcgtcgggcgtcggccggcccaatgcctcctcgtctgaacccgccggcttatatcagctccatccaggcccggggcccccaagaccatcggtgcggggcgagctacaaggttgccaagaatcgatggggtgccctcgaacgcatgctttgcgtgagtacggaggtttgagaacgatgtcgagtgatcgaccgcatccaactccctgtcggagagacaagccctgctgcgcccgacccgtgcccgcctagggacaatgcggatgccagaggagtccgggcaccatcggccagagggggcccagggaaggcaggcagtcgaggccggttcgccggtcacagcgaggcgtgtggcggcagtggtgacaggcgacgggcggtggcagagaagaggcccaagtcttccagggagggctcagggggtccccaggagtcctcccggggacaaacgcccctctcggggctgattgttcggacccccaggctgctggtctgcgcagtggggcgaaactggcagttggccggcctttaacactacccgggaggttggacgggacaccattccggggttgcc

SEQ ID NO: 635735 - DNA, 805 bp, Homo sapiens
  misc_feature (344)..(344): n is a, c, g, or t
ccgagtgtctagaggagcatgatgacccatggcacccgcgagctgttcaccgtcagtcggcgcaatggtcagggcgccaggtcgggtcccggagcggaacatcctggagggcaggagtcaatagtacgagagtctaagaaacgctgagtgggcagggcagtctcctacaagtgctgccgatgaatgggaccaagtaaagtgggcctgactgatatgcggtgactatcggctcccttgagagtatgtatgttgaacgtgtggtattctctgctgacactggatcaggccaaaaggaaaggaagaggaaaacacgatcagagaaatcaagaagctcgctctcgagnccaggcaccgaagtggacaacaccatgaaaatagggcctatatacccatatgcatggcactgggcacgtgctagacaccagagtatgcgcctacgttcgtgcgcgtattcgtctggatactcccaagggtggagcagaacatagaacaggtctacacgcgagaaagatttactcgggaaggtccttgggaacggctcctgtatcaaagtcctgttggccgggatgggacaacaccgggcagcgccaacaccacaaaatgccgtaacaaaggggggcaacccaccaatggtgggcgcaccggcgcaacgttgcagcaacgacgcccttggaacagggtctcccgcatagaaaagggcccacccatggggcaactcgtcttcataacaccgtaacggcggagaggcgtttttaccccgggcacccgggtacctttgacccctacccgggaggaacaaccgcac

SEQ ID NO: 635736 - DNA, 154 bp, Homo sapiens
actctgcatatgggacaagtgaacaattttattaactcctgaattttccagttgactcttcctttacaagtagtaacaagttctaactagttgtgtaaatttcttcaaggccaagttttatcattgtggctaactatcctatagacgctgaagc

SEQ ID NO: 635737 - DNA, 161 bp, Homo sapiens
actcctcccccgccctgcacgcgcaggaccgacgcccaccgcatccgggccgccgacacgaggtgcgtgtgctccgactctgcaccgtcacacagcgtggcggcgacgatcctagctgcacgctcgcacctgagttagcagctcgcccctgggttagccgc

SEQ ID NO: 635738 - DNA, 136 bp, Homo sapiens
ccgagaatcgcaccactgaactccatatttgagggacagatcaagactccgtctcagaataacgaaaagtttgcttggggtccgggcccctgacaggcatatctctcctggtggctgccctgccctgtagtcacag

SEQ ID NO: 635739 - DNA, 205 bp, Homo sapiens
cacgagggatgccaggatggtcgcagggaacactttactggtagaaaggaagagatacaggggacatagatgtctcggtgtggggatgttggtcatcttgggctggttcacacaggcgagatcactaactgctatacacaagtttctacatttctacaacgatgatttcagccacaaaggcaaccacgtcaccatttccaaatta

SEQ ID NO: 635740 - DNA, 545 bp, Homo sapiens
ccctttttatccgtcacacacgagaagccacgtgacagtcatataaggatgcagtaacgacagatatactacgaagaatgaccatgatagtgatggatacatattctcccaaggaataccaagtataccaacacgatgaactatagcatatttgtatttctacttataaaaaagcagctataaactgtacaaaatgtataaaacaaagtcaatatagctccacgttgtattagctataattcccctatgagaagatatttggatctccccaatacattgataaaggtataataaatgtagaggctgtattgcaaacttaacttgcaggaatggtatgactgtgttacctactgctattcttctgtaaccaagaattgtagcaccatgaaacagacctctgggtcgcagtgggcatatttacccctttcaggatgtaggaggacatgtctagtatgtcaaacactgcaaggctatttcccaactttaaccttaccagcatgttaatatccagtcttattatagttaaaaagttaaagtgcctcata

SEQ ID NO: 635741 - DNA, 2655 bp, Homo sapiens
  misc_feature (1700)..(1700): n is a, c, g, or t
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcagtgagtggggttgaagagcagagcctgggttgagttgggatgtctggtgggaacctcccagctgattcatcttcctgcacccccttccctagtcagcagtgccatttctcatcttggtggccctcatggagagtaacctcatcattacatatgcggtagctgtggcagctggcatcagtgtggcagctgccttcttactaccctggtaggtatatacaggcccccctcctcgggtatctccagcccctagtccccagttttgaagctccttagggagagttctatgcagtgttctcccacaggccattctgtgggtccaggttaggagtgggggaggtctgtcctgtacagttgtacaggtagtgagctttgcaagaacacctagtcggagtgaaaaatgggggctgtaatctggcctgggctccacttgccacgctgagcacctccangcagggttacttcctcttagagcaagaggccttttcttattcatgtgaaggtcccatatcctcactgagctgtgtacccatggtactgcaagcttccagagggccacctcttctcattaacacagaggcccgttaggtgggtcagtcctcatggctgtcactactctgcgcaggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 635742 - DNA, 425 bp, Homo sapiens
  misc_feature (215)..(215): n is a, c, g, or t
  misc_feature (295)..(295): n is a, c, g, or t
ctcccttcccttgttgacatcatccctcacggacccgtcggctcctgtacccccagcagccagctactacatgaggaacagtgtgtctcctgtgcctgccccagcggccagctacgtgcggtgggccatgctaggggggtgacctgacacagtgctaacggagcctgccccagccctgttgggaatggctacgtcagtgctcgggcttcccaacncaggggcgagctgcaactcaggggcgagctgcaactcaggggcgagctgcaactcaggggcgagctgcaactcaggggcnagctgcaactcaggggcgagctgcaactaaggggcgagctgcaactcaggggcgagctgcagctcatggggcagagctgccaattagactctatttgtgggtgctttttggccggctttccaccggggtg

SEQ ID NO: 635743 - DNA, 722 bp, Homo sapiens
ttctggagtatgtatagcttgtacctgaagtgatccttcaatgtggcctgacttagaatgaagggatttaatcgtgttgaagttactttaatcaattaaattagctactcgaatatagaccctacgcctagattaaggttgaatatatgctattattcgtgcttcatatcctccttccattcataagtatatacttgacaagtacatctgttaggccaatgatttgagtctctttgaagttctgaggaagaggcaaagtacttaagactattaggaatctagatttcagatgtagtcattccagaacctgtctctttatgagttcacctgcataggtacaattctccacaagttggaatggcatgggtgtgtactgtaattcctgccaaagggccttcacaagagttgttacatctatcaagtgttccactttgactcgcaagaagaactggtaatataaacgaagagtatgtgtctttatttgtattggaaaatactgtctttaacatttgtggtcttgttgactactcctcagaatggtaatattacccgaattagacctgtttaatggatgggagcttggagcataggaaagaagttggaggatttgaattcccattaccagttctcattgtgttggtgcttaaaaatatattaatcgggataatgtaataaaggtttaaaaggtggtttaaatgtgaatagcagtttctggatatcgg

SEQ ID NO: 635744 - DNA, 803 bp, Homo sapiens
cgggtcccagcatcgggccaacccccaatgtttggtttttgtcaaaaatttgccttcttagaatgcaaaaaagttttatttctagttaagggccggttgttctcaaactgcggggtcccccggctgtaagaaattcgccccccgtgggcaatgggaacgtcaaaagatggcaaaaaattggaactttctataaagacccagatctcaaaaattaggttcctgaagaaaaggtcaccactaggttaggtctgctgtccaactcttaaaggtgcgaaagagcccgtctggagcaatgagtggtccttaggggtgaagtaccggaaaataagccatctagaaagatgttaaaggtacagttctccccccacatccctacagagccatctgggttccagtgttttatcagacagtttcctaccacactgtgatgtgttttcatgttgaaagtacttttggatttttcctttgagtgcccatttggcactagtagatcttctcaaggcagcatggtatcctggcatggattttaactatgagtgtatagtgtgaattgaaacaggcaccttttgtgccatgcgctttcatgtgagggacagaagcagtgtgatccagttgagttccatcatttggttgcgctgacctaggaaggttggtcagatcaaacattaaaaatgaccactctgtaaactgaaattagcttttgtatgtttatgggggtatgtactgtccagtaatattagatatgccagacgtttgtcagggactgcccttcccctcaatcttggggtgcaataaagaacgtt

SEQ ID NO: 635745 - DNA, 3604 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
  misc_feature (3534)..(3534): n is a, c, g, or t
  misc_feature (3537)..(3537): n is a, c, g, or t
  misc_feature (3578)..(3579): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctctaatactagtaatgctagaggtgatgtttttggtaaacaggcggggtttgtgtttgccgagttccttttacttcttttaatctttccttggtgcactcctgtgttgggttaacaatgtaattaataaacgttttagtgttgttttggtttattggttgttaattatcagtatattattagttactgatgtaagcgtgtgcgaggagaaaggcttcttgttactcatattaacattattgcttctatgtttcaatagattagtccggtattnggnctaggagtttgttattagtttttgggagtattgtgtgatanntgatagtggggaatcctctagacgt

SEQ ID NO: 635746 - DNA, 2145 bp, Homo sapiens
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactggggacgaggcccgccgctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 635747 - DNA, 306 bp, Homo sapiens
  misc_feature (7)..(7): n is a, c, g, or t
  misc_feature (30)..(30): n is a, c, g, or t
  misc_feature (89)..(89): n is a, c, g, or t
  misc_feature (213)..(213): n is a, c, g, or t
  misc_feature (253)..(253): n is a, c, g, or t
tgaaaanaccattggggacgtgcgaagctntagcgaaggccagggtcatggatgcctctgcctttgagatcttcagcaaattcccgccnaccctctaccaggacgatacactcacgcttgcaggctgcaggccttgtgcccaaaaaagcactgctgctgcgggcacgccgagccccgaagtccagcctgaaattcagtcctggtccctgtccnggtcccggccccagtccctgtcccggtcccggtcccggcnccagtccctgtcccggacccagtcccagcccccaataaagcacccgccccctc

SEQ ID NO: 635748 - DNA, 3401 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgctttttttattgaggtataaaatgtaagtaccttaaaatttccttcccttatatgaacactgtgtttgagtaattttgctggatttttcaaacacgtagtttcaaaaaccaagtgagtaactctaacatggaaactaaagcttgagcccagtgtctcagagctaaggctaatattgagcctacaaaaggaggttattaacaggaccagctagtttattt

SEQ ID NO: 635749 - DNA, 590 bp, Homo sapiens
  misc_feature (41)..(42): n is a, c, g, or t
  misc_feature (45)..(46): n is a, c, g, or t
  misc_feature (51)..(51): n is a, c, g, or t
  misc_feature (540)..(540): n is a, c, g, or t
  misc_feature (547)..(547): n is a, c, g, or t
  misc_feature (553)..(554): n is a, c, g, or t
gttgtaacaagcgccggtcagtgaccatgcacgaacttctnnagnngagtntagaggatgcccccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactccaaggatgcaaccagatgtgtgcaggctacctcttccagccagacaagcagtattaaagtggatcatccagccagacaagcagtattaaagtggatcatccagccagacancagtatntggatnntccagccactttaagtggtatccgggccggctcttt

SEQ ID NO: 635750 - DNA, 2475 bp, Homo sapiens
  misc_feature (2174)..(2174): n is a, c, g, or t
taacttagcatgtactagcaatttcggttggggtgacctcggagtacaaaaaaccctccgagtgattttaatctagacaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635751 - DNA, 1945 bp, Homo sapiens
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 635752 - DNA, 122 bp, Homo sapiens
tggatctcctggctagatactggaggatggaagctgagactgaaggagcaataaaaccaggtttgcagcgaatgtctggcttaacttaccccgctggttacacaagagaaggtccaggtatg

SEQ ID NO: 635753 - DNA, 2776 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctccgcaaggcaaaaagggtaccg

SEQ ID NO: 635754 - DNA, 1108 bp, Homo sapiens
gaggtcgtctagaggatcccaacgtcagcactcctggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 635755 - DNA, 2697 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
  misc_feature (2667)..(2667): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatgtaattaataaacgttttagtgttgttttggtttattggttgttaattatcagtatattattagttactgtncgttattaggttccgggatcctctagatca

SEQ ID NO: 635756 - DNA, 558 bp, Homo sapiens
  misc_feature (41)..(42): n is a, c, g, or t
  misc_feature (45)..(46): n is a, c, g, or t
  misc_feature (51)..(51): n is a, c, g, or t
  misc_feature (508)..(508): n is a, c, g, or t
  misc_feature (515)..(515): n is a, c, g, or t
  misc_feature (521)..(522): n is a, c, g, or t
gttgtaacaagcgccggtcagtgaccatgcacgaacttctnnagnngagtntagaggatgcccccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggaagaggtagcctgcacacatctggttgcatccttggagtattaaagtggatcatccagccagacaagcagtattaaagtggatcatccagccagacaagcagtattaaagtggatcatccagccagacancagtatntggatnntccagccactttaagtggtatccgggccggctcttt

SEQ ID NO: 635757 - DNA, 2242 bp, Homo sapiens
  misc_feature (1)..(1): n is a, c, g, or t
  misc_feature (6)..(6): n is a, c, g, or t
  misc_feature (1941)..(1941): n is a, c, g, or t
nagatnctagaggatcccctttttgccttgcggattcatacaagtccttatttggagaacaagtgattatgctacctttgcacggtcagaataccgcggccgttaaactggtgtcactgggcaggcattgcctctaatactagtaatgctagaggtgatgtttttggtaaacaggcggggtttgtgtttgccgagttccttttacttcttttaatctttccttggtgcactcctgtgttgggttaacaatataattaataaacgctttagtgttgttttggtttattgattgttaattatcagtatattattagttactgatgtaagcgtgtgcgaggagaaaggcttcttgttactcatattaacattattgcttctatgtttcaatagattagtccggtattgggctaggagtttgttattagtttttgggattatgttggtgaatttgttgagctttaacgctttctcaattgatggctgcttttaggcctactatggtagtattaagattttactctctagtcaaggttgtatccgtttctaaaaagctgtacctttttagactatctcttaaaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635758 - DNA, 1163 bp, Homo sapiens
  misc_feature (41)..(42): n is a, c, g, or t
  misc_feature (45)..(46): n is a, c, g, or t
  misc_feature (51)..(51): n is a, c, g, or t
gttgtaacaagcgccggtcagtgaccatgcacgaacttctnnagnngagtntagaggatgcccccactttaatactgcttgtctggctggatgatccactttaatactgcttgtctggctggatgatccactttaatactgcttgtctggctggatgatccactttaatactgcttgtctggctggatgatccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 635759 - DNA, 2834 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
  misc_feature (2764)..(2764): n is a, c, g, or t
  misc_feature (2767)..(2767): n is a, c, g, or t
  misc_feature (2808)..(2809): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattggaagtaagagacagtaaaaccctcgtgtggccattcatacaagtccttatttggagaacaagtgattatgctacctttgcacggtcagaataccgcggccgttaaactggtgtcactgggcaggcattgcctctaatactagtaatgtaatactagtaatgctagaggtgatgtttttggtaaacaggcggggtttgtgtttgccgagttccttttacttcttttaatctttccttggtgcactcctgtgttgggttaacaatgtaattaataaacgttttagtgttgttttggtttattggttgttaattatcagtatattattagttactgatgtaagcgtgtgcgaggagaaaggcttcttgttactcatattaacattattgcttctatgtttcaatagattagtccggtattnggnctaggagtttgttattagtttttgggagtattgtgtgatanntgatagtggggaatcctctagacgt

SEQ ID NO: 635760 - DNA, 1731 bp, Homo sapiens
  misc_feature (1608)..(1608): n is a, c, g, or t
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtggcagctggcatcagtgtggcagctgccttcttactaccctggtaggtatatacaggcccccctcctcgggtatctccagcccctagtccccagttttgaagctccttagggagagttctatgcagtgttctcccacaggccattctgtgggtccaggttaggagtgggggaggtctgtcctgtacagttgtacaggtagtgagctttgcaagaacacctagtcggagtgaaaaatgggggctgtaatctggcctgggctccacttgccacgctgagcacctccangcagggttacttcctcttttttgaaagataataacacactattgtatagagggatttagctaaagtcacgccgccctttatgacctaactggaattttatcccaactctgtgagactccaata

SEQ ID NO: 635761 - DNA, 119 bp, Homo sapiens
gggaatctcccgggcaggagcggaatctgtcccgaaccgggtctgtgaggaactcgcgaacttggattaggaaatccctgcgcccggagcgtttatcccggaacccggatttaagatcg

SEQ ID NO: 635762 - DNA, 1700 bp, Homo sapiens
  misc_feature (1399)..(1399): n is a, c, g, or t
acctcgggccggctagagcggccggtagagcggctaaatacattggaatttagggtttttggggtatttttaaggttgaactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635763 - DNA, 1607 bp, Homo sapiens
  misc_feature (1607)..(1607): n is a, c, g, or t
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggagagtaacctcatcattacatatgcggtagctgtgggaagtggcatccgtgtggaagctgcttcttactaacctggtcaagctgctgatgtcatgacgactcatcctgaaacaagccacttcaggaacgagccaacttttctttatgtttttcaccaagttgctctggagtcagggattacaccccattggattggggccaccgggtgttcccgattataacgaaacgacaggccaaacgggggcgcaaccaagaaggggaaaggcggagaaggaaaaaattccctcacgctctctgtgtgcacttcctattcgttctn

SEQ ID NO: 635764 - DNA, 218 bp, Homo sapiens
tctatgctacacggctccttcttggctgctgttggcaacctcactcgtgggtcattgccagctaccgagtgggtgtcttcgcgcttcctgagcttctggcgtccggcagcaggtgagctggcaactggcgcggctgcctggaccaggctggcggctctgcacctgggctgcagacccacactccgcaggcatttggcagggcaccctcgcgcgcgctg

SEQ ID NO: 635765 - DNA, 2581 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatagggtcttctcgtcttatttttttattcccgcctcttcacgggaaggtcaatttcactgattgacccatcggcgtgtacgccgatgggtggagtaacattacatagtgttggggatttgctttaaagtatctcagccaagaaaagaaaaaaagagaaaaaggagttcccgctgtggcgcaacaggatcagcagtgtctctgtagctccaggatgaaggttcgatccccagccatgcacagttggttaaaggatcctgtgttgctgcagctgcagcgtataggcggaccatcggcgttg

SEQ ID NO: 635766 - DNA, 1341 bp, Homo sapiens
ggtgcagcagagtgcgttcctcgtctgccagccggcttggctagcgcgcggcggccgtggctaaggctgctacgaagcgagcttgggaggagcagcggcctgcggggcagaggagcatcccgtctaccaggtcccaagcggcgtggcccgcgggtcatggccaaaggagaaggcgccgagagcggctccgcggcggggctgctacccaccagcatcctccaaagcactgaacgcccggcccaggtgaagaaagaaccgaaaaagaagaaacaacagttgtctgtttgcaacaagctttgctatgcacttgggggagccccctaccaggtgacgggctgtgccctgggtttcttccttcagatctacctattggatgtggctcaggtgggccctttctctgcctccatcatcctgtttgtgggccgagcctgggatgccatcacagaccccctggtgggcctctgcatcagcaaatccccctggacctgcctgggtcgccttatgccctggatcatcttctccacgcccctggccgtcattgcctacttcctcatctggttcgtgcccgacttcccacacggccagacctattggtacctgcttttctattgcctctttgaaacaatggtcacgtgtttccatgttccctactcggctctcaccatgttcatcagcaccgagcagactgagcgggattctgccaccgcctatcggatgactgtggaagtgctgggcacagtgctgggcacggcgatccagggacaaatcgtgggccaagcagacacgccttgtttccaggacctcaatagctctacagtagcttcacaaagtgccaaccatacacatggcaccacctcacacagggaaacgcaaaaggcatacctgctggcagcgggggtcattgtctgtatctatataatctgtgctgtcatcctgatcctgggcgtgcgggagcagagagaaccctatgaagcccagcagtctgagccaatcgcctacttccggggcctacggctggtcatgagccacggcccatacatcaaacttattactggcttcctcttcacctccttggctttcatgctggtggaggggaactttgtcttgttttgcacctacaccttgggcttccgcaatgaattccagaatctactcctggccatcatgctctcggccactttaaccattcccatctggcagtggttcttgacccggtttggcaagaagacagctgtatatgttgggatctcatcagcagtgccatttctcatcttggtggccctcatggaagtggggctgcttcagatggaagttgtcaatgacatcaggcagcatggacca

SEQ ID NO: 635767 - DNA, 294 bp, Homo sapiens
aatccaagcagtcggttgcttctatactttatcttaaataaaacatcacctccatcacagcaggggccattttctctatcctttcatctcgcaacaactgggctgggtaaaagaataaaaggtggctcgttaccttagaatgatcacagtgacaccagtccaagcagagagcagagactgcttatgtccagtctccagaactagactgtgagctccttgaaggcagatagtttttgttctatttccttctaatatctcattttctattttctgcgactgcttggattacaagga

SEQ ID NO: 635768 - DNA, 1727 bp, Homo sapiens
  misc_feature (1426)..(1426): n is a, c, g, or t
actccatctttgactgccaaaagcccatgtagaagcccctattgcaggttcaatagtacttgcagccgtactgctaaaactcggaggctatggcataatgcgaatcactaaaattctttctcggacaaccagctatcaccaggctcgttaggcttttcacctctacctacaagtcttctcactattttgccacatagatgagttggttcttttaaactgctcataggtagctcgtctggtttcggggtatctagctaaagttctctttgttagattttttctggttaaaccattatgcaaaaggtagaaggggtaatctttgcttttttttacttttattttattctttcatctttcccttacggtactatctctatagcgtcaggataaaaatttctatctcctatactttaatgttaggtgaatgttttattttattttggtgtatttttgtatttgtttagtatgttgagctagctttggttcaaagtacccatacattgtgggatcttctaggtgtaaactaggtgctttagtttaagctatgctttggtaatccaagcacactttccagtatgcttaccttgttacgacttgtctcttcttgcatggttgtgtaattgaatataggttatttttattactacatgcttgaggagggtgacgggcggtgtgtgcgtgcttcatggccttattcaatcaagcactctattcttgatttactgctaaatcctcctttggtttttagtttcataaaaactttcgtatggtgggtattcttatgtagaaaatgtagcccatttctttccaacccataagctacaccttgacctaacgtttttatgtgttatgattgtgcttactattgttcctttttagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635769 - DNA, 145 bp, Homo sapiens
aatagtcggggctgctgggcggtgccccgcacgccagcgtcccgactattcgtggcatgatcctgattctcatcttcgccgaggagctggactctacggtctcatcgaaaccctcatcctctgcacaaaggagaccctctcagag

SEQ ID NO: 635770 - DNA, 181 bp, Homo sapiens
gccttttggttttttatatatttataaaaaaagaaaaaggtggggattgccttgggaaattcccagggtattactgggcctatgtggggtattgttaaaccagggtccctgtgatactggtgctcttgatggtcctgatacaggtaaggaaaccgttgggccactttgataccaaggatat

SEQ ID NO: 635771 - DNA, 429 bp, Homo sapiens
  misc_feature (70)..(70): n is a, c, g, or t
aactactaccgcaactaccaataaacaccactgaaatactcaactgtgtgaagaagtgaataaatgatgnaaaggtgaacaacactccaacctatagactttatggtctcacctcttttgctgaatttaagttcctggtagcgtgatgaacatgcctatcagccgtatccgccttcctgccttttgaatttgataaattaatactataacgattgttccatttcattcgtggtattaagaaataactcctaataaggaaaagactggaggcccctattcagagtatgtatgtttatgcctaaatggaaaatacatagcgcatcattaacaaagagaaactagtgcacctccacatggggcatgctttttggacgtcgttgctcagtgtccagaagcttgatgtccaattaatacagaaattgctacatg

SEQ ID NO: 635772 - DNA, 299 bp, Homo sapiens
tacagtacgagtcaattaaggctcttactatttgtaaatcgcccagcctcaggtatgtcttatatcagcagcgtgaaaccagactaatacagtaaattggtatgttgctgaaaagatgcccgaaaatgtggaagcaactttggaactggataacaggcagaggttggaacagtttgaagggctcagaagaagacaggaaaatgtgggaaagtttggaacttccttgagacttgttgaatggctttgaccacaagcctgatagcgatatggacaataaggtccagactcaggtggtgtga

SEQ ID NO: 635773 - DNA, 1112 bp, Homo sapiens
tccaaacaataatcttttattttatatcttctctatacttgtgatagcaaatctctttttttgtgcgtgaattttaattttattaattaaacttttttaaatttacattcttcttctctcttcttttttatttttaaaatctcagaggcctcttttatatgtgtctcaaacatctctttttttataccttattattttataacatttaactttttataacatatctccccccctttggtgcactctataatcaccggtgggaattatttcgaggttatttcacgtggtgtgtgtgtgtatacacacctataaaacaagagaggggagggagggaaaaatataagagcgcgaggtgaacacttgtggacacggatagtgttctcaaacaacacagagcagagatataaagagttaaacccccttcagaggtgcaccatattaccagagcatgtgctcttttctgtggaagacgccgtttaacctcttttcacgcccagagagagatattctcctctcagagccccccctttcccctttatctctccccctccttatatcctttccaaaagcaacaaaagagccaaaaaagaggctgtgaggctccttttctcggctattcatctcttgtgagagagccagaaacagtttgtgtcgccagtggggggcacactagtgccactccaacaccgaagataatcacgtgtgtggcaaagacccccagcgtgtgaacgcgcgtgttgaaatcctctattctccccgcggtgtgtgcttacgcgccccggtgggacacctttcattccttcctgggacactttccatttccccccttgggcgctctctccctccccttctcccctcgggctctttccacaaattttaaggggagggaagccccccatattcatacttttgcacaggtggtttataccataccccatgttgattacaactatttacgcaggggctggtgccccacaagaggacccggtttccctatgagaaaatttctttttgggccccaaaataaaagcaaattaggacgctccacacgcacacgctgaccgattacgacaacgactcaataatcctgcactacttatacacagtatgaa

SEQ ID NO: 635774 - DNA, 688 bp, Homo sapiens
  misc_feature (20)..(20): n is a, c, g, or t
  misc_feature (31)..(31): n is a, c, g, or t
  misc_feature (61)..(61): n is a, c, g, or t
  misc_feature (136)..(136): n is a, c, g, or t
  misc_feature (200)..(200): n is a, c, g, or t
  misc_feature (202)..(202): n is a, c, g, or t
  misc_feature (207)..(207): n is a, c, g, or t
  misc_feature (255)..(255): n is a, c, g, or t
  misc_feature (318)..(318): n is a, c, g, or t
  misc_feature (381)..(381): n is a, c, g, or t
  misc_feature (611)..(611): n is a, c, g, or t
  misc_feature (630)..(630): n is a, c, g, or t
  misc_feature (671)..(671): n is a, c, g, or t
aggatctcagcatagtgacncaggttcagtnagtgtactcgcagtatgaacgcccatagcnatggacggcccctcagtaattatctgtttgaatgagtgcctgtgccagcaagtcatgcctactgctactcactcnctccaagtcaacattctcgctcagccttccgagtaatggatcagtatgcgcaccatgctgctantntgatnttagtaagatgagttctccatgttggcagctggtcttgactccgaccntcaggtgatccgccaacctcagcctcgcaaagtgctggactactaggtgtgagtcaccacgcncagcctagagtagtcagattcttaatgctagaaagtagaatagctgtcagaggccagaagagnggataatggacagttactgtttaatgggtagaggtgtccaattgtgaatgatgagaaaagttctggagatcatggtgatgatggttgcacaacatgaatgtatttaatcacacagactgtacacgttaaattgccatagttctcaaccagcagatctcatgctgttggccaatctgcagggtggcaggagctccattgactccttggggaaagtatcagaaggctgctgnggatggcactgggaccccncctcctcctagtgacaaggaggcttcttcagaaataagaanagctactcatctcgtgc

SEQ ID NO: 635775 - DNA, 777 bp, Homo sapiens
cactaggataatcagaacccttttcgagtgcatggatggaacctcaccgtcctccccaataacacagggtccatcctgacgtcacctcgcgtgctgtgcctggagtgactattccctggctaaatattggcatggtcttttctatcctcatgctggttctcgagaccaaaatcaccttccatacatcgactacttacacactggtgctgactgcatttggtattgcattgcctgctgaggaggagaacaagctggaagatgtggtccagaccctgctgcaagaccaattggcaccccaggtctgcagatgctgcaaagcaatcgtcattgatctccgccaggaggtgctgatgcatagagaccgggagtcaatggtgcacaggaccgatgcatcatagtggaccagtttgtcgtctgcttcccgggatcctatgtgtccaaagtgtgctgtgggtacagcgtgtctgaaaccgtgcactttgctagcacccagtggacaactatgggctcttgagaccggcaacggaaatgacagcgtcagccatatagctaacgccattctccactggagaagttactctaccagattgcacaagcagaagcagaagaagaagacggtcccactctcagctaccagtcttcagccctccgtggatgagctcagggagtacagagctacggtaagcgcgagcagctgttcgaggctgagctccactcctccggacgctatggcagaccacgatggcagcagcaccggtggtcggaccgggaacgaaa

SEQ ID NO: 635776 - DNA, 308 bp, Homo sapiens
  misc_feature (1)..(2): n is a, c, g, or t
nnactcgccttggttgatccactttgcagcagtgtgtggaatccagctggtacttggctccagattcctttttctcagctgtgccacccagaagagcccagtccttcctgaaattgtgactgggaagtgggtctctattggaatacaggatggtgctaagtgcttttcctcgtgacatgttcaccttacaactcatttgatcggcacaggggtggggacattattacgcttccacagccacagtgagcaactctgggcccagtgacccgtggcatgcattcattcacctgacacttgtaagcacctgc

SEQ ID NO: 635777 - DNA, 128 bp, Homo sapiens
attagaggatcccatgctcatccctccttggattaagcggttcttggtaccagcaacttcaaggtttctgccagcccactgttgtatacgcttattgagaaaacaatgcacaatgtgcaagcatccgg

SEQ ID NO: 635778 - DNA, 160 bp, Homo sapiens
cccgggtttttgggggtttttttttttaaaaattttccttccccccccccaaaaaaaaaagggggaaaatggggggcaaattttttcccgtttttttcccaaaaagggggggaacccctaggggggggcctttaaaagaccccaaaaaattttttaaaga

SEQ ID NO: 635779 - DNA, 168 bp, Homo sapiens
actggcctccattgggcgtatgctgaggtctgccgcaaaccctgcagcagctggttaggagtgtaaggtggctgtctctgcgaggcagaggcaggcgtgggaggcagttccctttatactcgatcactgccatcgttggcccgatccaaactccgatttgggatctgc

SEQ ID NO: 635780 - DNA, 539 bp, Homo sapiens
tactcgtggatcccctcggctgcaggtattcggttctagtatatatatatgtatatatatatatatatatatatatatatatatagatagtgtttatccctagttatatatacccccttttctttgtcttttcttttttttctttttttttctcttctttcttttctttctttctcttctttttctttctcttttcttgttcttttcttttcttgttttttctcttcttttttctttttttttttctctttctttcttctttttttttctcttctttctttttttttctctttttctcttttttctttttttcttttctttcttcttttccttttttctctttcttctctttctttttcttttttttttttttctctcttcttctttttctctcttttcttttttcttctctttttctctctttcttttttcttttttttctctttttttttttttttttttttttttttctttctttttctcttcttttttctttcttctctcttttctttcttctttctttttctttttttctttct

SEQ ID NO: 635781 - DNA, 733 bp, Homo sapiens
tggccgggctcgctgtctcaagcctgatttcagagcgatctgctagatcatggctaggctggcctacaagtcccagcgtttgataatggtgctggcctagaccttgcaacgtgctcactacactgacatgcatgcacttggacccagccatacgacattggctatgattctccatcgactttgtcactgactcagaggtctcgattagtcacagagaaactagaggagcagacctcattgcttgatacattaccagtccacgctagtgcactagtagcagcacgatagtggactactacaattgcaacgctcgcatgatacatggctagggccaagtcagaatcttgagcatgctcagatgttaaccattgacgagtgcaaagagtactagagtatcaatgatctaacctgtgttctaaccttaggaatgctgtgtgatactatgcgttgcagctttagtagactcctacattatctgattgtagcataattactccactaggtggccgatactcgcgtaccttggatactgatacgctggtcaacctatcaatactaccagggtccaccttggccgcactggataaccccccctgtaacattcctcaggaccacctcaattccactcctagcgcctaactccaattctggcctaaccctcctcccattttaacacatcacccggtcggcttcaggtgcctcactgtgcctctactcatgagcaccatacacc

SEQ ID NO: 635782 - DNA, 154 bp, Homo sapiens
ctttttaaacgaatttaaactaaacaagcttcaggcttgagggggaattgccatgttgggttgggaaaaagggtattgcagggcagaattagctttagcattattaagcggtttcaatgggggcattatgttggggcttaaaccaccacccaaa

SEQ ID NO: 635783 - DNA, 367 bp, Homo sapiens
ttacactcgagagatacgaaaacacacacccacacaaaaacttgtacatctatttcatagcagcattatttacaatagccaaaagtggaagcaatgcaaatgtccatcaactgatgaatggacaaacaaaatgtagcatatccatacaatgcaatattattcagcattaaaaaggaatgaagcactgatacatgttgtgatctgagtgaaccttgaaaacattatactacgtgaaagaatacggtcacaaaacactacatactatatgcttccatttatatgaaatgtccagaataggcaaatctagagacagaaaatagactagtgattatcagaggctggcagagacagtgaaataggaagtgac

SEQ ID NO: 635784 - DNA, 150 bp, Homo sapiens
  misc_feature (101)..(101): n is a, c, g, or t
cgccatgatcagctcgtccattagcgcgtctggtggagttgcaccaaccgctaaaatgcacgccatcatcgagcgcacggcagcttcgtgtgcaggcaggnagcacaggttgaggtagtggtcgaagcgcagaaagtcaaactgggagtt

SEQ ID NO: 635785 - DNA, 516 bp, Homo sapiens
gccagggctggggtgtgagggcctacctctcacctgggggcacagaggctagagggtgtcacagatggccgggctgccagagctgcaaaggaacagccagcctgtgtgagcaagagcccgtgtgggcaccagggccctcactgtgtggtctctggagctgaccaccagttggtcccagccctgaccttggcccagaatccaccagggcagggcctgtgaacagggccaacttggggccctcctccgccctctctggatgcctccccttcagcactgggcctgccaggcagacagatggacacgtgcttgaggaaacacgggttttatctgggcgaggggttcacgcctgtgctccggggcccctgcccaggttgtgccgggttcagagttgactggctgccagtggaacagagtgtactttgctaatgaagcccttgtcattggacagataggcccctccaggtcctccctgccctgtaataaacgttgccaccgtgaatggtgctgctggacatc

SEQ ID NO: 635786 - DNA, 870 bp, Homo sapiens
  misc_feature (41)..(42): n is a, c, g, or t
  misc_feature (45)..(46): n is a, c, g, or t
  misc_feature (51)..(51): n is a, c, g, or t
  misc_feature (432)..(432): n is a, c, g, or t
  misc_feature (435)..(436): n is a, c, g, or t
  misc_feature (438)..(438): n is a, c, g, or t
  misc_feature (448)..(448): n is a, c, g, or t
  misc_feature (459)..(459): n is a, c, g, or t
  misc_feature (468)..(468): n is a, c, g, or t
  misc_feature (471)..(471): n is a, c, g, or t
  misc_feature (485)..(486): n is a, c, g, or t
  misc_feature (492)..(492): n is a, c, g, or t
  misc_feature (496)..(496): n is a, c, g, or t
  misc_feature (500)..(500): n is a, c, g, or t
gttgtaacaagcgccggtcagtgaccatgcacgaacttctnnagnngagtntagaggatgcccccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgctngtnngnctggatgatncacttttatantgcttgtcnggntggatgatccactnnaatacngctngtcnggctggatgatccactttaatactgcttgtctggctggatgatccactttaatactgcttgtctggctggatgatccactttaatactgcttgtctggctggatgatccactttaaataaaccaaacattccattttaaatgtggggattgggaaccactagttctttcagatggtattcttcagactatagaaggagcttcccgccaaaggtcaccccaggcccgactgaggaaaacagcgcgaacaagcctcgtctgaatgcacacacaaagactagatcaggtatactgggacaatagtatcgaatagatttcagctatagctggagtagaggtcagggatcctcagcgtcgacctgacagaatgca

SEQ ID NO: 635787 - DNA, 316 bp, Homo sapiens
gaacatgcgtgtgggaattcacagcgggcgagtacactgcggtgtccttggtctcaggaagtggcagttcgacgtctggtctaacgatgtcacgctagccaaccacatggaggctggcggcaaggcaggacgcatccacatcaccaaggctacactcaactacctgaatggggactacgaggtggagccaggctgtgggggcgagcgcaacgcctacctcaaggagcacagtatcgagaccttcctcatcctgcgctgcacccagaagcggaaagaagagaaggccatgatcgccaagatgaaccgccagagaacc

SEQ ID NO: 635788 - DNA, 2314 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
  misc_feature (2284)..(2284): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgttttatccctttgtggttgaattgtttaacttttggaatagttaattaaagctccatncgttattaggttccgggatcctctagatca

SEQ ID NO: 635789 - DNA, 1216 bp, Homo sapiens
gtgcctgtcatcttcgttgctgcccacatgatgtcatctggctgctcttgggcagggctgggagccactttggggttctgggaagggcaggaggggctctgtggctctaaagcacctccctttaaccccctttgtccatccacagctctcggccactttaaccattcccatctggcagtggttcttgacccggtttggcaagaagacagctgtatatgttgggatctcagtgagtggggttgaagagcagagcctgggttgagttgggatgtctggtgggaacctcccagctgattcatcttcctgcacccccttccctagtcagcagtgccatttctcatcttggtggccctcatggagagtaacctcatcattacatatgcggtagctgtggcagctggcatcagtgtggcagctgccttcttactaccctggtccatgctgcctgatgtcattgacgacttccatctgaagcagccccacttccatggaaccgagcccatcttcttctccttctatgtcttcttcaccaagtttgcctctggagtgtcactgggcatttctaccctcagtctggactttgcagggtaccagacccgtggctgctcgcagccggaacgtgtcaagtttacactgaacatgctcgtgaccatggctcccatagttctcatcctgctgggcctgctgctcttcaaaatgtaccccattgatgaggagaggcggcggcagaataagaaggccctgcaggcactgagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 635790 - DNA, 2338 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcaccccaaccgaaattgctagtccatgttaagttatgtggttagtatgagtgaaatgatatataacactaaagagctgattaagagtacgattattaaggtgtgatcgtgaaagtgtaggagttcttctatgatgggtgaagtggcgtc

SEQ ID NO: 635791 - DNA, 984 bp, Homo sapiens
  misc_feature (303)..(303): n is a, c, g, or t
  misc_feature (492)..(493): n is a, c, g, or t
  misc_feature (496)..(496): n is a, c, g, or t
ctctgtccttaaggagcctgttataggacgtgtgtatccatcacctcccatacccctccaacaaccctaagtatcaggttcttaggttccccctctgcaggtgaagaagttgaggtttcagcaggaagagtacctggcccagctgaaaggggcggagctggggtttgagcctcagcattccggctccagagactgcactcttcatcagcctcctggcatataggacctcgagtgtggcctgaccctgcatctggggaaaccagtgggcaggctggagtgagtcatgccagcccgtcagccagnccaggcgagagtgtagatctagggtttgcagtaccctgtgtgcagcaaggacagtaaacagaccaaccaacagttgaaagtgggagtgagcaaactctgtgtcccgcggttcactttagtccgacagcagggccaagatcacgtgaggaaggaggcaggtggggctgaggaggggtaaggatggatgcnnccnccaacccatctcctctctctcttgcagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaaccttttttttacagagcctaattaataacttaatgactgtgtacatagcaatgtgtgtgtatgtatatgtctgtgagctattaatgttattaattttcataaaagctggaaagcagctgcctgtt

SEQ ID NO: 635792 - DNA, 2383 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctagggtaacttgttccgttgatcaaaattttggatcaataagtgatgttatggttattttgactggtttgtctagattaaaatcactcggagggttttttgtactccgaggtcacccacaactttacactatttttattgtcttactcagtattttgtatatcaattctatgatgattggaagtgaccgcattactaagtgacttggaagtgacccacttagtgtgtggtaaagggagcacagcacctcagtttctccccagtctttgtctcttagtggcaaataccctcaggaggaggaggagga

SEQ ID NO: 635793 - DNA, 541 bp, Homo sapiens
  misc_feature (41)..(42): n is a, c, g, or t
  misc_feature (45)..(46): n is a, c, g, or t
  misc_feature (51)..(51): n is a, c, g, or t
  misc_feature (491)..(491): n is a, c, g, or t
  misc_feature (498)..(498): n is a, c, g, or t
  misc_feature (504)..(505): n is a, c, g, or t
gttgtaacaagcgccggtcagtgaccatgcacgaacttctnnagnngagtntagaggatgcccccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggaccaaggatgcaaccagatgtgtgcaggctacctcttccagccagacaagcagtattaaagtggatcatccagccagacaagcagtattaaagtggatcatccagccagacancagtatntggatnntccagccactttaagtggtatccgggccggctcttt

SEQ ID NO: 635794 - DNA, 214 bp, Homo sapiens
gttctgcagtggcatcctcttcctcgcattcctctgcagagtgacacagaactgtgctgatcgcatgagactggtagtgtactgagtcctctggttggtcacgagccgataccgggttggcaggaattgatacagcacttcgtcagggctcagacacatgatccatgtcggcccctgtcagggacctgccttaaattcagaatctctggttgag

SEQ ID NO: 635795 - DNA, 2289 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtaggatgattgctagtgttacttcatatgagattgtttgggctactgctcgtagggccccgatgagtgcgtattttgagttggatgctcatcctgatcataggatagagtagactgctaggcttgacatggctagcatgaatagtactcctagatttatgttgattagagggtagggtattggtagtggaactcatattgttagtgctagggataaggctaggattggtgcaataatgaacatggagattgaggatgtggctggtcgtaggggttctttggtgaatagttttagggcatcggcgatgggttggagtaggccgtaggggcctacaacgttgggtccttttcgtagttgcatataacctagtacttttcgttctactagggtgaggaatgctacggccagtaggataggaatgattaggcttagaatgttaattatgaacatgctattagggagaggagttgaacctctggtaataaaggtttaagttttacgcaattaccggtctctgccaccctaatgtgccctgttctagggctggatttattatgagttaattaggttaagattatatcattaattatctctgagacgcgtttgtgaggttggtcccatttctcttgtcctttcgtactgggagaaatttataatagatagaaaccgacctggattgctccggtctgaactcagatcacgtaggactttaatcgttgaacaaacgaacctttaatagcggttgcaccatttgggtgtcctgatccaacatcgaggtcgtaaaccctattgtcgataggaactctagaataggattgcgctgttatccctaagggttacattgttctcgttgctgctatgttagtggatcacactgagcaatattagttcgctttgatcggtgaaatcttagacatcttactgctacggaggcttgattttgttcacaagttcgccccgaccgaaattatcaattcaggtatgttagtttaggacctgtgggtttgttagatactgtcgacacgaatgttccggggatcct

SEQ ID NO: 635796 - DNA, 441 bp, Homo sapiens
  misc_feature (391)..(391): n is a, c, g, or t
  misc_feature (398)..(398): n is a, c, g, or t
  misc_feature (404)..(405): n is a, c, g, or t
ccattatatgtgttgctgacacacttatactgttgtctgctgatatccattatactgcttgtctggctggatatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactccaaggatgcaaccagatgtgtgcaggctacctcttccagccagacaagcagtattaaagtggatcatccagccagacaagcagtattaaagtggatcatccagccagacancagtatntggatnntccagccactttaagtggtatccgggccggctcttt

SEQ ID NO: 635797 - DNA, 462 bp, Homo sapiens
  misc_feature (1)..(1): n is a, c, g, or t
  misc_feature (349)..(349): n is a, c, g, or t
natttatcaatgtcaggttttttcagaaatgctacctaaaaaatttccagctataaataatggaaataaaatgttaacttttatttactttttgaaggtttaaatggaattatttatctaaagttttccaaatttttatgtcaagagatatctcagctaatatacttactcatactgaactatgttcacaaataattccaaatataatttctaaatttcaaatgcccatttttgttatgcacagaaatgtatttcaagatggtaacacaggcaggaggaatgcttgagctcaggagtttgagaccagtctggggaacatggcaaaaccctgtctctccaaaaaatacanaaactagcagcatgtggtggtgcatgcttgtggtcccagctactcgggaggctgaggtgggaggattgcttgagcccaggaggtcgaagctgtagtaagagagaccctgcctc

SEQ ID NO: 635798 - DNA, 777 bp, Homo sapiens
  misc_feature (20)..(20): n is a, c, g, or t
  misc_feature (476)..(476): n is a, c, g, or t
aaaagaggatcccgcgaacngtaacgagaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635799 - DNA, 397 bp, Homo sapiens
  misc_feature (347)..(347): n is a, c, g, or t
  misc_feature (354)..(354): n is a, c, g, or t
  misc_feature (360)..(361): n is a, c, g, or t
ataactactgactagtaaggactggataatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactgcttgtctggctggatgatccactttaatactccaaggatgcaaccagatgtgtgcaggctacctcttccagccagacaagcagtattaaagtggatcatccagccagacaagcagtattaaagtggatcatccagccagacancagtatntggatnntccagccactttaagtggtatccgggccggctcttt

SEQ ID NO: 635800 - DNA, 424 bp, Homo sapiens
agtgacatacagtgatcctaaattatcaacttgtcaaacatttaataatttccttctgttttttcgtctgaagagaccgaatgcttagatagataacaatagatgcctggaaaatgtagccaagtagttcctcttgacaaaatcttccctttttgatagtttggaacagagccactgtatggtgactggtagactccaagagttgctttaattgatacactgagactgggatggacagagtacatttgattgtctattttacctgcaatgcaatataaatcaacgtcatttggcttaatgttttaaattcattacatcagttatattgatattctgtaataaaccagcatttttccccatgacattaattttttttagtatttctatgtttcaaataaatacctttacttagtaaaaaaaaaaa

SEQ ID NO: 635801 - DNA, 1355 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtgttgtgattagggttgatagagtatatgatccatttattaggagtactgatagtccttctaggcatagtagtgaagatattaagtgagatcgatatataagtaaccctgcaagggcgatcgcgaatgctataatgatgtttatatatactaatggcacttg

SEQ ID NO: 635802 - DNA, 523 bp, Homo sapiens
  misc_feature (41)..(42): n is a, c, g, or t
  misc_feature (45)..(46): n is a, c, g, or t
  misc_feature (51)..(51): n is a, c, g, or t
  misc_feature (473)..(473): n is a, c, g, or t
  misc_feature (480)..(480): n is a, c, g, or t
  misc_feature (486)..(487): n is a, c, g, or t
gttgtaacaagcgccggtcagtgaccatgcacgaacttctnnagnngagtntagaggatgcccccactttaatactgcttgtctggctggatgatccactttaatactgcttgtctggctggatgatccactttaatactgcttgtctggctggatgatccactttaatactgcttgtctggctggatgatccataatactgcttgtctggctggatgatccactttaatactgcttgtctggctggatgatccactttaatactgcttgtctggctggatgatccactttaatactgcttgtctggctggatgatccactttaatactgcttgtctggctggaagaggtagcctgcacacatctggttgcatccttggagtattaaagtggatcatccagccagacaagcagtattaaagtggatcatccagccagacaagcagtattaaagtggatcatccagccagacancagtatntggatnntccagccactttaagtggtatccgggccggctcttt

SEQ ID NO: 635803 - DNA, 316 bp, Homo sapiens
tgttatgtgaaaaaagccagccacaagggatcacatattagaggatttcatttatatgaaatacccagaataggcaaatctttagaaacaaaaggtagagtggttgttgcctaaagggtagggaggatggaaaattttgcaagtgatttgctgatgggtacagagtttcttgttggggtgataaaaatattctaaaattgattgtagtgagggttgcacaactctgaatatgctaagagccattgagttgtacactttgtgtgggtgaattgtatgtgaattatatctcattaaagctggaaaaataatcaatgga

SEQ ID NO: 635804 - DNA, 887 bp, Homo sapiens
taaggttggagggggaatgcgggaaatggtaaggggtttggaaacttgtcatataagtaaggctagggtgaggggtaggaagtttttccataggaggggtatgagtgggccgtagcggaatcgggggtatgctgtccgaattcataagaacggggaggttagaagtagggtctgggggacaaaatatgtggtgtagagtccaggggagagtgcgtcatatgtggtccctaggaagatggtaggggtgagggtgtcatataataaggtcgggtatccggctatgaagaatagggcgaaggggcctgcgggtatacgatgtgaagcctgagactagtcggactccccttcggacaaggtcgaagggggtccggagggtctcggcaaggggggagataaatcatataagggccagggtcatgagggcaggagtaacagaggtgtctggtgtgtgacaagggcgagaggtaaaggagccactaataagaaggtcgacagaaaagacggcagggcgacacatatgaaatagatgggacaactgcaccacaggggccgactaagggcaggtacaaggaagttggaatgctccacccctgaatccaaaaggtatggcagtaaccggactacgcacaaagggcgtctagaaaaaactggccggcctaggtgtacggacgcaccacggcgggctggacatccggaaggaggtcacacaaacacacccacagagctcaaacacaagtcgtgacgaggaacgaacagggagacgaaacagcgcgaggaacaagagcctggcaacgacaagccgcccaagagcgaaccccacaacaacaagcacagacaacacaactaaaaacaccccaccagcacactagcagatggacaacgccaca

SEQ ID NO: 635805 - DNA, 1457 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (1094)..(1094): n is a, c, g, or t
  misc_feature (1096)..(1096): n is a, c, g, or t
  misc_feature (1102)..(1104): n is a, c, g, or t
  misc_feature (1110)..(1111): n is a, c, g, or t
  misc_feature (1116)..(1116): n is a, c, g, or t
  misc_feature (1422)..(1422): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggcttctttttacagcttagttataatttaactctattgtggtttttttttcttaaacactctttacgccgtggatctattaatttgggttaatcgtatgaccgcggtggctggcacgagatttaccnangcctannnatagtnnccctnctctcaataggaggcctgcctccactatcaggatttatgccaaaatgaataattattcaagaaataacaaaaaatgaaagcatcatcatgccaacactcatagcaataacagcactgctaaacctctatttctacatacgactagcctactcctcctcactgactatgttcccatccaccaacaacataaaaataaaatgacaattcgaacacacaaaacaaataaaattacttcccacaataatggtattatcaacactagtcctacctataacaccagccctctcgtccctaaactaggaattnaggttaacacagaccaagagccgtcggctaattta

SEQ ID NO: 635806 - DNA, 395 bp, Homo sapiens
  misc_feature (41)..(42): n is a, c, g, or t
  misc_feature (45)..(46): n is a, c, g, or t
  misc_feature (51)..(51): n is a, c, g, or t
gttgtaacaagcgccggtcagtgaccatgcacgaacttctnnagnngagtntagaggatgcccccactttaatactgcttgtctggctggatgatccactttaatactgcttgtctggctggatgatccactttaatactgcttgtctggctggatgatccactttaatactgcttgtctggctggatgatccactttaaccattcccatctggcagtggttcttgacccggtttggcaagaagacagctgtatatgttgggatctcatcagcagtgccatttctcatcttggtggccctcatggagagtaacctcatcattacatatgcagcagccgcggtattacagctccaatagcgtatattaaagtggatcaaccagggccgagctgatt

SEQ ID NO: 635807 - DNA, 1536 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (1235)..(1235): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgctgaagatggcggtatataggctgaattggcaagggttggtaaggtctatcggggtttatcgattatagaacaggctcctctaggtggatgtgaagcaccgccaagtcctttgagttttaggcagttgcgagtagtactctggcgaatagttttgttatgtaactatttgggtttagggctaggcatagtggggtatctaatcccagtttgggtcctagctatcgtgtgtcaggattattagagtcactttcgtgggttattttattttaactagggcttctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635808 - DNA, 321 bp, Homo sapiens
  misc_feature (41)..(42): n is a, c, g, or t
  misc_feature (45)..(46): n is a, c, g, or t
  misc_feature (51)..(51): n is a, c, g, or t
  misc_feature (271)..(271): n is a, c, g, or t
  misc_feature (278)..(278): n is a, c, g, or t
  misc_feature (284)..(285): n is a, c, g, or t
gttgtaacaagcgccggtcagtgaccatgcacgaacttctnnagnngagtntagaggatgcccccactttaatactgcttgtctggctggatgatccactttaatactgcttgtctggctggatgatccactttaatactgcttgtctggctggatgatccactttaatactgcttgtctggctggatgatccatccagccagacaagcagtattaaagtggatcatccagccagacaagcagtattaaagtggatcatccagccagacancagtatntggatnntccagccactttaagtggtatccgggccggctcttt

SEQ ID NO: 635809 - DNA, 426 bp, Homo sapiens
aatgtggccgtgaatatgacaacatttaaacgagaagacaacagctcaaagatagagcctaaaaacttgccgaccaagcaagtaattacgctgaacccccttggccccgcttggatactctctaattagacgccctgggccctcccaattctgagtcttttaatatctgtgtttcctgtactgatattgggaccttaggtcttccgtttagttgctcaattcatccaaaaccgtatccaggccatcatcaatgattctatatgacaaatgctccttctaacaaccccacgagatcaccccttaccacaaaatcttgcttcagcttaatctctcccactctaggttcccacgccgccccaatcctgctaaaagcagccctgagaaacatcgcccattatctctccataccaccccccaaaatttttg

SEQ ID NO: 635810 - DNA, 1218 bp, Homo sapiens
  misc_feature (55)..(55): n is a, c, g, or t
  misc_feature (174)..(174): n is a, c, g, or t
  misc_feature (204)..(204): n is a, c, g, or t
  misc_feature (852)..(852): n is a, c, g, or t
tgttagtaggggtactctaggttgttagtgggtgaattctgttggtggtcagaanctcctaattcgggtgttggtgctaggcttgagtggtagaaagctcaaaagaatccagtgaagaacagaacctcggaaataataaataaaattataccgtatcgtaagcctttttggacnactgatgtgtggtggccttggaaagtgctntctcgaataatgtctcgtcaccattggtatattgtcaaagtattggttaatagtcctagagatagtaagagtatagagttaaagtggaatcatataattaggcctgatgttattaaaagggctgatagggctccggtaagtggtcatgggcttgggtttactatgtggtatgcatgtgtttggtgggtcattatgtattgtcgtgtaggtataagcttactagcagtgtaaacacataagcttggatcagagctactgcaaattcaagaatagttaataggatgaggatagtaaatgtgataagggtagtgtagataatgggattaattagtatgggaagggtatgaaccaacattttcggggtatgggcccgatagcttagcttagctgaccttactgtagaatgtggtgtattttggtagcacggagaattttgaattctcaggtttaggttcgagtcctattgttctagaaataagagggtttgaacctctattttttactctatcaaagtaactcttttatcagacatatttctatgattgtgggggaatgcttgctgttataatagggagtgagatgtgtcatatacatagagctagtgttaggggcaggaagctttttcatagtaaatgtattagttggtcntatcggaatcgtgggtatgatgctcggattcataggaaggtgattgttaatgcgagtgtttttagtacgaagttgattgtatatagttctgatgtgtgtgggtcgtggaatgctcctaggaagagaattgctgtgaatgcatttattatgatgatgttggcatattctgctatgaagaatatggcgaaaggtccggctgcatattctacgttaaagcctgatacaagttctgactctccttctgtaaggtcgaacggggctcggttgtttgatgccgattgtcactattatcaagcctagttggcttgtagttgagaaggctacgatttgtttgatatcattttgtgtgagtgcacatatgctgct

SEQ ID NO: 635811 - DNA, 294 bp, Homo sapiens
  misc_feature (41)..(42): n is a, c, g, or t
  misc_feature (45)..(46): n is a, c, g, or t
  misc_feature (51)..(51): n is a, c, g, or t
gttgtaacaagcgccggtcagtgaccatgcacgaacttctnnagnngagtntagaggatgcccccactttaatactgcttgtctggctggatgatccactttaatactgcttgtctggctggatgatccactttaatactgcttgtctggctggatgatccactttaatactgcttgtctggctggatgatccacgtacaatgctgcgcgttgtggctggactgatgccacgtcatgaatcgcctgttaccgcgtatacagagtcaccgggttttcctccagcaaggcaagcac

SEQ ID NO: 635812 - DNA, 1172 bp, Homo sapiens
  misc_feature (734)..(734): n is a, c, g, or t
  misc_feature (743)..(743): n is a, c, g, or t
  misc_feature (869)..(869): n is a, c, g, or t
  misc_feature (896)..(896): n is a, c, g, or t
ggcgagcgtgagtcagcgctgaaggcccagagcgcgctgcacgagcagaagactctgcccgggatgaaccggccgatccaggtgaagcctgcggacagcgagaccgaggagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggccaggccgccattcaacgcgctacacggcagccagaccatgccgggagcctcgtccagtctggtggtcaagtttcgccgacaccgacaaggagcgcacgatgcggcgaatgcagcagatggttggccagatgggcatgttcaaccccatggccatccctttcggagcgtatggcgcctatgctcaggcactgatgcagcagcaagcggccctgatggcatcggtcgcgcagggcggctacctgaatcccatggctgccttcgctgccgcccagatgcagcagatggcggccctcaacatgatatgggctggcagccgcacctatgaccccaacctcaggtggcagcacccctccaggcatcactgcaccagctgtgcctagcatcccatcccccatgtgggtgaacggcttcacgggcctccccctcaggccaatgggcagcgtgctgcggaacgtgtgtntgccaatgngcattcaccgtacgcagcacagagccccacggcagccgaccccgtgcagcaggcctacgctggagttgcagagtatcgaggacgtgcctagcctgctgcctatggtcagattagccaggcctttcntcagcgacggcgaatgattcccagcanagagagaagggccgtaggtgttatttttgcggcgcgtcgcgggagttgtggacgacgtggaagagctgcctgtggttggggttgaagatgagacgaaacgatctcgatagggttacattctgaggcgagggcggttgggtaagagttccgaatttggtgtgctgggcacgatggagacaggcgagaataacattctatatggaggggttaacaagagaaaggttgtgttatagagggggagtaaatgaaaaacatatggggagcctcttcttcctc

SEQ ID NO: 635813 - DNA, 729 bp, Homo sapiens
  misc_feature (428)..(428): n is a, c, g, or t
ccgagctggacccggaagagcggctggcgaatagttttgttatgtaactatttgggtttagggctaggcatagtggggtatctaatcccagtttgggtcctagctatcgtgtgtcaggattattagagtcactttcgtgggttattttattttaactagggcttctttttacagcttagttataatttaactctattgtggtttttttttcttaaacactctttacgccgtggatctattaatttgggttaatcgtatgaccgcggtggctggcacgagatttaccaactctaattaatataacttagtcaaactttcgttcatggcttaatttttatcactgctgtttcccgtgggggtgtggttgagcaaggcgttatgagctaccgttataggtgtgcttgatacctgctccttttgatctttangatctggagggcattctcaccggggcgcggatacttgcatgtgtaattttattaagaattaatagaaaggccaggaccaaacctgtgtgtttatggggctgtgaggctcatctaggcattttcagtgccttgctttgataatttaagctacattaactataagctatattcagattgtgggcgtatgcttaataggtgcttatattctgggaggttattgtgttgtaattctaaactaatcttgtgctaggtttgtcctccaaatctagggtgatacgtgtgtccgaagtacggcccaggt

SEQ ID NO: 635814 - DNA, 487 bp, Homo sapiens
aataatagtagttgaacataagaagtaactgttatgctttttttgagagtatttaattagataatacttttaacttctagcatggtgttgagaggaaaactttcttctgtcccaacttaggtgtgtgtgatgggagaggagaatgtgaatcaattgacaacagatagattaataggagaaaagttttaattcatatgcatgcaggaggcaggagcagtgagtaaccttgctgaatagccaaggataagcagtatacctagttaatgtcaggagttcgagaccagcctggccaacatggtgaaaacctgtctccactaaaaatacaaaaattagcaaggcatggtggtgcatgcctgtaatcctagctactcaggaggctgaggcaggagaattgcttgaacccaggaggaggaggttgcagtgagctgagattgcaccactgcactccagcctgctgggtgacagagtgagactccatctcaggaaa

SEQ ID NO: 635815 - DNA, 463 bp, Homo sapiens
  misc_feature (347)..(347): n is a, c, g, or t
ggctctaaagggggtagagggggtgctataaggtaaataccggccctatttcaaagatttttaggggaattaattctaagacgatgggcatgaaactgtggtttgctccacagatttcaaagcattgaccggagtataccccccgtcgtgtagcggtgaaaggggtttggtttaaacctcccggaattgcatttggttttaagcctaatgtggggacagctcatgagtgcaagacgtcttgggatgtaattattatacgaatgggggcttcaatcgggagtactactcgattgtaaccgcaaggagtcgcaggtcgcctgttctaggataaatggggaagtatgtangagttgaaaaatagtcccgcgtagtcggtgtactcgtaggttccagtcccattggggcccatttgatttgatggtaaggggagggaatcgtgaccttcgcctgttactcgttgccg

SEQ ID NO: 635816 - DNA, 463 bp, Homo sapiens
gtatcagactgatacttccaacattgccacttcaatatccatgcaatttgctacagataaatcactagtcagtagaaagaacaacacgaccatggtactttctacttctaggtacaaagtgtagataaggagccctctgtgtggtacctggtaagctgtgttaatatagcctgatcacagtatacgagttagctcgtggctttcaggatgtagttgtctcctgcttgagaagcttgactggagcagtttacagcctttgagcccaaatgtgttaaacacgcagaccttatgtgggcaagatttcccatacaacatacatacacatagacagacataaggacaatagagacacaaaaatagagagagacatgtgtgcgcggggcgcgcgcgatgcaaggcgcgcgcggcgcggcgagagacacgcccatgttctgcgataggcactcccctatagccgcgtcgg

SEQ ID NO: 635817 - DNA, 733 bp, Homo sapiens
tgcatggtacggggtggaggtacaggcagcaaagcaatatttaggatgctgacttgtggagcagtatcgggcttggaaggaaagctatatgctacccattcatgctcccctgtcagagactcaagctttgatgaaaggctagcaaagagcaaggtaaagagagaaaacaacaaagtgcgcgaggcccgtcagagtgaaagcgtacggttcaggtcagtctgctgcagctttgccatacctcaggctgggcagtctccagactcccctgaaggaagagccttcctcacccaaacccacaagaagatgctgaatcaagcctctctcagctgtgacctggctctgcattttcagtacgtggcctttgtcagccaccctagcgtggctgcagaagctctctaagcacaagacaccagtcgacagccgacaggctcaagagcaggccaactgctgtgcaggaggtgacaggagctcaaggcccaaggttgccaagcttagcagcctgctgaggtgaactgaacaagaagcaggagagggactgggtcagcgtggatcatgcaggtgatggagctggagagcaacagcaagcgcatggatgtcgcgggctcacgagatgctgcagagcaagtactccgagatgaacaaccaaattgacatcatgcatgctgcaggcagcacagacggtcactcagaactccgcagatgccatctacgaatgatcttccctctaccagaa

SEQ ID NO: 635818 - DNA, 266 bp, Homo sapiens
  misc_feature (212)..(212): n is a, c, g, or t
  misc_feature (245)..(245): n is a, c, g, or t
ggatattcagtttttgtaacacaatttgttgaagagactcccccattatattgaggcaggaaaatagagtctggaggcagaaaacataagaccacttcacacttcacctttccatagggcatgggccataaataactttgtaactttatttcatcctctccatttacatagggcatactagggggtatttaaactcccaaaaattctgtaantgggcctttgagcccctacgcttgggctttttnccacactgtggagtgtatttt

SEQ ID NO: 635819 - DNA, 777 bp, Homo sapiens
ggccactgtaacagagacaccagccttcctgtatagacactaaatgttagcaagagtgtgagctagttcctggtgaagtgtttccacagaagacatgtggagcagttgtggggatattaagggaaactttcctctgcctgaccccttgttaaataaaatgacttgggagccattcatgtacagttgcaggaatgagagtgatttcatgatgtggtacattgggaccatgttctaaaaccttgggtttctgagtctgcttttgagtaggtgatttgaggttgaaaaaccagggccttcatctaggaaatacagcattttccagaagcttctttgaaagggaatcctggtttgtttgccaaaatgaaagcccggggtgggctgaatcccacaactgtggtgattgcttgtgagttagtggtcctggtattgtggtgtttataccaataagaatgagcctgaatgtggggtttgaaatcctgacttggaggtaacctggaggaaggaacacatgtaatatgcaggttttaggactgagtagcttgaaaataagctattctaaggccttgtaatctttgttttttttaacagaagtaatttcaactagcctggattcggggaaacagatattggggcgaaagaaagatggggaagtcttggtaggaaaatgggcaatggaggggcacggatcgttcgtgagggaggacaggaggtacagcaagtattttacaaaaaaagggcgcgtaaagggaaaaggagcggtaggcatgtttgcgttcg

SEQ ID NO: 635820 - DNA, 724 bp, Homo sapiens
aggagttggagctgggtgcagtggcttgtgcctgtagtcccagctacttgggaggctgaggcaggagggttgcttgagactagcctaggtaacatagtgagaccctgtctcattaaaaaaaaaaaaaaaggcttggtggcacgcactgtagtcccagctactcaggagactgaggctagaagattcttttgaacctaggagttttgagaccagccgtgggcgatatagtgaggccccatctcaaaaaaaaaaaaaaagcgggtggggggggagttggggcttgtgttgggaattgggccttgagcccaacaaacaggggacctaggaccgacggtgatttcaccagctttgcttaggtcagaaattgagagacgggggggtctgtctaacctggttttcttctaacaagaatccctatattggactggtaaaagtagctaataactccactttgttctccaaatcccaggtagccatgggtagagttgggtgtaggagttgagcaggtggccccaggtatcccaattgggtgggtggtctgaatgggaaagaactaggcaccccaggaggccactgatctggccttataagcacagtcatctgaaagtcaaggcctggctggaggacagggatccccagaagacccaattgtgcttctcaaactcagaccttccagcttgtgtttttcaattacatctactttttaacaacaaccacaacagcg

SEQ ID NO: 635821 - DNA, 141 bp, Homo sapiens
caaatgtaggcaggttgagaacttggaagacagagggataagaaaaataagtggaactggaaaagcattagcaaaaacagaaaaatatgaacacaaaagtgaagtgaagacttacgatccttctggtaactccctaaacga

SEQ ID NO: 635822 - DNA, 248 bp, Homo sapiens
caggagttcaatgaccagcctagtgtacaacgtgggacctcgtctctaccatacaaaggaaaagaaaagaaaagttagccagcactggttgacacatgcctgtagtcccagctactcaggaggctgagacaggaggatcaactgagcctgggaggtcgaggctgctgtgagcaatgatcaggccactgtactccactatgggtgacgacagagtgagactctgtaccaggaacttatgtaccaggaaa

SEQ ID NO: 635823 - DNA, 100 bp, Homo sapiens
catcttttacagaacttatgagttacttatatcatccgtgttatgataccattaatagaattacactttacagtgaatctttggcaagatatggcacaag

SEQ ID NO: 635824 - DNA, 112 bp, Homo sapiens
atcctccaagtgaacaccacagactctagatctcgttagagcattacaagatctggaaaatgcagcctcaggtgatgcagcacgcccctgagctgcagctcgcccctgagtt

SEQ ID NO: 635825 - DNA, 147 bp, Homo sapiens
aaagggggggggggggggggcccccccctttttttcccctttttttttaacccccctttggggggggttttttttccccttttggggcccccgggtttttcccccccccctgtttttttccgggggttttacccttttccccaagga

SEQ ID NO: 635826 - DNA, 682 bp, Homo sapiens
attgtcgcccttcttgctgacgttacttatgaattcttcaatctttgagccacgtcgctatttctattaccaatgtatgatccaggaactcttaatctaccggtggtgcagacctaacctgtcgttgccatgtttctgggacttacgctctaggtaagccttgttagtcacatgtacagagtacttatagagaaggggttcaataggtgcgagttaaccttgtattttttcgtgcttcataactcttctccttctattgtgtgttttccgtcactccctctccctccaccacattgtgttggtcaaatgatactatgtcgtatgaaaccctgagctatagttgtcacaagtaactatggattgtgaattagtcctctgtgggtgcttccttccctcttttttctcccgtcactcttctttctcagtctccactctggtaaatggaaaagttgatgtcgaagaattgatgcttgcttggactcatgttgtatcatgtgaatacgcgattagctgtctcctttttccttcttatatgggtagaattcttatgacttagtgtagttcccttcttgatttgtaggttatagactggagactatgtggtgactgttttatagtttctagagtgactagtataaagcctcaaagttaattcgttatgtgttttaattctcacatagtg

SEQ ID NO: 635827 - DNA, 480 bp, Homo sapiens
  misc_feature (423)..(423): n is a, c, g, or t
  misc_feature (432)..(432): n is a, c, g, or t
  misc_feature (453)..(453): n is a, c, g, or t
attttactattctaagtattccaaataagttgactcatacagtgtttattcttttatgtctggcttatttcacttagcgtaatgttttcaaggttcattcgtgttgtagcgtgtatccaaatttcatttatttttaaggctgaataatatcccattgtacgtacataacacattttctttatccattcatttgttgatggacatttaagttgcttccacctttggctattgtgaatagtgctgctataaacatgaatgtacacatctgtgtccctgctttcatttctttggggtatatacccggaagtagaaatgctggatcatatggtagttctgtgtttagctttttgaggaactgccatactgttttccacagcggcagtatatcctgtcaaattttaagtgtcaagggtccagctcccnttactaccncctccaagacattttttcaantccccttctaggtaggaggaggacttc

SEQ ID NO: 635828 - DNA, 202 bp, Homo sapiens
tggtccagcgctcagtcgggctcccttgactgaagtgcctcaataccagctaccagtcccagctcatcaaacccagccgcatgcgcagattaccccaatgcggcccagcaagactgcccccccgcacgaacgctcttgcgcttgcccagtggagtcctgtgatcgccgctactcccgctccgacgagctcacccgaccatac

SEQ ID NO: 635829 - DNA, 411 bp, Homo sapiens
  misc_feature (148)..(148): n is a, c, g, or t
  misc_feature (181)..(181): n is a, c, g, or t
accgcatctcacagccgtatgtgaactggagggtgtgaagggcctagaagccccggggacaggcaatgtcagtgacccccacagatgtatttcccaaggcctctccaatcatggtccctgctgcccttagcactgctccccgattccnttgggttctccttagaggacggctgttcacacntctagataacctaggctggctttccactgataccttggaagtgctgtgagctctgacagggagctagaactcgggctttgctgtgtcacaggctcttcaccctctgtggctctgttcctcttgcacacaagtcacaagcccagagcatgaccacaggactcctgtgcaagcagtccctggagtccaggagtaacctcccaggagcagagcacagcgcaggagcatggtgg

SEQ ID NO: 635830 - DNA, 136 bp, Homo sapiens
  misc_feature (34)..(34): n is a, c, g, or t
  misc_feature (130)..(130): n is a, c, g, or t
agaggtggagcagctacgtcgacaggtgcgtgantcagatgaggctggacatccgtcactgctgtcccctccagcagagcccccatggactatgaggatgattttacatgtttgaaggagtcagatagcngtgata

SEQ ID NO: 635831 - DNA, 314 bp, Homo sapiens
tctggtactgaacgctttcagccacggcagcagcaatgccggcggcaccttcttgagccattacgcggttcaccacacttcttcctttagaggtgacgcggagcgtcacagggtgcattcccatgcggagcgtgggaacgatcaatgacgagcaccacttgaacaggccacataaaaaagccgccttataaaaggcggcttcggatttcgctacggttacgcttgcggccgcatgtgcgggaacaggatcacgtcgcggatcgacggcgagttgggcaacaacatcaccagacggtcaatgccgataccttcac

SEQ ID NO: 635832 - DNA, 1334 bp, Homo sapiens
taaaacaattttttttttggtttcccgtccaacaatttttttattgaactttttaaattaaaaaaaaattctttacaaattataaaatttttttttcaaattaacaattagtgtgaaaaattgtgggggcacattgaagttctccttttttttggaaagtggagttcttcgcttctgtgttgtgcccagggcgtggaatgtgtcaggtggcgaccattcttcggcttcactgtggaacctctctcaccttctccgaggtttcaaggccatttcttctctgtgtccttcgagcctctctccagagcagctgtgggaattatcaggctattgttgtccacccagcccctgtggctttatttattatatttatttttattgtgtgtattttctataagtgtcagaaatatatatttcaccatgtgttgtggccccaggcggtggttcttgtagaactctccttcacctctccaggtgtgattctgtgcccccaccctctctgcgcgctctctgcaaaacgtgtgctcgtggcgatttctaccgcgcgctaattgtacgcccaaccacacaactgtgtggcgctttaaagatcttcctctattatattaggcaggaaacaccaatttacacacttatgtgtgcacacaatcttcccttctgaacaggaacactttttctaatctacattctacagagacgccctttttttctcccagggggcattacattatcccaacccggggggaaacaaccctgttgtttaccccttatttttcgcggttacaccaccactttggggacaccttctacccctgcgttccttttctttccccttggctttacaacttcttctttttcacttctttcgcgtctttccttctgtgcaaacaacaacagcactttgaacaaatttatatgtcctttctatttttttccacgaaattctcaaattccattttccccacaccctgccctctcacaatagccaaatggggcccttattggcctcccttggggacaaaaaacgaccgccgcctcacggagacgtccctaaacactcacgagggggacacccccaaccacacccccagagatctttttcggcatctgtgaacccgtgatgttaactgcaccccctgcacagtagtcctctcttcgtcggtattacaccccacgtttttcttttttccacccaagtctcctctatgccagtgttggcgccgcctgataaacaagggtcctccgtacacggtgtatctatacgctactggccgcccctatcgttttttctaacaccgcactcagagggctgcctgtgttctttctccaacaagatt

SEQ ID NO: 635833 - DNA, 533 bp, Homo sapiens
  misc_feature (310)..(310): n is a, c, g, or t
  misc_feature (345)..(345): n is a, c, g, or t
  misc_feature (437)..(437): n is a, c, g, or t
  misc_feature (440)..(440): n is a, c, g, or t
  misc_feature (457)..(458): n is a, c, g, or t
  misc_feature (467)..(467): n is a, c, g, or t
  misc_feature (470)..(470): n is a, c, g, or t
  misc_feature (473)..(473): n is a, c, g, or t
  misc_feature (480)..(480): n is a, c, g, or t
  misc_feature (484)..(484): n is a, c, g, or t
  misc_feature (489)..(489): n is a, c, g, or t
  misc_feature (499)..(499): n is a, c, g, or t
  misc_feature (525)..(526): n is a, c, g, or t
  misc_feature (532)..(532): n is a, c, g, or t
ccaagctggtttcaaactcctgacctcaaatggtccacccaccttggcctcccaaagtgcagggattacaggcatgagccaccatgcctggctttacaccaatgtcatagcaggcaaaaggtagaagcaacccagatgtccatcgccatatgaatggataaacaaaatgtggtctatacatacaatgggatattattcagccttaaaaagggaggacattctgtcacatactgcgacatggataaaccgtggtgaagacattacactaagtgaagttaaggcagacacagaaggacaaatacaggtgttntatgactccacttatctgaagttatctaaaaatantccaattcctagaaactgtattacttcctgtttgctattaaaaaaatacctgaaacttggtaatttataaaaaaaaaagtttatttggctcncantccgcaggtgttcaacnntttgaagcnggntcngcctccnggtnaaacnccaaaacttncatcctggttaaaggcaaaagaaccnnctttanc

SEQ ID NO: 635834 - DNA, 386 bp, Homo sapiens
gtctttccttcggtgaaaatcctatcaatggctggggcggtggtcacacctgtatcccagcactttgggagaccgaggcaggtggatcacctgaggtcaggagttcgagaccagcctggccaacgtggtgaaaccctgtctctactaaaaatacaaaaattagctgggcgtgatggtgtgcacctgtaatcccagctactcaggaggctgagacaggacacttgcttgaacccgggagctgccgattgcaatgagccaagattgtgccactgtattccaacttgggtgacagagcaggaactctgtctcaaaaacagcaccgaccataatatccagcaaatcgaaatatcacccacgtcaggcaagagaccgggaggaaccgggct

SEQ ID NO: 635835 - DNA, 869 bp, Homo sapiens
  misc_feature (816)..(816): n is a, c, g, or t
  misc_feature (825)..(825): n is a, c, g, or t
  misc_feature (847)..(847): n is a, c, g, or t
  misc_feature (862)..(862): n is a, c, g, or t
gatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagtttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgagcagggctgaaaacttgcctttgggtggactttttgatanggccatgcnttggccactttacaagttcctntttggaatttacttngtattta

SEQ ID NO: 635836 - DNA, 979 bp, Homo sapiens
  misc_feature (157)..(157): n is a, c, g, or t
  misc_feature (159)..(160): n is a, c, g, or t
  misc_feature (169)..(169): n is a, c, g, or t
  misc_feature (174)..(174): n is a, c, g, or t
  misc_feature (235)..(235): n is a, c, g, or t
  misc_feature (609)..(609): n is a, c, g, or t
aggatcttatttactggcatttggagggatgggaggtaggggtggggcttacttgtagtagcttttttttttttaacagacttcacagagaaatgcagttgtcttgacttcaggtctgtctgtcctgtgggcaagtaaatgcagtactgttctgatncnnctgctatanaatgnttgtgaaacgactggagtatattaaaagttgtgttccccaatgcttggagtagtgattgtngaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggaccaganaagccagacccagtaagaaaaaatagcctatttactttaaataaaccaaacattccattttaaatgtggggattgggaaccactagttctttcagatggtattcttcagactatagaaggagcttccagttgaattcgccagtggacaatatgaggataccaggtgcacaagttttttcggtattcataatcagagtcagaccagttatgggcccatagtatagaatagatttcacctttatgctggagtaattggcatgtaatcaatttgtgttcctctcggggtccaggcatgagggggcctgttagcctctcttttaacatttttctgggtacccctcaagaaaggcgcggaagggtgaaagtaggt

SEQ ID NO: 635837 - DNA, 361 bp, Homo sapiens
gatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaagattacgcgtagttactgtcaggacattaagctcgctaagaatttagtggcttt

SEQ ID NO: 635838 - DNA, 332 bp, Homo sapiens
  misc_feature (305)..(305): n is a, c, g, or t
  misc_feature (330)..(330): n is a, c, g, or t
gttcaagcaattctgccgcagcctccggagcagctgggactacaggcatgtgcaccacgcccgactggtttttgcattatttgtggagacgggggtttcaccatgttggccagactggtctcgatctcctgacctcgtgatccgccagccttggcctcccagagtgctgggattgcaggtgtgaaccactgcggcccggcggaacttctctttcctcacttctctctctggggtcccagcttctgggaagggacaccctggccttggccttcacccccagacagggggcaggaacaacccaaatnggggaatttgaggcaagggattttncc

SEQ ID NO: 635839 - DNA, 803 bp, Homo sapiens
  misc_feature (733)..(733): n is a, c, g, or t
  misc_feature (736)..(736): n is a, c, g, or t
  misc_feature (777)..(778): n is a, c, g, or t
gcatgaatcatcagcaaactggtggcgatgggcgggctgagttatgtcggcgggtatgtgtcggcggcagcgttgctcagcttgattgctgtgctgtgcctgaaagagacgcgggataatgatttgaacaaggtcgcctgatagaccgccttcgcgagcaagcccgctcccacacttgaccgagttccagcatgagaatgcggtcaagtgtgggagcgggcttgctcgcgaagggcgcgactcgattacagctctactacaacagccttggaagcacgggtcgctttagcccgagccgcttcaatcgactcatcccgcgccaacgccacgcccatccgacgctgaccattcatacaagtccttatttggagaacaagtgattatgctacctttgcacggtcagaataccgcggccgttaaactggtgtcactgggcaggcattgcctctaatactagtaatgtaatactagtaatgctagaggtgatgtttttggtaaacaggcggggtttgtgtttgccgagttccttttacttcttttaatctttccttggtgcactcctgtgttgggttaacaatgtaattaataaacgttttagtgttgttttggtttattggttgttaattatcagtatattattagttactgatgtaagcgtgtgcgaggagaaaggcttcttgttactcatattaacattattgcttctatgtttcaatagattagtccggtattnggnctaggagtttgttattagtttttgggagtattgtgtgatanntgatagtggggaatcctctagacgt

SEQ ID NO: 635840 - DNA, 903 bp, Homo sapiens
  misc_feature (157)..(157): n is a, c, g, or t
  misc_feature (159)..(160): n is a, c, g, or t
  misc_feature (169)..(169): n is a, c, g, or t
  misc_feature (174)..(174): n is a, c, g, or t
  misc_feature (235)..(235): n is a, c, g, or t
  misc_feature (609)..(609): n is a, c, g, or t
aggatcttatttactggcatttggagggatgggaggtaggggtggggcttacttgtagtagcttttttttttttaacagacttcacagagaaatgcagttgtcttgacttcaggtctgtctgtcctgtgggcaagtaaatgcagtactgttctgatncnnctgctatanaatgnttgtgaaacgactggagtatattaaaagttgtgttccccaatgcttggagtagtgattgtngaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggaccaganaagccagacccagtaagaaaaaatagcctatttactttaaataaaccaaacattccattttaaatgtggggattgggaaccactagttctttcagatggtattcttcagactatagaaggagcttcccgccaaaggtcaccccaggcccgactgaggaaaacagcgcgaacaagcctcgtctgaatgcacacacaaagactagatcaggtatactgggacaatagtatcgaatagatttcagctatagctggagtagaggtcagggatcctcagcgtcgacctgacagaatgca

SEQ ID NO: 635841 - DNA, 905 bp, Homo sapiens
gggcgcttcaaggatgcgctgtctgaaccgtgcctatgctgctgcgggccctggtcccaggctgcacgtgcagagacctcctggtggccggagcctccatcagcatggttgcacgtggcagcccatctacaatgtatgtgaacatgctgggatcccgagatggacatgaaggtcagtgactgaccgggctagcccgcagccctgctgtggatctggagctcttccgaggcctgggcatgaccctgagctacctgttccgtggataccgggcagccatcttagggctatcccgttccgagaaggggcccgctgagccctcgcttccgtggggagcatgcgctgctccggtacccatccggggaggagcgttgcattgtctgctagctctgcgaggccatctggcccgcccagtgccatcaccatctgagtgctgagccaagagctgtatggcaagccgcgtgatcacccgtctatgagcatcgaacatgaccaagtgcactctactgcggcttctgcaggaggcctgtcccgtggatgccatcgtcgagggccccaattttgagttctccacggagacccatgaggagctgctgtacaacaggagaagttgctcaacacacggggaccagtggggagggccgagatcgtcgcaacattcaggctgacttacttgtatcgggtgacgccctgcgggccgtagccctgctgaccagtagaccattcgacccatcttgctgagatgggcttccgcggttggccgcttttttttggctgcccgcggccccttctctaagacccggggtgggggggtctctgcccgtttggctttgggcggccggcccggcgtccccgggaggcttgtgcgccatgccctcgtgcccggtccctccctttcccggggcggc

SEQ ID NO: 635842 - DNA, 421 bp, Homo sapiens
  misc_feature (58)..(58): n is a, c, g, or t
  misc_feature (60)..(60): n is a, c, g, or t
  misc_feature (66)..(68): n is a, c, g, or t
  misc_feature (74)..(75): n is a, c, g, or t
  misc_feature (80)..(80): n is a, c, g, or t
  misc_feature (386)..(386): n is a, c, g, or t
tagcgacgcaccacaactgtatgtctatccatacatgaaacaaaatacccgtcatcanangcctannnatagtnnccctnctctcaataggaggcctgcctccactatcaggatttatgccaaaatgaataattattcaagaaataacaaaaaatgaaagcatcatcatgccaacactcatagcaataacagcactgctaaacctctatttctacatacgactagcctactcctcctcactgactatgttcccatccaccaacaacataaaaataaaatgacaattcgaacacacaaaacaaataaaattacttcccacaataatggtattatcaacactagtcctacctataacaccagccctctcgtccctaaactaggaattnaggttaacacagaccaagagccgtcggctaattta

SEQ ID NO: 635843 - DNA, 539 bp, Homo sapiens
  misc_feature (22)..(22): n is a, c, g, or t
  misc_feature (101)..(101): n is a, c, g, or t
  misc_feature (104)..(105): n is a, c, g, or t
  misc_feature (107)..(107): n is a, c, g, or t
  misc_feature (117)..(117): n is a, c, g, or t
  misc_feature (128)..(128): n is a, c, g, or t
  misc_feature (137)..(137): n is a, c, g, or t
  misc_feature (140)..(140): n is a, c, g, or t
  misc_feature (154)..(155): n is a, c, g, or t
  misc_feature (161)..(161): n is a, c, g, or t
  misc_feature (165)..(165): n is a, c, g, or t
  misc_feature (169)..(169): n is a, c, g, or t
aggacggcgcttgaggaccccnggatgatccctttaatactgcttgtctgatccactttaatactgcttgtctggctggatgatccactttaatactgctngtnngnctggatgatncacttttatantgcttgtcnggntggatgatccactnnaatacngctngtcnggctggatgatccactttaatactgcttgtctggctggatgatccactttaatactgcttgtctggctggatgatccactttaatactgcttgtctggctggatgatccactttaaataaaccaaacattccattttaaatgtggggattgggaaccactagttctttcagatggtattcttcagactatagaaggagcttcccgccaaaggtcaccccaggcccgactgaggaaaacagcgcgaacaagcctcgtctgaatgcacacacaaagactagatcaggtatactgggacaatagtatcgaatagatttcagctatagctggagtagaggtcagggatcctcagcgtcgacctgacagaatgca

SEQ ID NO: 635844 - DNA, 215 bp, Homo sapiens
tattcatatattcctgtcccaagccacactgaaaacagaggctgagacatgtactcctggtgtgatctcttgtcctcagtgtctcttactgggctcctgtccctcttgctttatagctagctagccggagaccaaggtactgtgtgcagccaggtagcagcttgcgggatgaggcctgtctggcttaccagtctatacacttgatggctcaacct

SEQ ID NO: 635845 - DNA, 738 bp, Homo sapiens
tgtatctgtctactttctcttgtttaaaaaaagaagaaaaaattaaacaaaatggggttatacgaatggtcagcaaagggtgggttcgagatgtcggaggtgggtaaaggtgggcatttgtgaccaaccagtggttctcctttgtggcatgtttacactgtgtgaatatttggacaagacatcctttgcaagttttaaagaatgaacactttttaaaaattaaaatttccttcttcccttaaaattgaattgacctttggaagcccctggggccaacttccaatgttgcggacgaaatcaaggcaaggaaaaccccttggtaaaggggacaactcccttttaaatctcgcggcgacacattcggcccaaatttgcgttcctaaattgtggtacaaacttttcgtggattccccgtggtcaaaactgtttgtcacaaaacacactttttccttgcgcccattgtactaacaccggggagtaatctacaccacaccttgtgtggtcggaaacaaacaggggtcgaccacaacagcgacgttgcaagttggccccttcccaaaaggattttttataaaaaaaccgcggcttttcaccacaaccacgggcgtttgggtttcaccccaaaaagcgttctgtggcgccatcacataggagggatcgttcacaccccacaattttcaaacaacagatctgttaacaaaacacttgggtgtggcgtataaccacccacaaaacacg

SEQ ID NO: 635846 - DNA, 578 bp, Homo sapiens
  misc_feature (508)..(508): n is a, c, g, or t
  misc_feature (511)..(511): n is a, c, g, or t
  misc_feature (552)..(553): n is a, c, g, or t
tcagccgtccctctctgctcatggtcatctcctcttacatgaactatggactggtctgggctggttctctttttctgattaatgaagctggggtggagcatgaaaaaaccctctgggcaattgctcccattatttcaggatttctgaacaagtgattatgctacctttgcacggtcagaataccgcggccgttaaactggtgtcactgggcaggcattgcctctaatactagtaatgtaatactagtaatgctagaggtgatgtttttggtaaacaggcggggtttgtgtttgccgagttccttttacttcttttaatctttccttggtgcactcctgtgttgggttaacaatgtaattaataaacgttttagtgttgttttggtttattggttgttaattatcagtatattattagttactgatgtaagcgtgtgcgaggagaaaggcttcttgttactcatattaacattattgcttctatgtttcaatagattagtccggtattnggnctaggagtttgttattagtttttgggagtattgtgtgatanntgatagtggggaatcctctagacgt

SEQ ID NO: 635847 - DNA, 451 bp, Homo sapiens
acctatcacttaaactgctgtctgctggatgaccactttaatactgcttgtctggctggaagaggtagcctgcacacatctggttgcatccttggagtattaaagtggatcatggctggatgatccactttaatactgcttgtctggctggatgatccactttaatactgcttgtctggctggatgatccactttaaataaaccaaacattccattttaaatgtggggattgggaaccactagttctttcagatggtattcttcagactatagaaggagcttcccgccaaaggtcaccccaggcccgactgaggaaaacagcgcgaacaagcctcgtctgaatgcacacacaaagactagatcaggtatactgggacaatagtatcgaatagatttcagctatagctggagtagaggtcagggatcctcagcgtcgacctgacagaatgca

SEQ ID NO: 635848 - DNA, 421 bp, Homo sapiens
  misc_feature (76)..(76): n is a, c, g, or t
  misc_feature (412)..(412): n is a, c, g, or t
cacttaaaaaaatgtaagctcccaaagctgggccttgggtggaaagcgtgcttgtaagcccccaagccacctaagnaggctgaggcaagtagggatccctgaagcccccagaagtccaaggataataagtacattaatgattgtgtctgtgaaatagccactgtactcccagcctgggtaacatagtgagaaccttcctcttgaaaaaaataaaaattagttccattgtttgctggccttcgttactacttatgagatgtcaagcatcttttatatcattttcccctagtatataaagtttaactttgagccggcgtggtactcacgcctgtaatcccagcactttgcgtggctgaggcgggtaggtcacttgaggccaggagttccaggccagcctggtcaacatggtganaccctgtct

SEQ ID NO: 635849 - DNA, 387 bp, Homo sapiens
  misc_feature (22)..(22): n is a, c, g, or t
aggacggcgcttgaggaccccnggatgatccctttaatactgcttgtctggctggatgatccactttaatactgcttgtctggctggatgatccactttaatactgcttgtctggctggatgatccactttaaataaaccaaacattccattttaaatgtggggattgggaaccactagttctttcagatggtattcttcagactatagaaggagcttcccgccaaaggtcaccccaggcccgactgaggaaaacagcgcgaacaagcctcgtctgaatgcacacacaaagactagatcaggtatactgggacaatagtatcgaatagatttcagctatagctggagtagaggtcagggatcctcagcgtcgacctgacagaatgca

SEQ ID NO: 635850 - DNA, 394 bp, Homo sapiens
cagctcttcttctaaattcattaaagaaagtgggggaaagaaatggggaaaacaacaatgatatgccattttacaccatcaaatcagcaaaatgtaaaattctaacagtgctgtgcagtgatgagcatgcgaagaaatgaaaactcgtatgtggctaagaggagtgtggattgatgtgggcattttggcatgcaattcagaaataatcaatgaaattgaagatgtttgtgctctatgacccagaaatcccacttctagagatattctcaaatgtgtgtacagagacacatagaagcatgttcattgcagcaccatttgtaatactggaaaattggaaataaccagaatgcacatcaaccagaaaatggataaataaaatgtggcttatcaaata

SEQ ID NO: 635851 - DNA, 125 bp, Homo sapiens
tgatctagaggacccccatatcaatccaccccggcggggcccctcggaaaacagacctaagtggaaatttctttgagaaacctcgaggttctacgtcagacgcgtatgcacttgacatccttccc

SEQ ID NO: 635852 - DNA, 189 bp, Homo sapiens
gaagaccttagaaaaaggaggaaaggaggagaggcagataatttggatgaattcctcaaagaatttgaaaatccagaggttcctaggaggaggaccagcaacaacaggcattcagcaggcgttgatgtttatcggattgaggccccattattgaaggagcccaggcgcgcttccgagagttcaggttat

SEQ ID NO: 635853 - DNA, 123 bp, Homo sapiens
tcccgtgtgttccctttgtctggggtaattcgatacaaaatgatacttttttgaatcctgaatccataaattacactttttttttccacttcaccaaattccacatggttcttgacttgtttt

SEQ ID NO: 635854 - DNA, 220 bp, Homo sapiens
gcatatggcacggcaagtgttctcatgtttagtttccacctatgagtgagaacatgcagtgtttggttttctgtccttgtgatagtttactcagatatgatggtttccagcttcatccatgtccctacaaaggacatgaactcatcctttttatggctgtatagtattcgatggtgtacatgtgcccccttggccttgccatatgcaagggtaccgagca

SEQ ID NO: 635855 - DNA, 100 bp, Homo sapiens
ctctcatattcagcttgtgccggactggctggcagctcggtcatgtactcgcgtgtggcccggccgttgccctcgcggaatgggtgcatttcgttcacca

SEQ ID NO: 635856 - DNA, 714 bp, Homo sapiens
  misc_feature (474)..(474): n is a, c, g, or t
  misc_feature (599)..(599): n is a, c, g, or t
ccctttgatccatatgtgctgtgggctccgcttaaatcagcaagaatgagaaatgagatggagtaaccttcgcacgatcaacgcctctctttaatgattgatggatactatgcctctactggtaatcaattcggcaccctgcttcactgtatagcgctttacatgcttattattgatggaagagcatattcaacagatccttcatttggatcgtgatatctagaattgtagtgatgttataacctaattggggaatacatatctctctggggtttaatataaaagagaataccatgctgcgtctgttatagcggcgcaccttacatactatttgtattgtccctggtgacccccgactaatgtctcttttattctaaggcaccctctacataactgcctataactattttgttggggcctacaatacagcttgcctggccccttgccccctaactggattcgggccaaacacanaacacggcttttaacgcgtgggggcccgggagcgcccggcctctataaactcgttcctccttgcgcacccgccctttatccaaactccctaaccaaatacagccgaaaggttatatttcataaanttgtcaaaattaaaaggcttggaaaggtaacacccttaaatacccaatattcggatggattaattcccctcttccttttagaaactgggccgaaccccgccaggccctcttttac

SEQ ID NO: 635857 - DNA, 771 bp, Homo sapiens
gcaccagcaccagccccagccccagctccctccggccgcagaaccagcatcgggtgttcactgtcgagctctcgatgctgatttgacataatgtgccttacgctgcctcgctgggggcagctggcctccgcctccgcccacgcaccagcagccgcctccatgccctaggttgggcccctgggggaatctgagggctctgtggcctcctcagggcaatgttcccatgatcctatgtctgtctgtacatcgctacgagtatgggaggaggagaaaaagcggtacgatgccgttcgcatgacactcaccggcactccctcaaggggtgccggcgactctgggtggtactcacaggtcatgctgggcccctaccgtcataacatggtcaacgtgagactgtaaggtcaatgtcctatcgtactggtggcccgagactaatctctgtgggtcctggatctgtcagacaggctgccctatagccccaaccagtacggggggactgggagcagttccaagaccaactgcaaaccctttatggtgaatgcttgttccttggttagtcagatacgtgcgtcttgtctcgagtctggcgtacaaaatgcttatatcattactctaaagtgatttgaggggcagcgatagcccactttataacatattggaaacaacttgtgttggacagccgggccccaaagaggatgctgacagaggggaagcagaacctcagaagatcccggggcagagcggctgcgaggaaacctcgccctatatacg

SEQ ID NO: 635858 - DNA, 169 bp, Homo sapiens
  misc_feature (70)..(70): n is a, c, g, or t
  misc_feature (157)..(157): n is a, c, g, or t
tgtcacctcttggcttcatggctatgctgcattaagagatggctaccattgaccctctgcattgccttgncttctggtgcctccctctcctgcaagtggccctttttagtcagatccttaaagctatttcaacatttctccacccgtatccccccancacccttccacc

SEQ ID NO: 635859 - DNA, 555 bp, Homo sapiens
ctgcaagagagcctcagaaaaccatcacgttgctctcatctggaggatcatgggatacctattctgtctgaggactacagtatctccttctggttccaagatgctcagctcaaggatcacatgttggctgtgccgctgttgaatcgcaggtcatccttttgaaatccttacgggtctatctatacagctcgcagaggaacagacaacaatgaaaggaaagagttaggaacctgggctccaaatgggacagaatcttctctgtgctagcaagggtaccttagaaatcaggatctttgcttctcaaatgccagtgtggttcctgatttctctgagactactaggaagctcctccccaaattctccaatgaaaacgaatactgctttattagaatttggccaaagtgtgagtccctccttgtctgcaggaagactggagcagagtgtgacaggattgtgacatcaagaacaatgacagtggagggaccaggccaggtgtttgagatccattgcgatttgattggtctggctgagaaagagagagagagagagagagtg

SEQ ID NO: 635860 - DNA, 112 bp, Homo sapiens
gtgggtctgtgacattctgcagctagtccactactccgaggtaactatcgacttggtttcagtagaatctattttgttattaactacctgtgatttattcagctcagtagtc

SEQ ID NO: 635861 - DNA, 80 bp, Homo sapiens
cgtcgacgtcaaaaattgccaatgccgactatatttcaagtcgtcatggcggggtattgggaaaagttttcaattagcag

SEQ ID NO: 635862 - DNA, 397 bp, Homo sapiens
actgtgttatccttcaatgtactgcctgatctcagcggaacccacattcctctattaccatctcctgataatttttcatgtaccaccttatcatactcatccaggtacagcatggagatggcactcagttcattgggcacactacaggctttggggatactgtaattgacagaattgacctgggtctgcacaatggcatggttggttgagttgaggtgctcagtcagtgtcatggtgcattccccatggctagtataaggcctggtagcctggtggggccacaatccagtcattccagcccacatcgctgaagtccacatagagcgagtggcgccggcagttcttattcttcttcctggcccgctgtgagtggataacacgttcgcgaggggtaccg

SEQ ID NO: 635863 - DNA, 100 bp, Homo sapiens
acgacagtgggtccagctccctgatggggcgacaccactcaccagtttgcagcttccacttaaaattaacaactgctggctgagcgccgtcgcctacgca

SEQ ID NO: 635864 - DNA, 103 bp, Homo sapiens
gatcagcggaccttcatttcacgttcatttcatctcatcattttatctcaatctcacgtatcatcatttcatcagtttcttttcattgtcatctcatttcagt

SEQ ID NO: 635865 - DNA, 986 bp, Homo sapiens
cgcgaactcgcttggtgccctggctgtgtgctgcccctgcccatgcccatgtctccaatgtattgctcagatagactgtggcatgaatgctggcagccaaggcgcatctacgagatcctcccccagcgcatccagcagtggcagcagatcccttgcattgctaaagagcacggaagaagctgctcgaacgcttcccgagagcccagagtgcccgcactcgccttccggatatggaacgcacgataaccatgagcttgaggccatcattctacgtgccaaggcagcaggctgtgcgcgaggatgagtgatgatgcaacagagggtgacccgtgatgacacagacctgcagatcttctgtgttgcctgtgggcaccccatcaacccacgtgtagccttgcgccacatggatgcgctgctacgccaagtatgatgagccggacgtcctttgggtccatgtaccccacacgcattgaaggggccacacgatcttctgtgatgtgtatcatcctcagagcaaaacatactgtaagcggctccaggtgctgtgccccgagcactcacgggacccaaagtggcagtctgacgaggatccgggtgggccccccttttcctgaatgcttgactcccgggtgaattctgccgctgcccagccatgccatcgcattactgcttgggaaactggggtgcggaagttgacttggagcgcgtcgtgtgtgtaacagcttggaccaggctgttgagccatggcgcaaagttggcacaggcatgaccaaaccggcggaattgtggccctgatgttgaccaagaatcaggaattccctcctaacagcttggccaggccgacgtagctctgcgagccttaacctgtcaagggggcgcgcgccgttggccccccttttcggtctgcacccggggcgctttaagggcccatatcgggggggaccccccctttattaccaaaagggcttgcctcgtaccgggccaca

SEQ ID NO: 635866 - DNA, 172 bp, Homo sapiens
aattagacatccgttatgcggggttcctccggctcctctttaaaacaggccgtagtagacgatgagagtatcgatgacgcgggctgatggggataatccaccaggaggagagggacacggtggcctcgtgtgggcctgtggccgaagcagcgtgggcccgaacacgatgccc

SEQ ID NO: 635867 - DNA, 363 bp, Homo sapiens
gttgacaggttggcattttcctgtatttgggaaatgaatcataatgctgaaatattaaaaacgagatttaccaaaagtgtcattaattcaaaggcttctcttacgtacgcggaagcacagatgagaattgattcggcggctatgaatgatgatattaccactagtctccgtggactcaatcagctggctaaaattctaaaaaagggaaggattgaaaagggggctttgactctgtcttctccagagatccgattccacatggacagtgaaacccacgacccaatcgacctgcagacgaaagagctgagagaaacaaattccatggtggaagaatttatgttacttgctaatatttctgtcgca

SEQ ID NO: 635868 - DNA, 494 bp, Homo sapiens
  misc_feature (460)..(460): n is a, c, g, or t
  misc_feature (463)..(463): n is a, c, g, or t
  misc_feature (486)..(486): n is a, c, g, or t
gtaacaacaggtaacacatagtaagtactatgttccaagttatgttctaatagctttacagacataacttcatttaattctcccaacaaccaataactggaagaaatagtgctattataacccccatttgccagataaaggataagaagtctcgaagatggtaaataagtcaaccaaggtcacattgttgagctgaattccagcaagtggttgagctagaattcaaaccaaggtcaatacagctccagggtctgtactcttaagatcaacggtgcatcatctccatggattgctatctttcagaggtactgtgaaagagatgcctacattggagcattctggacaagatgaccttcccttctgtgaaccataatgagcatatccaacatagtcaatctctacccttctacctccaacatcattttctctttccttatttgttttaatttttaatacactnaanacaactgacattaaagcatctanttattaaa

SEQ ID NO: 635869 - DNA, 172 bp, Homo sapiens
tataaggacggcttgctcagttactccacgtagagtccacacaaagaggcgaggagtattgctcagtgggtggtacgggaggctggcacttgcctgaaccgcttaagatagggaatgaaatgcccaccgaagggcagggcaggtacccgtgctgtcccgatcactgaagata

SEQ ID NO: 635870 - DNA, 82 bp, Homo sapiens
ggctggtactggtccggaatgttaaggatcttttagctctgggcacctccagctcctgctcgccggacggctcccagtgaga

SEQ ID NO: 635871 - DNA, 1547 bp, Homo sapiens
gtgcgggaggggctgcgagcggtgctggcctgaggatgtgaggcgtgcgtgctgtggatgctgccttcctgcctggctgtgtgcctgtggcctgtggcctgatgcccctgtgtgctgcttgctgtgctgactgctctgtgagtccttgtcctcctgccatgtgcctgtgcttgccttgtgtgcccctgatgtgatgtgcttgcttgatggccccagtgccagtgtgtcccgctcgtctgcatgtgactgtgtgagaccttgtgtgatgccactgcgcctctgctgctgtgtgtgccttgtgtgatgatgttggtgcctggtgcccctgtgatggccctggatgcctgggtgatgggctcggcccctgccgccaggccccatgtccatgcccctggctcggccctgcccggtttccacagcagcaacgctggtggcccttggggtgatgtggtttgaggaagcttgagtgcatgttgtggaaagaaggagtaacaccacgaggatcgttgcatgtgttgaacagaaggaggagctccacaaggttggagccaggagagtgttgcaaaggcagtcatggcccctaatgacacacattaaggtcatacgatgtggcccggaaggcgccccattaaagacagttgtgaacatggggggcattgggcaccccctggagagaaagagaagcacacaacaggtgcgccatcctaacgcgttggagccacgttgagcacgggggtaaggagagcaaagccattggaagtgggggaggaaaagggcgtcaagtatagtgagacaagtggggagcccgagagggggaaggagagattgagtggcccgaggaaacgttgggaagaaatcgattagagagccatggggagcgtggaggcactcctgaagcatatggaggaaggaagagggacaacgcaggggaggacacacgttagtgtgaaatggggtatgggaggagagctagaagggtgaaccgtggaacgggggcaaagagggagagaatggggagagtaggcagttaggtgtgagcagagccgggaaaggattgaggagagacagtagagtggatgacgtagaaggagtggtcatcgagagttggtgtaccatatatggacagaggggaaatgggtggaaggaagaagtatagaaagtagaacatgatagcgcaggaatataggagtagataggatgtagtgcaaatagtgatagctgaggaaagatgggtgaaaaggacaaagggggaaggaagcggatgaacgggaaagaactaaggtgtgaggatgagagaagtaggggagagggggaaggagtaggagtgggaaagagagtaaggagggagagagggagagaggaggatagcgtacgttgtgtattgaatttgtagaagagaaggagataagtcagaagggggggaacggagatggaagatggaggggagagtaggagaagaaggggtcagggaaggaatgagaaagaagagcgaggaggaggagagaaaggaggaggaagaaatagagaggagggagagaagaagggta

SEQ ID NO: 635872 - DNA, 306 bp, Homo sapiens
  misc_feature (150)..(150): n is a, c, g, or t
tggtacctctaaccagaggctttttctctgcagcctgcaagcatcgtcattggttattagccattctgactgatgtgagatggtatctcattgtggtttagattgcagagttctctcatgattagagatgtgggcatttattcttatgtntgttggccattggtgtatcttcttttgagaagtgtctgttcatgccctttgcccatttttaagctggattatttggtttttgctcgttgatttgtttagattccttgtagattttcttatcagatctttgttggatgcacagtttgtaaatatttt

SEQ ID NO: 635873 - DNA, 139 bp, Homo sapiens
tgaggatcccacagaggagggggcctgccccaccccatccagccaacccacgctgaccatgcgtcagggcctagaggtggagttcttagctatcctggctttcagagccagcctggctctgccccctcctctgtgctgt

SEQ ID NO: 635874 - DNA, 273 bp, Homo sapiens
gtgatattcttatatttctcttctgatgattgtcacagtcaactgaaagcaccttcttagcaaatgagtggccatcaatatacatgtcgaggtagttacaaatcttcttagggggaggtggtggtatctgtaggaatgccaattttacagcttctgctgctgattcaggttctttaattatgcttatctttgagtctgcttcaaatagcacaacaaaaaaatgatgacacttttcacacttgacaaaacgggtggatgagacaaagggaaaca

SEQ ID NO: 635875 - DNA, 302 bp, Homo sapiens
tatcctaaatataaggtatggagttctcttttgggagggtttattcgtgcgggttcatcgtgagtaagaagcctgccttgctgtgccgtgggaagatgccatagttttcgttactggatgtttggagtagatactggtctgtgattggtggaatggagaacacacgtgttggtgcttctgggtagcactggtttgcattagtttatgtttccatgccagagtttgtgtgggcgggcgcatgtgcaccacagagtgcactcgaggggactttcagtcacaggatttcataattgtcatcgtca

SEQ ID NO: 635876 - DNA, 332 bp, Homo sapiens
  misc_feature (21)..(21): n is a, c, g, or t
  misc_feature (105)..(105): n is a, c, g, or t
tagaagcacacttctcacagnaagcattcatgaactcatgtcagttttataaatgtcccacaaataagggttgcaaatacagaatgatgtctggctgggccttgngtgtcacgcctgtaatcccagcactttgggaggtcgaggtgggcggatcacgaggtcaggagatcaagatcatcctggctaacacagtgaaaccccgtctctactaaaaatacaaaaaattagccaggcgtggtgcgggcgcctgtagtcccagctactcgggaggctgaggcaggagaatggcatgaacccgggaggcagagcttgcagtgagccgagatcgcgcc

SEQ ID NO: 635877 - DNA, 143 bp, Homo sapiens
  misc_feature (73)..(73): n is a, c, g, or t
  misc_feature (138)..(138): n is a, c, g, or t
cagctgagatgctctgcaagccagccacagtactaataacccgagccacgtgggtgactgtgactccagtttntccagatgagagagatcttttcaacagtggtattggaagctgggccagggatgatcctgataaanacctt

SEQ ID NO: 635878 - DNA, 861 bp, Homo sapiens
  misc_feature (36)..(36): n is a, c, g, or t
  misc_feature (61)..(61): n is a, c, g, or t
  misc_feature (63)..(63): n is a, c, g, or t
  misc_feature (71)..(71): n is a, c, g, or t
  misc_feature (83)..(84): n is a, c, g, or t
  misc_feature (86)..(86): n is a, c, g, or t
  misc_feature (89)..(89): n is a, c, g, or t
  misc_feature (91)..(91): n is a, c, g, or t
  misc_feature (172)..(172): n is a, c, g, or t
  misc_feature (239)..(239): n is a, c, g, or t
aatgcacaaaaaaaaaaaaaaagaaaaaaaaaaagnaaaaggaaagaaataaaaaaaaaananaaaaaagnaaaactctgaannanaananaaaaaaaaaaaaaagaagaagaaaaaaaaaaaaaaaaaaaaaaaaaaaaaaaaaaaaaaaaaaaaaaaaaaaaaaaaaaanaataaaaaaaaataaaaaaaaaaaaaataaaaaaaaaaaaaaaaaaaaagaaaaaaaaaaaaaaaanagtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 635879 - DNA, 721 bp, Homo sapiens
gcccgtgttgcttggatggtgggttccgagtactcggcctggttttcgggctctagtagtggacgtgccccgttgctggccctctgcggttctctgctctggacatgcatctagctcgccacaggccggccgccccctctgcttcggggctcctgtatactcggtcaactgttcgtcacctcagactgcagatgttgctacaataccacactgatacgtagtattcacacagggaaaggggcagacgtgaacctagtccaggtggtccgaattttccaagaacatagtttaagtagattatatatgcttgctagaaatgcaggagcctacgtctagcgcgtatcttttctgctatgcttaaactaccatattacaagttcatagaccaaagagatatcccacaattagctatgctctagtaatgcgtcctgaccaagccagagactgcccagttctcattaggtgagtgcgccggcgatctaggggtttgagagaagggaattgttggctcaacttcagattgagagggtgcagtctcagacagcttgactgcttttataatgtaccaatagatgagcctgtggtaagcaacctgggcatcttaggaagcagtccctggagaaggcatgttcccagaaaggtctctggtagggactaaactcactcagtaagaacataatgtatcatcgaagagaactgattcttcttctcgacatgaaat

SEQ ID NO: 635880 - DNA, 1346 bp, Homo sapiens
agcggagtttttgagggagacctaaaactgtatcatcctagcccgtatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaagtaaggaagtggatgaaaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccaccgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgtgctgccaatgcggtaccgagctcgattcg

SEQ ID NO: 635881 - DNA, 1336 bp, Homo sapiens
  misc_feature (1324)..(1324): n is a, c, g, or t
  misc_feature (1327)..(1327): n is a, c, g, or t
agcggagtttttgagggagacctaaaactgtatcatcctagcccgtatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaagtaaggaagtggatgaaaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccaccgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgtgctgccnatncggggaccg

SEQ ID NO: 635882 - DNA, 1590 bp, Homo sapiens
agcggagtttttgagggagacctaaaactgtatcatcctagcccgtatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaagtaaggaagtggatgaaaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccaccgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaatacaaatagatagtcccttgagtcatgatgacgatgatttacaacctcgtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 635883 - DNA, 162 bp, Homo sapiens
  misc_feature (9)..(9): n is a, c, g, or t
  misc_feature (55)..(55): n is a, c, g, or t
attagctangcgttgtggtcacaacacctagggtagttagtcctggctaccctgnaggctgaggtgggaggattgcttgagcccaggaggtcacagctgtagggagctgtgatggcgccactgtactccagtctgggtggtagagtaagaccatgtctcaag

SEQ ID NO: 635884 - DNA, 725 bp, Homo sapiens
gaactatatgtatgagtctatacatcaaggcttagactcataaatactgctatggttatgattgacacctttcaggcacagtccaatttacattgttcccttccctagcaattactttctactccagctctcaactcttcttgagttactaaatactttgtagacggttaaaggaaagattgagaagtcatacacaatacttttggggtgatagtgagtggacgaatggaagaacatcgtagagtcgagacaggctttagatgtgacattgtcaatagctccagatggatcaggaagtacatttttatattgtgttaaccctgtagtgcgtagaatatgcatcaatttcttgaaggagattccaggtattcataagaatttgcatgtacttatggcaattgtggtcaatataaggaacgtttcctgcttgaaagattatattgatttagactgatgtgtgagatgtctcatccattttcaggcactgtggtaattctatttgtagtaaagtggcaggtatctatggtaactattacaataggtgcatgctcatccatgtgcactgttgatagcctttaccaaacgtgtttgacaaggaccataattaacatcacttatgaacttggctgggccaacaaagccatgattatcgaaggggaaggttgatatggggcaagacgaaccgttaacaatgtgcaagttggcttccaccaggggcctcttgc

SEQ ID NO: 635885 - DNA, 517 bp, Homo sapiens
gttgctttatttacaaacacttaccagatacagtacatatccccattctggagctgtggaataagaaaggattcacagagttgcaaggctaacatagttttgccttctttttcagcattacagatgatatcaattccactcttacaatcggttttcaataaatgctgtaagaggaaaagagaaatcagttcatataattaaaaatatctaagaagctagttgcaataaatgtttaaacattcaagagaaattgcttagatttctagttttcttctacaaagacaatgatgacttgtacagaaatattttcatggtttcatagtttcactgtacagcacctacattttacaatgactacttttaatctcattaatgtccacaacctataggtacatacgatccatattaggaaaagattaattccttcaccttaagaaacaaaataaacatgagcattttacctctagtactttattttcaaggcaagatcataatgcttctggggtattttttttgg

SEQ ID NO: 635886 - DNA, 1616 bp, Homo sapiens
agcggagtttttgagggagacctaaaactgtatcatcctagcccgtatctctcccttttaactgttctttatgtgtacattctgtgcccaaaagaaaacaacctttcattaattgggcaattgtccaggctcttagcttggcatccagctctcagagctgtgaaatcaaccgcaccagatctacgctttgaaatgaggcaacatctaactggaaactcgctcaaagtaaggaagtggatgaaaagactcagggtcccttttctcttccccgtcttctctcagccacatctctcttatcctatcttggtgaagaagcttgcttggctaggagagaggtcagggacgagaagatagtgacgagaaagttccatgagactctcagaagtcccagcctgaacatcaaacctgaataaccaggagagacgtaacctcggcatactttcagtggtttacctcctgcccacgctgcaggtttttcaggtccttgctcgagtgtgtgctcataggcgtaaataaacgtgctatcagcagcctgcgtcagccagcccagctatttaagcaggctggcatcagcaaacacagcttccaaacccagggcttgcgcttgcctttgcctcttccaccgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctcggtttttcagcatagtgttgtatgttccattgctagctgtcctgctgtttaacacagtgttgtattttttttctaaatgtacataattagaaaagaaaatagtgtaaagcagtggcttcactggaaaaatggtgtggctagcatttccctttgagtcatgatgacagatggggtgaaaaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaaaatgcactgaaaaaaaaaactcttcacaaccaatcacacaacaacacctaccacaccacatcaacaacacacaactcccaacacaaaaacaacaaatcacaa

SEQ ID NO: 635887 - DNA, 229 bp, Homo sapiens
agatatttatggacgagttgaaaagataacggttgatgagccattggttgctatgcacgctgccctatcagacagttaaagctggtgacacggcacaagctgaaaaagcttatcgctagttgacaaaatctttttataaacatatactatatatacggtatattccatatatcccgtaagggggtatcaaaattgatgaaagttatagcgcgagaagattggccattcg

SEQ ID NO: 635888 - DNA, 127 bp, Homo sapiens
ctagacggaccccctactacggagactgacggcacggagacggcgtgaaccccgggacggccgaggaacgggctgacatggctgcgtcccaggtcaacaagctgagggtgaagagcagggaggttca

SEQ ID NO: 635889 - DNA, 213 bp, Homo sapiens
ggaatctttagagacagactacaaaagagtagttcttaaatacagaagtgattgtgagactttgtgataccgatgtgtgtagtagcagttttgtctcaggtacatttatcatttgtgactcaaaggatgttgaggtattgaagtcattatgctgtctgtggagtcctactattagtacagacacctccagtgattttccgccgtgttacattg

SEQ ID NO: 635890 - DNA, 111 bp, Homo sapiens
gaaggattgaaacacaactcaataaggtctcaaaaatctaccgctctgccacacatgtgatgtgataaagagatctagtaccgcgatgtgagcaacttctatgtcacagca

SEQ ID NO: 635891 - DNA, 281 bp, Homo sapiens
  misc_feature (73)..(73): n is a, c, g, or t
gtagtgtacataaaagttatatttatactttagcctattaagtatacaatagcattatgtataaaatagatangtacatacgttatttaaaaattacactactgctaaaaaatgctaacagtcatctgaggcttcagctaatactaatgtttttgctggagtagggtcttgcctcaatgttgatgactgctgactgatcacaaggtggctgctgaagcctgctgtggcaacttcttaagacaataaagtttgtggcatggattgtaaagtgggaattagta

SEQ ID NO: 635892 - DNA, 910 bp, Homo sapiens
ctgatacctcctcttctggatcccgggacgctcccctttgggtttcaggactcctgactcccagtgcccccatttccaccgtcctgaggacgtccttttgacccgtcactcggactcaggagttcactgcctcggaatcttaggccctctgcggctgttcactggagtcgccgcgctgttgtctgtgaattcttattatgacaagctgcctgcgtccataggtgggcatgtgtccgtttcgccacatcagtggtgcagaagacagttgtgtgcaaccacctggctgcgtggcctatgcaagaaaggggaccagtgtgagttcctgcatgagtatgacatgaccaagatgcccgagtgctacttctactccaagttcggggagtgcagcacacaaggaatgtcccttcctgcaccatcgacgcccgagtccaagatcaaggactgtccttggtatgaccgcggttctgaagcaacggtcccctttgcaggcagccggacacatcggcgcagtcatctgtgtgaattacctcgttgggattctgcccggaggggccctcgtgtaaaattcatgcaccctcgatttgaactgcccatggaaacccaccgagtaatgccccaagtggccatagcaaggacacgaggctcctagaaaagcaagagaacctccgcagggtcatcggtggtccatggccagcgtcccacagcagcaggccgtcgcccaaccgggggaccccggccacttgaagcggccccctggtccatttgttggggagaaaagggccgtaacggccacaggtgcacaaaagggcactgggcttttcacaagggaacactgcacccgttggaggcacctccacaagccaggggcccttggtgggagtcgcatctaaaagtgatcgcccttgtggga

SEQ ID NO: 635893 - DNA, 414 bp, Homo sapiens
tgaagcctgttaatttttccattacaatgttttgtaaattcctccatgaggccataatgcattgttttgtgctcaaatttttgcattgtatttaaagcgattcaagtgaaatatattttatataacagtttaatatttatgctctgttgaatggaaagaggtaaaaaacaaatttaggaagcctggttaaattaaactgaactgaaacctgtttggcccataaagcataactctgctaaacctattttttatacacgatttttctaattaaaatttttgcaagtgcttctgtgactttcttccctacagccacttatttgctatgaggagtctgtaactgacaagtgttgcagagggtttgcccattaactgagtaaccatagcacaataaagctaaattctatcactagttta

SEQ ID NO: 635894 - DNA, 215 bp, Homo sapiens
cggagagcgggaagaggatggatttcccggccctcccccccggatggaagaaggaggaagttatcccaaaatcttggctaagttctggcaagagccatgtctactacttcagtcccagttgtaagaagttcaaaagcaagctcaatttgcaaggtaacctggaaatactctttgatctcaacacagttttactctcagagactctgagagattat

SEQ ID NO: 635895 - DNA, 182 bp, Homo sapiens
aaaaaaagacaaaaaaagactctgttttattgaggcaaccacaatgccacactgacacttaaaaaaataccacctcctcgccaccactgggaatccggccggcgcccaaaattcccgcatttccccaccatcaattttttgtttttttgaagtctcccgatgttgcccaggctcgtctcaaa

SEQ ID NO: 635896 - DNA, 478 bp, Homo sapiens
  misc_feature (250)..(250): n is a, c, g, or t
  misc_feature (388)..(388): n is a, c, g, or t
agttcgacggagactctctctgtcgcccaggctggagtgcgatagcgccgtctcggctcactgcgacctctgccccccggatccaagcgattctcctgatgaacactgatgcaaaaatcctcagtaaaatactgccaaaccgaatccagcagcacatcaaaaagcttatccaccatgattaagtgggcttcatccctgggatgcaaggctggttcaatatacgcaaatcaataaacatataatgtttatngatttaacattatatattaaatcagcatataaacagaactaaagacgaaaaccacatgattatctcaatagatgcagaaaaggccttgacaaaattcaacggcccttcatgctaaaaactctcaataaattaggtatngatgggacatatctcaaaataataagagctatttatgacaaacccacagccaatacctaatttattgagagtctccgtcgaactgggtac

SEQ ID NO: 635897 - DNA, 406 bp, Homo sapiens
tccagacaaggtctcactctgtcgccagagtgtggtggcacaatcacaactcactacagcttcaactgctcaggctcaagcgattatcccacctcagccttctgagtagctgggactacaggcacaccccaccatcctcggctaattttttttttatgattattattatttgtatagacaaggtctcaactatgttgcccaggctagtcttgaactcctgggctcaagcgatcctcctgcctcagactctcagagtgcaggaattagagacgtaagccactgcacccggccctcattcttatacatatactttaagtacccatgatgtgccaagcaagttccctgtcctcatgtactaaatattgataccacaaagcgttgacgcggccgcgaatttaatagttgt

SEQ ID NO: 635898 - DNA, 142 bp, Homo sapiens
cgcaacgctgtgcgatcacgctcagagggagagccgatgacagcacacgtggacgctccttgcacccatgtcccgcagccccagctcctggcaagcgcaatgtgaccacgcataacgcccgctaagtgaccacgctaaacgc

SEQ ID NO: 635899 - DNA, 508 bp, Homo sapiens
tgatcgaggatcccagcggcgccctttttttatcttacataacaccaatcattgtatttatggaatgattatgcatcattattggtaaatgacctcaccagctagactctaaatcaaaaagggctggggctgtatctgacatattctcagttgtatcagcagcacctagcacggcatccaacataaatgatacttatttgtggtttggcttaatacaaaaaaaaaaaaaaaaaactgggggaggggggggaatccaatcaacagacaaaaaaatattgctatgtgggggaaagagaaccaaagtgtccacgggtatggtatcagggtggtaagaccaggggcgtcctttttcttccttaaatatcacctatttaatctcttatgtccttttaatgatcaagaaaataaaaaacccttacaaatattttgggtactatttaaaattaggtttccatttaaaacatagactttggggtgtataagtccattctcccactgctataaagaa

SEQ ID NO: 635900 - DNA, 882 bp, Homo sapiens
cacaaaggaccacacgaagaggagacaacggacaggacaaggtgcgagcatcggcccgcccagtcggcgagtagaaataacgcctcgcagagcttgccccggggacccaaatgcgggtccccacaaagcatcggggccccacgtcatggccttcgcacgcgggggattccccaccaccttgtccggagtccaccaaacagggtcctccttcccgccagcaaccgcaccccgccaataacaatggtctaagacgacatccccggacagaggaaaataccgccttgtggggaacctcccccgcctctttctcggccggttggccccaatcacccccctccggaccccccggggaggccacccaacgggcgcactctggaggcggcaccaccaagagaagtagggcgccaccgaacaactggtggacccaccaccacagaacccttcataggtgattactcccccgcacgccctagccacggcggagcaactccaacaaaccccccgggctccagggtgagtcaagccccaccccgcgggagcaaaattgttactgcgcggtaaacactgcactccacgccgccagttccgcaccacggaggagcacatgttttggcgagagccccctcggagggactcacttgcaggaatcgactacacggagaacagggatcccccacgatggagcgagtgcgcacatccctccccccccccgcgagaaagggaggaacactgctccccccccgaggtgagacaccggtacggacaagcgggcggcgagaatagaacctggaacgggcgaagaccaacccgaaaagcgcacgggagcaaaccgtttttttaaaacactaaatgcagccccctgtttcccggccacacaaaaca

SEQ ID NO: 635901 - DNA, 837 bp, Homo sapiens
tccaatgtccagttccttaaatgacccccatctccctgaaagggcaggtgcaggcagctaggtgatggcaaaaaatgtccacttgaaaatctgtgccctgattgaaggcttggcccacatgctggaaggccccctcccaggaaaagtactctcgaaaccagcgtcggggtctcctcgctgccaggactccagtttccgccatgtgtttgactcgttagtccacctgccaattcgtggactcagcggaaaggcaagcctcctgggcctcgggaagacccagacctccaaaaatgtggagctgctatggtgggtcccaaaaaggatgacacctggcaaaggcaattcttcctcagtttgtccagtcgcttggaacatcccagtgatgagatggcagctcatgaaaggtctgagtgagtctctccagggaaagaagatactctgagtaccacgagggaaccagccgtccttatcaaagtgctcccagaaaatatggcagtgcccaagcgagagtgtgtcctcatgggagctacttgcgcttaatttcatccaacacaaaggtactctgggacaggtgagcgaaggggtccttggcctggggctacagcagaccagggcctgtacacattaatcaatctcctcctaaggaacaggggcagccgccttatcttcctcctaccgatacagcggagggacactgatttctctccccgagaacccttctctcccgggggtgtcctataacggtggggtctcgacaacttcaagcatctaaatgggcacatttctaccaaagttaacttcccagaaagccgaacgggctgtaatgagttagaaccg

SEQ ID NO: 635902 - DNA, 859 bp, Homo sapiens
gaccccattctataccaacatcctatgctgatttttcggtcacccttgaagtaatattcttatcctaccaggctctcgcagataatctcccatattgtaacttactactccggagaaaacaagaaccattcgaatacataggtatggtctgagctatgatatcaattggcttcctgagggtttatcgtgtgagcaggaccatatatttactaggtaggaatagacgtaaacacactagcatatttcacactccgctaccatatatcatcgctatcccctaaccggacgtcgaacagtatttagctgactcgtccagcggactccacgtcaagtcagtcatgaaacatgaactctgctgcagtgctcggagccctaggatacctctttctttacaccgtaggtggtctggctggcattgtattagcagactcatcgacgtagacttcgttctacctcgacacgtactacgtgtagcccatttccactatgtcctatcaattggggctgtctttgccatcatgggaggctacattcactggttctgccctattctcaggctacgacctagatccaaactacgccaaaatccatttcactatcatattcatcggagtaatctatgtttcttccccccagctttctcggctgtccggagtgccgcgacgtttctcgggctaccccgtgttgccccgttgaaacatcctgtccctggaggccatcttgtcttacgcgaaaatagtaatgtctgattgagagcctgttcgagcgcagctattgtgaagcccccgactggtgttttggcccccctggctttgaacgcctattgtcaaggggatgccccggtgccctcttcgttaaa

SEQ ID NO: 635903 - DNA, 985 bp, Homo sapiens
gccggatctcacacgtgggtcccccctatccgccatttgtagaccacccatatcttttgtcgaactaaaagtttccttgcgcgtccgtgaaatcgccgggtttctctcttccgcccgtccaatggtgttctcgccggttacaacgtgttaacacaaaagagaaaggtttgccaacaagttcagaacaaacacacgggtgggtagcaacacccgacgttaaacgcagtggtttaactctttccgcaaacctacttgaatttctacttcctttccggatcatttcctccctcatctcttggtgatccccgccgtaataatccctcctctgtcgcaccactggcgagatccttgggggcgacccgccctatcaccccgcggcccatccttgcgtgaagtcccgccctgcggtccgcaccaggggggcaaaagggtgctttttctcactaaacacccttggcctgtagggtcttcaaataaacgagttcgtggccctcggtggtccccccacgacggaggttcgctttgccggaggccaccacccccctgcgtcatcgttgctccgtgccccgcgccgtccacacccgcgctgcggacatgtgacacgcacgccaggctttaaattccccccaaaacttctttccggtggaggaactcgcattccacaaaaaaaagagtaaaaacgttgcttgagtgccacgcccaccaccacccgtgatcgagggagaatgtcttgcaaccacaatataaagcaaatacttcagaagcccctggcgacgcccccatataacggtcacgcaacaaaccatgtgggccaccccgacagttgcccccccaaccaaatccatcgggttatattcctctctgctcctctgccggccacctcggttttatgtctactagctcttcgagcagcaggtggaatttcactcctctccccacacagggttttttaaatcttttagacccataaaaaccgaacaaaaca

SEQ ID NO: 635904 - DNA, 832 bp, Homo sapiens
gacctggggtctgtgagcgctgtgatggtctagaggctggcgattgaagaatgctgggtgccagtcagtttatcggtggttcatgttgattgcaggccatcttcgcagtgtcgacatacaggctgtacgtctttgacttcgctccaacgcgttttatggctatatcacaagagacttaaccatatatctacaaatgtcgatactatcaatggaatcaaggaggaatctaggatccgggatagtatctactagatgtggggagcatgtacctcgaatagctgcacggaagaatcgtcattaggatgatttgtggataagagaattagttggaaaaagtaatagtggataagagacttgtgtggatttactattatattcatcttcattaggaactactgaaagtattttcaaacctgagtgtcaaaacattgtggtcatggtggacaattttgttcccaattattcgtcaagggtggaaaatgtgatgtagatccttgatttgaaaaattcgaagatcaaaattggagatactgacttaacattcgttccactgacatagcaaggtttacctctttaaaatcctcgatggggatcgggttccttcgtagtcatatccactattcatgtgcaaaaacggtatacgatgggtcccacgaaattgttgggaggaaccaagatccctctgaaccatggggtcactgggtcgcattttaaatgagaggtcgaacagacatgcgactaacaggttcttctgggaaagaacttttaggattccgggggacccccattcggcgggttcggtggtggaaacgagacatgatgaataaagggg

SEQ ID NO: 635905 - DNA, 475 bp, Homo sapiens
  misc_feature (49)..(49): n is a, c, g, or t
  misc_feature (63)..(63): n is a, c, g, or t
  misc_feature (66)..(66): n is a, c, g, or t
  misc_feature (122)..(122): n is a, c, g, or t
  misc_feature (124)..(124): n is a, c, g, or t
  misc_feature (126)..(126): n is a, c, g, or t
  misc_feature (128)..(128): n is a, c, g, or t
  misc_feature (145)..(145): n is a, c, g, or t
  misc_feature (155)..(155): n is a, c, g, or t
  misc_feature (166)..(166): n is a, c, g, or t
  misc_feature (186)..(186): n is a, c, g, or t
  misc_feature (237)..(237): n is a, c, g, or t
  misc_feature (469)..(469): n is a, c, g, or t
aagtgtattatttagatatggtctttcttcatctttctctgcatcctgnaagttagcgagtcnttntactcctacctcttgtcctccctttctccacaaaatacatacacatatacggcttngngngngggtgtggtatcatcancacagcatanagatttaagcngtagacacaagtcacatganagaggctctatgcatcatgtggcctgtccgaataaaaagcaaacattagantgccatttcagcagttacagtgttgatatgatcaatatagctaatttttttatacccgtcatatatttttagaagtcatccgtaggaagaggcaaacaacaaagactgcttttttttagaaaagttatgtgccaacttcaaaatgacatactaaccagatatcagcattcgagagcgaggttgaataggactggccttgatgcacatgcagatgatttgctttcataatatnaaatta

SEQ ID NO: 635906 - DNA, 335 bp, Homo sapiens
tgaatggccagagggctggcagtgtgctgcgcactgctggagcgtgtatgatggctggtcggagccttggagctggtgccgttgcaccgttactggccggtggtcggcctccatgttcaggttctcaatgtgtatgctctgacctggtcctgcgaggaactcacgaagaacctgctctcggagccgttcatgagggccttgtacctcagagtcagtgatcttgtaccagtgcccagtcagtgacaggtggcacggactctgacttgcagaccagcattggacgtctccccctcgttgatgtgttctgacgacttcacggccttcactctgggagg

SEQ ID NO: 635907 - DNA, 151 bp, Homo sapiens
acctagcaggatccctttgagagcccctctcctacagtttgagcacccatcgttaccgcacttcagcctggggtgcatagggtgagactctgtctctaagaagaataaaaaaaaagcttcatgggtaaccatttagtagatacagatctta

SEQ ID NO: 635908 - DNA, 169 bp, Homo sapiens
ccgtaatgatgagggaggtgtatccatagacttgctgacactcgttcaaggctacttgaagtgggtgtattacacaggcttggccaaagggttaatgcatgctagaaatgtgaagtgaagggaatagaccttgaccgcttgggaacattctatgtttctttacgactgc

SEQ ID NO: 635909 - DNA, 236 bp, Homo sapiens
agttgtaagagaatacaacaatttaacgaaattaataaattcattagctgagtgagaaattgaacaaagatagatattatggaaaggaacaaaacaggaatcttggagcttgaggaattaagtgaatgaaattaaaaaaaatacaattgagagccacagtaacagactagaacatgcagaataatacatttctgaacttgaagacagatcgtttgaaataacccattcagaggaag

SEQ ID NO: 635910 - DNA, 315 bp, Homo sapiens
ttagactcgagcttgtaccctcgataggcatatcccaggtacatctgactgcttcagattcctccttcttctcatcttccttctcctctgctgcaacatgggcagatccagcagcaggggctgcggagcctggggcagcatgagacgggtactgctccaccagcaggtacactggccaccttgccaataccctgtgcaataacgtcttccatgatttttccattcagctcactgataaccttgttgagccggtcgtcgtccgcctcgatacccacgctgtccaagatcttcttgatgtccttggcccttatcgag

SEQ ID NO: 635911 - DNA, 406 bp, Homo sapiens
ggcttatgcttgtagtctcacatactggggaggctgaggcaggaggattgctatgaggccaggagttcaagaccagactggacgtcatagtagagactctgtctctataaaaaaccaaaaagaaaaattagccgggtgtggcagcatacacctatggttccagctacttgggaagctgaggtgggaggaatgtctgagcccagaagttcaaggctgcagtgagccatggtcaaaccactgcactccagcctgggagacagaacgagatgctgtctcaaaaaaaaaaaaaaaaaaacccccaaaaacccccttaaaaaccctttaaccagtggggggtttcagggcctctcaatttttggggggattacccagggttacttttttcccatgaaaccaggaaacatta

SEQ ID NO: 635912 - DNA, 559 bp, Homo sapiens
gctctacccaggtcccgctcaagaccctctgccagcccactcagggctctgcctttccccagccctgggcccctcagcctccccatcccccactggctatggtcctgccccttctaccagacccatgggcccccaggcagccctcttaccattcgagggccctcgtctgctggcagtccacccctagtccccactggtgccttactgccccatactccagggcctggtccggtaccccctcgccacccagcatgcagaaacagccccattgcatgtgccgagtgcgccagcagctgcagacctgctctccgtccagcccggagagccagcatggcggcaaggtcagtactcctgggggtgggcatgcgccctgcgtgcaaaaccaccaacggtggatgcaagctgatgaggtctgacgggagaaagggcccttgcgcgatgattgagcgggacccctatgaacatcctgagaggctgagagaagtatgcagcaggaagctggagtgactttacggggtcaagctagggggatgtagggagctctggacacttgtctggc

SEQ ID NO: 635913 - DNA, 270 bp, Homo sapiens
  misc_feature (14)..(14): n is a, c, g, or t
  misc_feature (104)..(104): n is a, c, g, or t
  misc_feature (109)..(109): n is a, c, g, or t
  misc_feature (111)..(111): n is a, c, g, or t
  misc_feature (116)..(116): n is a, c, g, or t
  misc_feature (119)..(119): n is a, c, g, or t
  misc_feature (125)..(125): n is a, c, g, or t
  misc_feature (127)..(127): n is a, c, g, or t
  misc_feature (129)..(129): n is a, c, g, or t
  misc_feature (132)..(132): n is a, c, g, or t
  misc_feature (143)..(143): n is a, c, g, or t
  misc_feature (152)..(152): n is a, c, g, or t
  misc_feature (155)..(155): n is a, c, g, or t
  misc_feature (167)..(167): n is a, c, g, or t
  misc_feature (172)..(172): n is a, c, g, or t
  misc_feature (174)..(174): n is a, c, g, or t
  misc_feature (192)..(192): n is a, c, g, or t
  misc_feature (212)..(212): n is a, c, g, or t
  misc_feature (216)..(216): n is a, c, g, or t
  misc_feature (240)..(240): n is a, c, g, or t
  misc_feature (244)..(244): n is a, c, g, or t
tttgaaagcttttnaatttttctttacagtaaatattccattctgatttcataaattaaacatttatgcctcccttttgtgttgacactgtagctcatactggnaaagncncccantgntttgcngntnttnaaagtagttcnatatataancantgttataaggantttcntntggaaatggttgaaaatncttctaaaatgtgattatcnaccntggtatgatgatcggtgtaattgntganattcctttagaggtgtgaatgtacac

SEQ ID NO: 635914 - DNA, 245 bp, Homo sapiens
  misc_feature (51)..(51): n is a, c, g, or t
  misc_feature (129)..(129): n is a, c, g, or t
ttagaggatcctggtcatgtgatcctcccagtcggtgcagcaaattcaggnaagcatgcgcattggagcagaggtttacacaacctgaagaatgtcatcaaggagaaatatgggaaagatggcaccaantgtgggggatgaaggcgggtttgctcccaaatattcctggagaataacagaaggcctggagcttgctgaaagactggctatttgggaaaaggctggcttacactggatacaggtgg

SEQ ID NO: 635915 - DNA, 227 bp, Homo sapiens
attcttctgtctagcataatatgaagaaatcccgtttccaacgaaggcctcaaaggggtctgaatatccacttgcagactttataaacagagtgtttactaactgctctatgaaaagaaaggttaaactctgtgagttgaacacacacatcacaaaggagtttctgagaatcattctgtctagtttttctacgaagatatttccttttctactattgacgtcgacgc

SEQ ID NO: 635916 - DNA, 606 bp, Homo sapiens
gtggacctgcctcccgtcccagctcttggaatgctgcgggatgggttgctcagacatgtaggcatgctggttggtactcatctcccagttagcagctcaggcctgcctctgagtagccgtccacagctctgctgatcgattgtcttctgacacgggttggaatgtgagctagagcacagaggcaagccctggaagttagggtcactgattgattctacccttttttttttttttggaaacgcagtctcgctcggtcgcccaggtgggagtgcggggagcgatcggggctcacggaaatttccgcctccggggttcaagccattctccggcctcagcctcccgagatagcggggacggcggggggcccgtcaccacccgggggcataattttgggggtataaggtacgagcacggggtccaccgggtgggccaggagggtctcgatctccggacctcgtgatccgcccgggtcggcctcccaaagtgcggggatacgggcgtgagccaccgaccgggcctgattctaggtttaaaaatattcctacctttgtgggcaagggccgcatgtgcccccctttgacaacccggtttgtgccagtgggtcgg

SEQ ID NO: 635917 - DNA, 975 bp, Homo sapiens
aggggctgttacggctcggagtttcgggagtgcgcggtgggtcgtgctgtgatgacggcatggagacgttctgccccgtggtgctactgcgaccctcgtagacgatcatgcgcggtctactgctcattcagcgagaggcgcctcccgcggatcgcccagactggcgcccgcttcgcccatgccgagctgagcgcggctagtggctggcgggatgcttgcgctgctggccgccagcgtggcgctcgccgtggccgctggtggcccaggacagcccgtgcgcccggtacgccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcggaggccatccgcgagctcacgggcaagctagcgcgctgcgagggggctggcgggcggcaatggcgcgcggcgcgggggccacgggcaaggacactatgggcgaccttgccgcgggacccccggccacgtcgtggagcagctcaggccgctcgcttgcaagaccctcaatggaccgccttggaggagcctcgaggcaccagcttcaggagcaaacgttttccaattgctgggctgcccgggcgaccttccgcgaggtgcctccagcagcgggcttgggcggagcttggaagaggcaggcttcatggcgcaaagtgttggcaagagcttggaggcacgagcaagttccctggcgtgcaccacatgaagacctcggggttcaaccgggcagaaagaccggtagaggcaacccttgaacggcggcttggttgcaagaggtgtcaccccgaagctttgagcggaggcaataaccggcctttaaagtcaaccaagattgcgttcaaagggtgtccctcccaaa

SEQ ID NO: 635918 - DNA, 154 bp, Homo sapiens
tggtgtctagaggatccatcggagagtgcaggaataaaatgttctttgcctcaggatggctgaaaagaaaaacaaagacggtgacatattcaaattatgatcaatgtgcatttaaaacttcgcataaaatcttctcaaggggttgacttttccg

SEQ ID NO: 635919 - DNA, 198 bp, Homo sapiens
agcggagcgcggcgccgctctccgctgcgggggaggccatggcggaaccttcccaggccccgacccggcccggtgcgcagccccggccgttgtgtcacagccgtgccagttcacgactgtgctcccgcggttttgggcattcatccgccggtcgcctgccgtgagccgcgctgaggcttgggggcccggatgtaggaa

SEQ ID NO: 635920 - DNA, 768 bp, Homo sapiens
  misc_feature (562)..(562): n is a, c, g, or t
  misc_feature (619)..(619): n is a, c, g, or t
  misc_feature (623)..(623): n is a, c, g, or t
  misc_feature (627)..(627): n is a, c, g, or t
  misc_feature (635)..(635): n is a, c, g, or t
tgattttccaggcatttataatttatcaaacatggctacaaaacatgacaatgtaacctactagttaacataaaattaataaaatggttatcacaattttaatagggatgtcataaaacctttaaagaacaaatcattaaagtgctatgtaacacaatccagaagtttaaaatggaaggaagggtcactgacttgtttaattatgaatgacacgtaattttatatcagagtgtaactaaggtagtgaacacacacaaacacattcacaaatacatgcaaactaatgatcaagtttatgaataatgatgcaaaattttaagaaaatattagaataaaaatatttcagcatgtatttatttaattagccaaaaaaggtaatcatataatcatctctttgatcaggcaaaaacaattagatttttctctcctttcttcactgttagttattatttgatgtatcaatcaatgcaattgtatacaaggccaaaaaatgagacatataaatgatacatccttcaaagaaggatttaaattcctctctctgagatgttgtatgttgaanatctgaaaatttctgtaaaaccttaaaaataaaaatcagtaaaattctaggagaaanatantaantgtggatnagtttcgtataatatagaaaatgtaatgaaatgcctatttttgttatcacaacaataatttaaagtacacaagaaccatgtactttaaatttaggaataaataaaaactgggaataaatttaaaaaaaaaaaa

SEQ ID NO: 635921 - DNA, 243 bp, Homo sapiens
  misc_feature (46)..(46): n is a, c, g, or t
  misc_feature (80)..(80): n is a, c, g, or t
  misc_feature (203)..(203): n is a, c, g, or t
gcccgcaagaagctcctggctgaccaggctgaggctcgcaggtctnagaccaaggaagcacgaaagcgccgggaggagcncctccaggccaagaaggaagagatcatcaagactctgtccaaggaggaggagaccaagaaataaagcttccctcgtgtctgtacatagcggcctggctgtggcctcatgtggatcagtctttnaaataaaacaagcctttgtctgttgccctcttgtttagca

SEQ ID NO: 635922 - DNA, 826 bp, Homo sapiens
  misc_feature (826)..(826): n is a, c, g, or t
ggggttacgggatcggcggcagcagccccagccctcagagagaccagcagaaaggtgagggagggagggtgctggggggacagtcctcccaccattcctaccgctatgggcccaagtctccacactcccagcgtccgactcacaatcggcggggctaggagacacctccaaatccctgtcgcccccttggcacgacagccccagagagagacagagacacaagcgcactcgcgggacaacactctgggtgccgcacgcacgtggctagggggacgggggccgaagacacagacaatgaaacgaatagcccagcgatagacagaagagacaagaaatggagtcaagatggcacaagggagaatagaactagctagaaagatagaaacaactcacaataagcaagatggcaacgcgataagagaacagtgagcagtggccacgagccgacacgacgccagtggcaggcagaaacgaacagaacgtagcgacccgaaggaatgcacgtagaagagtcggcagcagatagccaaagagaaatagcgctcacataactcggaagccaacagatcgagagcaatatggaaataccgacgcacggaaccactatacaagatggtaggcatacagagcccaaactacagccaatggcaaaatagatagcacaggagttcagccgagagacaggcgacacacgcggaacacagagaagcaagcaattgcaaagcaagaagcgacagagacgggcccaaacaagagacgctaggaggaccaagacaagacaaagcgagcagtaacacccaatcagatagaacaggcgtcaaagtcn

SEQ ID NO: 635923 - DNA, 476 bp, Homo sapiens
tataggagaggatcacagtgttactggggatggccttgtagtgtcgtggcacaagcctaaatctgcgcggtgcataagaatggctcaccggtgagactccattatttcttgaagaacagtgttgtttgtcttattttattttctttcaggcatatatagaatctttggcactataaaaagcatataccgcataattaatatctaatggttcccagagaagacacaatcttataaggggaagtcatgggaagaaggaagctctggtcataaaaacacgatttccaccttctgtgcagagaaactgcactcttaattgtaggcagaagggtttcgtttgggtgacttcatcttcaccactggaagacgctgcccacctgccaccacacccggctaattttttgtatttttagtagagacagggtttcaccatgttggccagactggtctcaaactcctgacctcaggtgatcaacctg

SEQ ID NO: 635924 - DNA, 591 bp, Homo sapiens
ttacctgctcgcggagcagataccccccacatccaatgacatgtctgtcttgtcacccaggctgagtgctgtgcacgatcttggtcactgcaacctctgcctcccaggttcaagcgattctcctgcctcaacctcccgagtaggtgggattacgggcacccgccaccacacccggctaatttttgtatattagtagagatggggtttcgccatgttggccaggctggtctccaactcttgacctcaagtgatccgcccgcctcagcctcccagaatgctgggattacaggtgtgagctaccacacccagccatgattttgggtatttttagagatggggtttcaccatgttggccaggctggtctcaaactcctgtgcctcaagtgatccacccgacttgtgcctcccaaaatgctgggattataggcgtgagccaccatgcctggccaaaaaagcatattttaaacaaaagtactgggacaatgaagttaagggcagaacacccagtttatctcttttggaaaatttgccagcctcacctccctgtctacttgtctagggtttccgggtgtattactcggcgagccgggg

SEQ ID NO: 635925 - DNA, 129 bp, Homo sapiens
catttacgcggctataccgactactgtgatctcgtcatgggatattgcatcccgatcccatcagatgggtcacgggtaccgcgctgcctgggtaggtaggcacacgctgagccagtcagtgtagcgcgc

SEQ ID NO: 635926 - DNA, 148 bp, Homo sapiens
ttgttttgtagagatgtggtctcgctatgttacaggctggtctcaaactcctgggctcaagcaatctgcctgcctcagcctcccaaagtgctgggatcataggcatgagactttgtgccaggccttctatttatgttcttggtcgacg

SEQ ID NO: 635927 - DNA, 269 bp, Homo sapiens
  misc_feature (148)..(148): n is a, c, g, or t
  misc_feature (200)..(200): n is a, c, g, or t
  misc_feature (204)..(204): n is a, c, g, or t
  misc_feature (207)..(207): n is a, c, g, or t
  misc_feature (214)..(214): n is a, c, g, or t
  misc_feature (217)..(217): n is a, c, g, or t
  misc_feature (228)..(228): n is a, c, g, or t
  misc_feature (230)..(232): n is a, c, g, or t
  misc_feature (239)..(239): n is a, c, g, or t
  misc_feature (241)..(241): n is a, c, g, or t
  misc_feature (247)..(247): n is a, c, g, or t
tcttgcatggcctgtagctttacagatcgtgggattccctgttgtatatatactcagccatgagggggcatatgtatcttgattatcagactggaagacgggactttctattactatcatcaccagaataaaacataggataatttancctaccagcccttctcccccaataactgtggtctatacagagtcaatatatntttncanagaaagntantcgctcgattntnnntgaatcntnattaanctttatgataagctagggggga

SEQ ID NO: 635928 - DNA, 327 bp, Homo sapiens
ggagaggtcatagccactgctgttgtgcaaggacctgctgttagaatagaaggccaaggaggcgctggtggtggcctcaggctatgcatgtgatgcccattgtttccagggccatcccagattggaggttcctgtttctataggaggatcccttgagacctcctcatttccacacccgagcaatgctgagggctgtggggcccccacgggcttgagtgtggtttatggcacaacagggactgatcacagtggcaccgggtgtcagtggccagtggtcaatggccaggaaccctgaggaccctactacttgtgtgggtggcatttacc

SEQ ID NO: 635929 - DNA, 149 bp, Homo sapiens
aaatcctgttcgtatcccccttttgatttccctaagttccttgttccccccctaaaaaaagaatgattgccccccccctgtttccccccggattgttgtgattgtagaaacgaagctatgtgaaaattatataagtattataaaggtga

SEQ ID NO: 635930 - DNA, 476 bp, Homo sapiens
tagggcctgggatcgcaggaaccagcgaggaattgcgatgcggagagagaaaggaaggggggatggcccgatcacgccccgcaaagcacttcgcgatcccaaggtagccgagaaggacctccatgggtcagctgcggctaggggtcgcgcaagccatcgtagatgacaggtcggaagaggcagaccgaaggctccaggacgcataactcaggagcactgctacactggccaatgggcggtgacgggagaacagagctctgctctcactggctggcagcgcaccaggagcctgtatcccgttgcctctcctggatgggttgtcagccctgtgtttcagctgtgaccaattcattataacatttggatacttactgaaaatgtaaggaagcaggaaaaattaactacgtttcattcagagatagcctctatcaactagtttgacatttttccctctgttacattgagatcatacccta

SEQ ID NO: 635931 - DNA, 316 bp, Homo sapiens
tgaactgttacgtcaattaaacaccctccctataataaattacccagcctcaggtatttcttcaaagcagcgtgagaacggactaatacaaccagtttgcacccttcatccaatctcacagacacacagaggggtctcagactgttcttcccactcagcctttattccaaccaaaacagacttgtgatgttattagggaaatgagtttgaatcactcacagacacacatactcacattattaaggagtgggttatcattactcactgagacgacacagacactcatatcgatgtatgggtgggtcagaatcatgag

SEQ ID NO: 635932 - DNA, 766 bp, Homo sapiens
  misc_feature (302)..(302): n is a, c, g, or t
gcacgaggtatgcttcaactgcacattacgagtcgaccaaaccattcatgtcaaatgctttgaatgtcctctgcgaatttgtatcctctgtttccaatgcggcgcggaatcaccaccacatcgccgaggtcacaattacgagcttgtcaagccaacaagtaatcccgaagcaatgagctggacacacgaagatgaattcgaattgttaaaagctgctcataaattcaagatgggaaattggggagaaatagctgaaagtattggtcgcggaagaaaagatggtcataattgcaaggattacnttgaaaaacatttcgtgcgtggatggattggacaattttccataaaaagttcaagttgggatcgaattaaatatgggatgtatataaatcaaacattagacagtgtgctacaaaaaaactgtttggaatcaacggaaagaatgcttctgattcgagacgccgttcgtgcatctggagaaagctgggatgaaaacgatccgaaacttgcgataaaagtgcaacaagtattagagcagtatgtgcaaaaagtaatcgatgatgacattgaaaccaagtatgagcgcccaaaattccttacaaatcaatatgagacggagcttagcccagatgactgtgatcctgataatgaaagagatatgaaatcgaagcgatcagtaaaacaggaaataaatactgatgatagtgataatgacaattcgccgggcccgtcttccagttgtcggaaaaaggggcctccgagtcca

SEQ ID NO: 635933 - DNA, 136 bp, Homo sapiens
gagcttctttagcctaggccagcaggcacaccgaagtcagccccgaacaggcctgtgatcagcagccgggtcgaagcccaggccctggggtggcctgcacacctgtctctgcagggccctgcgttgacaaaagcca

SEQ ID NO: 635934 - DNA, 658 bp, Homo sapiens
gcggtcccaaacagcagtgcagcagagactaacagtgaaccctttgtatggcatcatttcctggggtgatcgaccagctacccggtagcaggttgatcatattggaactcttccaccatggcaaaggagagaggtttgtcctcattggaacaggcacttactcaggatatgggtttgcctacctgcatgcaatgcttccgccaagactaccatttatggactcaaggaatgccttatccactatcacggtattccacacagcattacctttgaccaagcactcactttacaggtaaagaagtgaggcagtgggctcatgctcacggaattcactggtcttaccatattccccatcttcctgaagcagctggattgatagaatggtgggacggccttttgaggtcgcgattacaacatcaactaggttgcaatactttgccgggccggggcaccatactccagaagaccgtgtgtgctctgaatcagcgcccaacgtatggtattgtttctcccatagccaggattcacagatccaggattcaaggggtggatgtgaaagtggaaccactcactatgatgcactagcaaaatgtttgctttctgttcccacgacattaggttctgctttactagtcatcttaactccagagggaagaac

SEQ ID NO: 635935 - DNA, 361 bp, Homo sapiens
  misc_feature (361)..(361): n is a, c, g, or t
cacgagagcaaactcactctagattactagcagacaaccttagagagaccatttacccgaataccgtgtaggcgatatgagaatggacctcgggcaatagacatagagccgcgtggcgaagatggacaattataaccacgcgtaatatagcgaggactaacccctataccttctgcataatggattgactagaaataactttgcaaggagagacaaagcttagacccccgaaaccagacgagctatctaagaacagcttaaagagcgcacccgtatatgtagcagctggatgtgcaagattgagtactagtttgagctttttgtccacagaaccctatgaatgcccttgggatatcaggtn

SEQ ID NO: 635936 - DNA, 860 bp, Homo sapiens
ggcaccgcctgccctctctctctctctctctctctctctctctctctctctctctctctctctctctctctctctctctctcagagatggagaagagagagaggcgcgaggagagagagtgtgtctcccgcccggggtggtgagaaaacgcgggagagcagagagaggggaagacgccgccggagagagagagggaccaagaagagggggagggaggagagagcagagccagagagagccacacacgcggagagagacgtgcgccgccgtctatatgcgggggggagagagagagagacctctctctatgagcgggaagagagtggcgcgcgacgagcacgcagacacgcgggctaggggagccgagagagagacacacaggtgaaaaggcggggcacaaatatacagcaggagagagaagagagagaagaagagagagagagtgtgggcgcggcggagaaaagagggggtggtcgagagggggggccgtcccaaaaggagagaccgtgtggcgcgcgagagagagaagagagcagacaccagagggaggagagcaacagagagcagcacagggggggggagcgagcacaggatgatgctatccccagcgacggtgagctggtacgcgcgccgggactgtgtaggcaaaagggggggccccacaagaggaagattaacgagggagaagacgacacagaaggggaggtaaacacaacagaaagaccggcacactggccgcgaacgaaggaatgcgagtccaaacaaagagggccgcgtgcaaagcgggggcgaacatacagggaacacaaacagagagagaagaaagcaacccgcaaagggagagagagcgggcaaaaagg

SEQ ID NO: 635937 - DNA, 700 bp, Homo sapiens
tggggaaagtcaggtcaggggtagtactataatggtggggacgattagtttatagcatgggagtaggtttaaaggttaatggtacgtaagtctaaggccattatgtgtgtgttgggatgattggagactaagtagggctaaggcccaccgcgtgacttacgcagggggcaaagactaagttatgggcaataaggcaacaataatgggctcaagagggcagtggtgtgtcgacgggttcatagaggagtaagctataaatgagaaccagcgagataatgttatatcatattcccattactaaaggacataaggtaacggagagggacatattgagtgtgtgtgagacgcgatatataactaaagagttatatcgactaaagaaagtcgacagatcgcgtcaacatggctaaagtataaaacaatgtaacaaatggcattggtagagactctgagggcctacaggtgcgaacagccatgaacacaccccattctcacacagacaaaacaccgaggatacaaaatgagcgtgcccgagagtgtacaccccgccacgagcccggaaccaacaaccacaagcgtgcactgcaacgcggccacaccccctccatcacacaacgcccccgcacgagacaccacgcatccgagggaactccccacagactcccacaaaaaccaacgacctccccagcaaacgaaacac

SEQ ID NO: 635938 - DNA, 368 bp, Homo sapiens
  misc_feature (199)..(199): n is a, c, g, or t
tatccgctcacgaggggtggggaaattggaacaggggaacaggtctccaggccctacagtgcagtccagagaaggcaggcaagtgacctcaggtcacacagcaaaaactccccatttgctgcctgcccttgcccagctccagaccagtcctctgctcctagatctgtggactcttaatgaagtgagaggtggctgcagngcaccatggtggacaccccagtccgggagaaatggctacacttcgctgaccgtgggagggctgcgagctctctagcatgaagtagcaagtctgtgaaacttgatactatgggccgcctctcttcctgactctacatgatgcgcctaccaccaggatgggcacctggaaa

SEQ ID NO: 635939 - DNA, 362 bp, Homo sapiens
  misc_feature (199)..(199): n is a, c, g, or t
tatccgctcacgaggggtggggaaattggaacaggggaacaggtctccaggccctacagtgcagtccagagaaggcaggcaagtgacctcaggtcacacagcaaaaactccccatttgctgcctgcccttgcccagctccagaccagtcctctgctcctagatctgtggactcttaatgaagtgagaggtggctgcagngcaacacaggagacacgctcatgtacaaggagcaatggctacccatctgctcagtcgggtagcgtacgaactctatagctatgaaatgacatagttttcatgcagccagcataatcggggccccctgttcatcctctaccattctatccctcccacagtttgc

SEQ ID NO: 635940 - DNA, 1358 bp, Homo sapiens
  misc_feature (481)..(481): n is a, c, g, or t
  misc_feature (684)..(685): n is a, c, g, or t
  misc_feature (722)..(722): n is a, c, g, or t
  misc_feature (734)..(734): n is a, c, g, or t
  misc_feature (770)..(771): n is a, c, g, or t
  misc_feature (792)..(792): n is a, c, g, or t
  misc_feature (794)..(794): n is a, c, g, or t
  misc_feature (852)..(852): n is a, c, g, or t
ttttcggaatgatctcttgatgtaaagccttgacacctttctactgatgcaggtacactgtcagtgaagacttaatgcagtgccttccgtagcatcattttttcttttcaattacaaatacatcaagttgaatgttttattaccagtagtttgttttgatgcttctttgtaaaacagatgacatgctgttaagattcctcgacaggaattctatctagaactgttagctaagtgctgctactaatatcttacatttatacgacagtataaatgtttttgactaacaatcttttgaattgctatttcccctatgtcacttgacttgatagtacattcagtaagtcttaatatattatttaaaagtgataccttttctatttcatttgttccattgtctcaaacattgtggtgatggtttctatgcaatttgataatatgaacaaatctgcagcatggtgacagacacattggctatagctgntgatagtacaaacttgtctaccttctttagctcagcctcacattattgtaatcaacctcaaaagaaatcaacctaattcctcaattctacttaacccaacctcattaccctgtcctatttttttaccttttttatagcctatatcaagtcctaatatttatttatctatctgtacactttaatgaaagtccttttgaaacagnntttctggtttggtcaatagatgtgtcccaaactatanggcccatagtantcactcaataaaatgaatggttgagtggggtaaatnnatatattgttatatatactcncnttaaaaaattttgtttctgagacgggcctcaatttggtcgcccaagcttggaatgganggccatgaacttgggaaactggaaggtccggttccctggtgtaccgccttttttctgctaaacttccgggagagttgggatatccggtccgtgcaacacgcccctaaatggtgtcgatttcttaggcaaaaaacggtttcacacgcgttactcggaagggcttgattccccggacttagcctttcacaccttggcctctcaagaggtggggttacccggcgggccccacaaaaaatctattaaatcgacacttgtgggatcctgcgctttttatccctaaagacggttttagagattacacccccgccttaaaaaatggtgacacactctgtgaataatacctatgataacctgtgggcccctccccagtctttatatccacgtatatgtcgcccatcaagttacatgtcatcgcctttacgatgactacacacgcggcgtatatagtccggcgctcatatctactcacacgactgcgctgacgtactactatagcgcgcgcgcct

SEQ ID NO: 635941 - DNA, 137 bp, Homo sapiens
tttcgccagccaacaggatgatatgaagacttccctgaagaaagttgtgaaggagacctcctacgagatgatgatgcagtgtgtgtcccgcatgttaggcccacccccatgcatgtcacctcacatgcgctgcatgg

SEQ ID NO: 635942 - DNA, 284 bp, Homo sapiens
aaaacttcaccagcattaatttttttattcattaaaacaacaaaccttggccaggcgcagtggctcattcctataatcccagcactttgggaggccgaggtgggcggatcgtgaggtcaggagagatcgagacaatccgtggtagcgcggtgaagccccatctctactaaaaatacagaagattagccgggtgtggtcgcgtgcgcctgtggtcccagctgctgaggaggctgaggcgggggaatcgcttgaacccgggaggcggatgttgcagtgagccggga

SEQ ID NO: 635943 - DNA, 383 bp, Homo sapiens
tcagctgcgttaccggtgggagtacggaatgacaacaatgagccagtttttctagagaaagcacttttggtgtcaggaccagcacgtgcaaggcctgaggtgggaaagaggttggtgtgttcaagaaagaaggcaagactggcctgaacacagtgactaaggtggagagggttacacgcagaagccagaaagacaagaagttttgccccaaaaatggaaatctaagcactcttgcagtcataaaactggccatggaagtgccctggtgcccagagagatatgtcatttctgagcagtagtagggaattcttccagttacaaagtcgcttcctacttactcaggtaatagtcatagactcagagctggcagggagtgtagagtt

SEQ ID NO: 635944 - DNA, 375 bp, Homo sapiens
gtggaagaaaagaagcagctttacctacttgtttctttttgtctctcttcctggacactcactttttcagagacttaaacagtctctgcaatggagtgtgggtccaccttagcctcttaacttcctaatggagaagggtgtcaaccaggcaattttccttgggcctttaaaggattcgggacttatcctaaccaagcccccatttttttaaacaaggggtttttttggatgggtttaaaaatacttgaaaacttaggcccaccatttttatagatctcttaaaaattgaggccgtttcgaaagtttcggcgacaagaaaaaagtcgccctcgtgcgtagtttacaagattttgtggagtctttttaaaattgtta

SEQ ID NO: 635945 - DNA, 1163 bp, Homo sapiens
  misc_feature (1163)..(1163): n is a, c, g, or t
ggagaatgccagaaagtgttgtgcatggggaagctgagatcatccatgctgtggttatcaggaaactagaatgagatcctacagggcacgaggcaagaagggaactgatcgtgcgtgccgcagattgagctgctgcaactgcttggttcagattggcagcggaaaataatcctgtggagagggcgtcgagtggtcaagatcaagttcatatatcatcggccatcgtctctatgagctacgaacgcccaaccttggctagacgcgtacattgaagccagagatgtgggggaagtgcctggactgcatcaatgagcatgagtggatagtcctgtgtggcaaatcccaggcatgttagttgggagaggagatattctggaaggagaggtgagaagcctggcacagaggctgaggcaggcactgtgtggtccgtggggtggatcctaactctggtggaacgaatggatgaagaatttaccaaaataatgcagacatactgaccctcactcccaagagtacgtggagcacttgaacggatgatggcccaggtgtgtgccatcatcgagcgtgtgcaggctaactggaggagaagggcactaaccgaggaggtctgccgcatctagctgctgcgcatactgcacaactacctaccaagttgattacgagggcccatcagcgacaggtgacccggctgaggctcctcaaagtctggacaagaacagggcgaaaatgagggcgaaggaatcggatgaggctgatgggagaagactggtgcaaggtaaatttaagcccaaggaacggataacacgggaatcggacacatggtccacactatggcacaatttacccacaaggcccgtgacacgcgcgtggtacagcgcaggaaaccaggccataaccactgagtggaacagtaagattgaagcgcgcacgtgaaggaccttttaaaagggccaaggtggaaggtgattgagcatcgacagaggtaacgagagaaaagacctagagcaatatgtagcaagtatggaaggaggggagtgaacataacaagatagtaagaagaaggaggaatcaagaacctaagagtgtagtcagtggtgagtaaagagaagaaaaaatgtgagacgctgtctagatttgttgattaggtgtgtagttgtatatan

SEQ ID NO: 635946 - DNA, 203 bp, Homo sapiens
aaaaaacccaaggggggggggggcccccccttcccccccggggggggttaacccttttttaaaaccccggggggggaaaacccattttttttttttgggggtttctttttatttttgggccttgccctttttgttcccggtggggagggggggccctttttgtttttttggggccccccgggccccttttttttttttttcca

SEQ ID NO: 635947 - DNA, 348 bp, Homo sapiens
  misc_feature (342)..(342): n is a, c, g, or t
gcaactaaatagcaaaaagataaataagccaattttaagttgggcaaaatatttgaatagccattgcaccaaaaggtgtaggaatagctaataaagcacatgaaaagatggtcagtatcatcagtcagcagggaaatgcaaatcaaaactacaatgacacaccacttcttacccactagaatgctatgataaaaatgaaggacaataacaattgagggaagtgaaataacaatgatgtgggaaaaattggaaatacttcatggcattgttgatggggacatggcagccatgttggggaaaggcagtttgggcagtttctttaaaaacgtttggaaggatacnttttac

SEQ ID NO: 635948 - DNA, 878 bp, Homo sapiens
  misc_feature (1)..(1): n is a, c, g, or t
  misc_feature (76)..(76): n is a, c, g, or t
  misc_feature (113)..(113): n is a, c, g, or t
  misc_feature (126)..(126): n is a, c, g, or t
  misc_feature (130)..(130): n is a, c, g, or t
  misc_feature (203)..(203): n is a, c, g, or t
  misc_feature (248)..(248): n is a, c, g, or t
  misc_feature (326)..(326): n is a, c, g, or t
  misc_feature (328)..(328): n is a, c, g, or t
  misc_feature (331)..(331): n is a, c, g, or t
  misc_feature (354)..(354): n is a, c, g, or t
  misc_feature (470)..(470): n is a, c, g, or t
  misc_feature (557)..(557): n is a, c, g, or t
  misc_feature (579)..(579): n is a, c, g, or t
  misc_feature (613)..(613): n is a, c, g, or t
  misc_feature (634)..(634): n is a, c, g, or t
  misc_feature (643)..(643): n is a, c, g, or t
  misc_feature (662)..(662): n is a, c, g, or t
  misc_feature (668)..(668): n is a, c, g, or t
  misc_feature (685)..(685): n is a, c, g, or t
  misc_feature (695)..(695): n is a, c, g, or t
  misc_feature (706)..(706): n is a, c, g, or t
  misc_feature (750)..(750): n is a, c, g, or t
  misc_feature (771)..(771): n is a, c, g, or t
  misc_feature (773)..(773): n is a, c, g, or t
  misc_feature (776)..(776): n is a, c, g, or t
  misc_feature (778)..(778): n is a, c, g, or t
  misc_feature (805)..(805): n is a, c, g, or t
  misc_feature (809)..(809): n is a, c, g, or t
  misc_feature (869)..(869): n is a, c, g, or t
ntaattcctttgtttcttgccccctttagtgttttccccccacatttaattttcatttgctccccactcccttttntaaatagaatgcaaacaaccatcctgaagtgtctgangggcacctgcccncacntccctgccctccaaaatgcagactgagaagccaacagactgccttttcttttcttaatcaggtcactagttcnaaatatggtggcctggaggtcccatagaaaaagcaaaggggtgtnaacagtatgtataacagcgtatttacagggagtcacatgcggacaaaaagctacaatactgagtatcagacgacgcangnganaacaaagggccgggggtgggggnagagaaccccatgggcaaagaaaccccaggaaacgttaaactggtaaatcaatggcgagttaaggcttaaaaagtgtataaaaataacacagttaatattcaaaacggaactccanatacagaatatatagatgagtttctgtctagttttcttttttttcccggggggatgataggagggcttctctgggctctgtaaatanttcctatatacaccgacacgcntggctttcagattggggtgtgtctgtgggggctnggggcagggtctgctcctggnaactgcctncccggggatcccttccctncagagnggcctagggcctcggcngggggaatcncactccatagnagggaagacaaataacccctccctagggcactgcccccatctgngaggaaattctggagggaagncncananccaggcccactccctccccatcccccngccnacagtctgggtatggtgggagaggtagccgaaaggtttcctggccagcaccgaggtagantggggtggt

SEQ ID NO: 635949 - DNA, 932 bp, Homo sapiens
  misc_feature (70)..(70): n is a, c, g, or t
ggcttcagtagcgacaggggctgagaaagtggtgacaccgtcggaggtagcgagagtggagtccctgaanactttctcccaacagccccagggacatttcttccctcagtcccagcatctgcctcttcgctcagctcccaggatccccaactcctgataccgagggtgtggaggttggcgtgatgcactagtggccggtctcactcgcatgtggatccataacacgagggggtccgtggtagcggggtacgggagccacctcgaggacggggtgtggcactgagacacgactagaacaagtacgtggctgagcgtcagcacacgacccccatgcggtgacaagcgctgggagatgcaaggaatagtggggaatggccgcgcgcgcgattcccgaaagcggcgaagcctacctgaggagtacatggcggggtaagttatttactcatacttcctacatataatccgagagagagagggaaaagcgtcaacctccgacaacgccccgcgcaagggaagcatggaatctcaagaacgacgctaggattctctccactgcggccgtgccggagtgcagcttgctttctccaccagacacccacagacgataaaccgggctggggtcgaaccgaacaaccctggtggccctcccaaccttctaacacattcgtcgcttcgttttcctcgcagcccacgctacagagggcccccgggttagttccccgggtctaagagacttaatgtgccccaattcttaactggtttccttggaataggaacaagcgttcctggcccttcttattggaaagccaaggcggcagggcgcaatactggagccagccaaggcgtatcgttgggacacgggcgcaaaaggggcgccgggtaggaagaaccctttccatggaaaagcttcccggttggcccctgggggaccc

SEQ ID NO: 635950 - DNA, 122 bp, Homo sapiens
  misc_feature (103)..(103): n is a, c, g, or t
ctgcggattggcggacctgtggtgctgagcataagaggtcttccgtatctgattgtgcgttttagtaaaaccaacacagaacagacgaagcaagtaaccatcnggtagtcttgaccatcaag

SEQ ID NO: 635951 - DNA, 317 bp, Homo sapiens
  misc_feature (12)..(12): n is a, c, g, or t
tgtgcaactgcnttggcaagggcggcaagtgttagatgtagaagtactggcctaacaattttcaagtgactcttgacctagataagtggtttcgtgcatggccaatatgaatgtggctcccagcaactgcggcacagctactctcccatctggcagtctgatccatcctccttttattacttacctccctcctgcatggaaaaagtctttttcgtccgtagaataggtaggtaccaggtcaggtgtttaagggagtaagggggctgctaccaatgcccggtaaggggtagacgctgctttttgagcttttgaatcag

SEQ ID NO: 635952 - DNA, 182 bp, Homo sapiens
tgtcacagagggggcagactgtatgtggtcactgtcggcttcagccggacgtgggcaaagggatctaactctagtcaggcggctcagaatctggccacttccacatcggctgctgtcattggaccgcgctccaaagtcatccatggccctgggagaacggcgggcacggccacactggtagg

SEQ ID NO: 635953 - DNA, 221 bp, Homo sapiens
tacatgatacgactcgagctgagtaccctcgataaggggcccactcgtttagccaattaagttatttggaatggtgagttcatgggtggttgtgagtagatgcatccaaacttgcccaatagcctttcacctcgtggagagcgtggagtcaattcgcggcgaatccgggtcccggccgtgcatcatggttcaagtgaagactggttgtcttgccacctgtg

SEQ ID NO: 635954 - DNA, 161 bp, Homo sapiens
  misc_feature (62)..(62): n is a, c, g, or t
  misc_feature (146)..(146): n is a, c, g, or t
tgttaaatagaagattttaggccagatatggtggttcgcacctgtaaacctagcactttggnaggctgaggtgggagaatcgcttgagcccaggtagtcaaggctgcagtgagctctgtttgctccagtcctgggagagagaaatngagtgacaccctgcc

SEQ ID NO: 635955 - DNA, 155 bp, Homo sapiens
tcccgtctctactaaaaatacaaacttagctggtgattataggctgacgcatagtgcccgggtcaacttgtttatttacagattgtctatctaatatttttagaacatggatgactggtggtaactaaaactgcagaaagtgaaattgcagataa

SEQ ID NO: 635956 - DNA, 1628 bp, Homo sapiens
  misc_feature (574)..(574): n is a, c, g, or t
  misc_feature (845)..(845): n is a, c, g, or t
tagggccattctgggctccggggggccgcctctgggtcctccccgggggtggttggccggtggccgcgccctgtggtgtcatctggcgctggggcagttcccgggcgcggcctgggtgccccctataatctaatgtcgcgccggatatattggggaggtttcttacaaatatgggcgaaactattggagcaaacaaagaacatgttctgagaatcttgagatcacaaaattgtggagtagtgagagtgtgtgtgagaaagaagtgtataaaaataagaggagagaatgcgggtgagagaagaaaaacaatatatctctcaaagagcagtgtgacagtctaaatgtggtgtcacaagagtgtgagtggcgaaaatcctctcacagagtattctctgtggagagcgcctctatcatcaagagaaaagagatctgtgtgagtggtgtcgtctggtgtgaagacaaacaccacacacagcaggagagtaacacttgtgagagaagcgctctggcctctaagagagtgtgagtgtgtaacaagagacacagagagtgtgagagagggtgtctctctctnaaaaaacacgctgctggcgagaagttatacagtgtgggtgtccgcccgagatatagatggaagacgcccaaatattctctctatgtgagagagagagagtgtctccagcagaaactctctgtgataaagagggagaagattatgtgagcgggggtctctctctatatatcagacgcggctcttctatatgttgtgagagattaagcgcgagaaatgttgggaagaatattttatatttaaagggggcggaattttttattgtagaagaccnctattaacgggggaggaagcacacagatcgtgtgtgtggactgtggtggtggagacacccccatgtatttttgttgataggaaacgtaatgttggagagaatatattcgaggggaggggagaacattgtggtgaagacaaagaaacaactgtgcggcgcacaacaagatgttgtggctacactatctgttgtgacgaaaccaccgcgggggcgttctggactactgaaacaaacaaggagaaaaaagacctcccccccaaaagagggggggaagctcttcctcccggtgagacaaaatctgtggggggggcacaccgcggtgtggcgttccacaacgagacacgcgtggctgtgagaccgttgggtcccaccacgggggaacgatatggggggtgtgccccgcgaaaccccccgcggagtggtaaccccccttattttgtcggtgtgagggcaccctgttgtaacaagcgactacttcttaagtggggggcgagcaaggtttcccccccacggagtgtgtcgtgggcacacgcccattatgtatgaagtgtttggtgggtcgtcagagaatttttttccctcgtgtgtgaaccccccacttggtgtgagtttctttcttcttccctcactgtgtgatggctgtggtgggggcaccggacaccagttacgggcggggggaggtgggctgcacacccccccagtggtgatcattggtaggtcgccccctttttgtgggtgggggcccccaacaactatggtggtgggggtctcacggggggcgca

SEQ ID NO: 635957 - DNA, 211 bp, Homo sapiens
tacggcaagtatatcagagtctcgatcagcgtggtgtctcgggatctaatttcaaatcgttgtcttctgactacgcatagtagtttgtagagatgtccttgccggtatggtacgcttgttcgctttcatgattctctccatattgccagcacatccgtactggctggccaccaaagcacacggagattctagtacaggcgctgagacacca

SEQ ID NO: 635958 - DNA, 898 bp, Homo sapiens
gcagatttgtggtgcgtactgagtcgtcggtgctgcgcgcgggtgagtacggggacctggatctggctcgcgaggtgcgagacggcgggggcgggagggcgagaagccgtcttggccctcgctgatcttggggttccagccctccgccggctgcgcctgcttgtctggccggtttgcccttctctgaagggaggtagggcagggttcggtctgccagagggaagcatcgcctagaggctgtgccaggtgtccctccttggcctaaacgggctcaggtgcacctgagattgctccgcacggttattgacagggagacgtacctatgggcttgagcaggttcagtctggcctaacccaggaggctacgcagagatttggaggacagccacgcagtaccaagcccatagaatcgtctgggactcgcacatgcacaagtcccgttctctctcttgttataactgcaagttgtcctttgcgccggagcattctgccctccacgttatgctgtacatgacaacttgggtgaggcaacagggaagctgaaaagagatcatacggtgctgaatgaaattgtatggaactcgcgggtcagacatttcccaatttccagtgtcagatgcttcaaagtattattaaaaacgtatggatccccatgaagccttactacaccaaagttttaacaggagatttggataggaatggggttgatggggttcatcgtttataaaattcgggcgtggtgataaaagaaagtaggttggaagcttcgggctggtcctggtcttcataaacagattactggggtccatttgaagaaagtgctgccgtaaatcagcagcggtaatggagcgggacgtctgccctgttagcggaactaggggataggttgggtggaaaaa

SEQ ID NO: 635959 - DNA, 526 bp, Homo sapiens
ggacgcgtgggtatgaccctggtcatcgtggtgtggagcgtggccgcctcatctggccggtgccatcatcgccggcttcctgcccaacggatggaacagcgccggacaccgcagacaccgagcacccccgcgagtgcccgaggaccaccgagcgcgcgcgcgcgatgcgcgcgcgggcgtattggggtggacaagtgacccgctccgctcctcctgtgtccgtcctgtgtccgcgcgcgcggatgcctttcccgcggggactcggcggtgtgcttcggctgtagtatcgtaagtcctctttcccgagatggggccgccgagagaccccaggctttgaaaaagcaaggttggtgctgcacttcagtttccgaaaagcagatgttcaagcccattgcatagagggtgaggatcgacagctccgaagacggcgaggagggacaatgggggccttcccccttctagtgcattcccctgacacgataccttctcagaacccacttgcccaaattcatgccgatccatgacc

SEQ ID NO: 635960 - DNA, 196 bp, Homo sapiens
taaccatagaggatcccccacgtatgttgatggtttccttaggtgcaggtgggcagcagagatggccctgaaccctccactcagtcttggatgagaaagtcggggtctcatagttgctggtggtggaggtgatgatctcatcgcgcatgcttgtaggacaggtgcgagtctagtgtggccggtcagctagcgcatg

SEQ ID NO: 635961 - DNA, 214 bp, Homo sapiens
  misc_feature (97)..(97): n is a, c, g, or t
gaccttcagagggaaaatcagatgtccaaacgacttttaacaaacgcataaagaggtttatttgggtacatggaccgcagtggttattgcacaaganagggaaaggaacacgcgggtagatgatttctagcaggcaggaagtcctgtgaggtgtcaacatgagcacctccagctgtactagtgacattggaataataaatttgataaggtggtg

SEQ ID NO: 635962 - DNA, 376 bp, Homo sapiens
aggcgtggtgcacaagcctgaagtcccagctacttcgggatgctgaggcaggagcatcgcttggaacctgggaggcggaggctgcagtaagccgagaacgcgccactgcactccagcttgggcaacagaccgagactctgtctcataacaaaaccaaacacacacacacacacacacacacacacacactcaaaacaagatatatataactggtttcaaagaagaggccaggccatgtgcggtcgctcacgcctgtactcccaacactatgggaggcggacgcaggagaatcacttgaccccaggaggcagaggttgtggtgagctgagatcacgccattgcagtccaggttgggcaacaagagcaaaactccatc

SEQ ID NO: 635963 - DNA, 147 bp, Homo sapiens
tactccttccagctccttttcacttcttttgtttattagagtatagactggatcttactatgtttctcagactggtttcaaactcctagagctcacagtcaatcttccctgtggagactccaccctccggggtaccgatgctcgaca

SEQ ID NO: 635964 - DNA, 482 bp, Homo sapiens
tatcgttgatcctaagctgtttctagggtcaactccataggagatttctcttttataccttcttcactggcccgtctcgagcaagaccgtagtcaccatatcctgttttcattcattgatctacgatcaacaatacagtattttataaatgtatttatgctgctagactgtgggtcaaatgttcccattttcaaattatttagaattcttatgagtttaaaatttgtaaatttctaaatccaatcatgtaaaatgaaactgtggctccattggagtagtctcccacctaaatatcaagatggctatatgctaaaaagagacaatatggtcaagtctaaaatggctaattgtcctatgatgctattatcatagactaatgacatttatcttcaaaacaccaaattgtctttagaaaaattaatgtgattacaggtagaggccttctaggtgagacacttttaaggtacactgcatttggcaaa

SEQ ID NO: 635965 - DNA, 159 bp, Homo sapiens
tagcatcttatttgcttctgcatgccgctggccccaatacaaactcgacagtagttccaatagccagaacacagcactttcaatttttccaccctgcagatctaaatattctgtcataaaataagcaaacggtctgaggtgcctgacaagaattattta

SEQ ID NO: 635966 - DNA, 188 bp, Homo sapiens
cctggtacgggagtggctgtgtgtctggcactgtgctcatagtggaatagaacatatcaagactcaagtgagggccgacatttcacctctcttaaggtctctctgcattttttttttttttttttttttttttttttttttttttttttttttttttttttttttttttttttttttttttttttttt

SEQ ID NO: 635967 - DNA, 124 bp, Homo sapiens
caggtcgatcacttcaggtaacgagttcgagaccagcccggccaatgtggcgaaatcccgtctctaccacgaataccaaacttagccgggtatggtggtgctcggctgcaatctagcctggaac

SEQ ID NO: 635968 - DNA, 325 bp, Homo sapiens
  misc_feature (321)..(321): n is a, c, g, or t
tttggaggaggcatgaagcaggaagacaatgcaataattgaaatctctctgaaactggccaacatctatgctgctcagaataaacaggaatttgcccttgctggctatgaattctgcatttcaactctagaggggaaaattgaaagagaaaaggaattagcagaagatattatgtcagaagaaacagccaatacttacctcctccttggtatgtgcttagactcttgtgcacgctatctgctattctccaagcagctatcacaggcacaaagggatgtattgaaaaaagccctgcaagatttgtcaaggaattccaagggngaaa

SEQ ID NO: 635969 - DNA, 673 bp, Homo sapiens
  misc_feature (75)..(75): n is a, c, g, or t
  misc_feature (77)..(77): n is a, c, g, or t
  misc_feature (642)..(642): n is a, c, g, or t
acagtctggtgattatgctatcctatgccatgcacttcctgcctccaacaaaaaacagcttggggagtggtggcngnggtggggatcctagatgtgcctaatacatcctctgcttccacttaccagaatgatagtggcttccctaaaactgcattggctctccagctgcctacaaagtagtcagattcccaagcagtagtagaaaagtacagaacggaaattcttcctcattcatcatgtacttgtcatattccattgtggcaccctaagtcccttttactgtgtttattttctcttggattctgtgcttgggctggaagataaaggggtgggaggaatgtctgttactacctggaataaggcttgtctttaatccactagcattcagaagtacccccaggaagcatcctctgctcaccatagaaagttttcagaaactcttgagagtctgattatatactagattggaacaaagaagctagtaagaattaatgaagtcacctctgggaacattgcctctgaaaaactgtaagtaattgcgcatttgccaggaaggcaaggaattccaaggcagcggagatctgaggagcattctccagcagtcctcaggtgctgtggtgcttaccagagctctgtccaggnataggaaaggaacgagaagcggcgaaggtac

SEQ ID NO: 635970 - DNA, 295 bp, Homo sapiens
aacagcagccaaatcatgaatagttagccaagaagaaggtcttaaaggtaccaagaaaaggaccaaaaaaattggggtttgaaatcccagtgcgcaaaccataaacttctttctcaaaaccatagagaattttggaaaactcaagaagataaatttgtggcacagtaagtcacattctttcaagcatacttgtaaaatgtttccttaaagtgttcttggaataaaaatgattgtcatgtctccaaccacagtaaactaatggtgctccgtgaaataaaagtcatatccccccttt

SEQ ID NO: 635971 - DNA, 119 bp, Homo sapiens
  misc_feature (49)..(49): n is a, c, g, or t
ggacccgcggtttgtcttacgccctggcccagtgtggtgttctgcaagngatcacattgcagcaactgaagctgtaggttacagctaaggctcatattcaatccctggtcctggaactt

SEQ ID NO: 635972 - DNA, 1459 bp, Homo sapiens
caaagccgcctgggctgctgcgcccagagccagcctggatgcctggagcctggatgccctgaacttgcatgctccatgccccatgcctgtgctgtgatgcctgcatgcccatgtgcctgtgtggcctgtgctgtgtgtgatcactgtgaacatgctggtggctgtgtgctgtgctggctgcttgccctgggatgtgctgtggccctcccttgatttctcggtgtgccgtccccatgtgattggacgcagccttgacgtgcaccaggacctcaggtgcccttgggtgtggcacactgtgcctaacttgacttgaccacttcacatgcgtggctatgcaccttgcgtggctaccttgcatggcataccaatcccccagtgccactggccaacatcgggggctacgtgtaccaagtgtgcccggatggcaacgagaccagcgccaacaacccctcattggtgaggcctcgacacgccgactcatggcttttccaagactggtggtggcagcctgatacaaaagctaggacaggtagtggtgcccctggttacctatccgacgttgggattgtgcaagacacatgtgttgaccatttttcagcacaagcgcaggaccctaccatcagaacacggttgcagtggtgctcccggtggacattgccacggaaaccaagactccccttggtgaattccccgtgaaatccattgtgagatttaagacggttatcatagtcagcaagagaccgtacgtggcatgacatgtgcagagcccacgggattgtatagaaggggacagaatagaaagttacaaaggacaatcagtgacaaacacagacaaagatttatgagtgtaacacaggtagagtcaagatactttggggcataccgctgaagaaggagcgaacattatgggataagttcggtcacgcattacccagattgagtttacaggaaccgtggattgttggtcacaaagcggtggtgggcatccatattgaagattgggagatggattgggaggatgtgggacacagagaagatatacgtgggaccggtcacagtttaacacaggaggaccccaggtcacgcggaacaaaccaaccaacaggacccaacggaacgaaggggaccacaactggatgcaacgtcgagcatgcgatggaaccacatggagacaacacactactgtgctccatccaactgcgagaacccaccaaggtggcgacagcacccgaggacagataccagagatacgaatacagaacgaaccccgacgaaaggaagagagacactgaaggacacagaaaggacgaagaacaccagggagccgagcaaacagggaggaacatgaaagcaaagcaacaggagaaaaacaaagaaaaggcaaggaaaaaggaacagaggacgaagcacaacgagccgatatcacgacagacaaagaacgaacgacgacaacgccgtg

SEQ ID NO: 635973 - DNA, 400 bp, Homo sapiens
acatggttacaattactatttccaaaagatgggaatattttgcttgcacgtagagaagtcagctacagggaatggtggccatgcagaagactctgccatagaaggataattttatatcactttatgagaattattgctctgagtcaggagactttattgccatcaaagcatagcctgtcagggatggtgccattagtcattgaagtgtggtttatcccagggcagtctggtttataatgtaaacacctctatcttcatatttcatatttcatctgggggcacaatttaaactgattgatggacacaggaaaaatactttaattctgagaaagcttaataaaaaatcaaggtaaaatcccccatcaataaaacatctactgaaatgacaagaaaaaaaaaa

SEQ ID NO: 635974 - DNA, 438 bp, Homo sapiens
  misc_feature (154)..(154): n is a, c, g, or t
  misc_feature (326)..(327): n is a, c, g, or t
gccgcatgcaggtgggcccatctaagcaatttggaccacccatggctgggcttggtcagcctctaagatggacagggatctcataagaattcaagtaaggaattgtgagtaaagacaattaaaatttaaagaggaattttaattacagtttccntgagtttcggaaatctagttccaatgacagatactgggaatgtcagcgcaaggagtttgtgtcatcacatccttagtataccaccatttaagcattttttaagttcctcgtgtcgtgtttgttcaggtgggccttcctcattggttgactcaacgctttaactttacctccnntagcttagtctgcattcgtgcttcccgcattcaattttcaagctattcatacattaaattgttggcttgttgccccaagtgtatgacgatagtgcccactatgctttagcg

SEQ ID NO: 635975 - DNA, 179 bp, Homo sapiens
gaggattccccacccgatagagcatggatggtggcaatcaaagaggcatagggaatgccccctcaggcatttgatacagcattcaaaatcaccctatttctgtgtctgattcgatcatcacccattcttggagttaccgatgctcgaatttctgctaatacatggatcagtagactgct

SEQ ID NO: 635976 - DNA, 2089 bp, Homo sapiens
tctcttgcttgtattatttgggaacatcatttaaaaggactgtataatattccattaagtagatggaccatcatttatttaacatgctttggtctttaccccttgaaggcaaggcatatcctcctttccctattaacccattatggttcagtcatccgtgaagttggctaagcttttgaatttaaattttctgtctgcactgtctctttgaggtaatggtatgccagttgctgtgtgaaatgaaacttctttttatttgctttaaactttattaattcaagctttagctaggcatcttgttcttattcggctttagtttgataaaaaaaaaaagttgtgtttatcttcccctgcctggtcttgcagctttggtcctagggcctcccttccttctttcgaaacagatgccactgtggatggtaggttccacaagcatggccctgtccactcatcacagatgtgactcgagcagcttctggagctgcgctctagagggcattcaggtggatgtttccccacctgcaaggtgggatgtttgctggacagataacaagatttgcctgtttttttccccttcccatcacatctatttccttatccctttggtgacccagggtgccctgttggctggatcttaggaactggttgtctcacactttcacctgccccctgcctgtgtctttccccttcctgacttctgttgacctcctgttcccactctactggtctctccctcacagtgctgtcactgcagctatgctcctggcttcccctcaccgagtgagtttttgtgaccttcgcactgtattcatgctttgggacttactgctgtaatgatgtcagtggcggaggttagcagatggcggcagcagcaatgagacctgacatgttctaatgactccctccttcctacccttgctggctgagccaatggagggacagaggtttccttgaggtatttaaggagggggccaagggaaatcggggggcccccaggtgccaatgaggcctgtgacctttgctgctataatatcagtgtttcacaagcagggcggttcgggagcccacttgcagcccatcaaaaattgatttaattgcaatttttcctccaattaggagcactggagcctgactaattggagtaatagagagtaataaggctcagataaaaagccttcctcggctgcctttgtatctcgtgtcagtgcctgtcagaggtcagagagcttgcatattctattaggcagcctggccttcatttgtacaaattagtttacccaacagtaattaaaatgccaatgcgggttgaagagaactgaatacacttgatgggcatgttggtgaacgatgtgacagctctggtggcctcccttgccaaagtgtgtcagcccaggctcagaggctgctggggcctgggccagctgggcggctctaggccagccacggggcacagctgctgagcacgccacttgtgctgccctgcctcagagccactcagttgcttctttcttcttccaggtggagtcatttgttcatttgtccattcattcattcattcaatcaataagcatttgagttttcaatatgtgtcaggcattatactagatgctggagattcaaacaagactaactcttgaagtgtagcccacatgagaacttctgggcgaggggtggtataataacttgggtctggaatcaagactgactgggttccaattccagtccactagttgctacctgtgtgagctagagcaaattaattacctcccaaagcctcagtctcctcatgtgtaaaatagggaaagtggggctgggtgcggtggctcatgcgtctaatcccagaactttgcgaggccaaggtaggtggatcacttgaggtcaggagttcgagaccagcctggccaacctggggaaaccctctctctactaaaaatacaaaaattagccaggcgtggtggtgcgcacctgttaactcagctactgggggtgctgaggcaggagaatggcatgaacctgggagatagaggttgcatgagctgagattgcaccactgcactccagcctgggcgacagagcaagactctgtctc

SEQ ID NO: 635977 - DNA, 2008 bp, Homo sapiens
ctgtgttgttgtttgtgctttctgggtcgttgtggtggttttgtctgtgtttttgttgttttgtctttgtgtcggtctggtttgtttgatctacgtcttggttagtctgttggtttcttgtgttgctttcgtttagttttgtttctctctctctgtgtcgttcgtcgttgctttcggttgcttgctgtgtttcgtcgttgtgttggttcgtttttgtatgttgggggagcagctagagatggccccggatacctcgtggtcatgccacgcgggcgggcgccctttttgttttcgtcgaggggacctcaccttgcgtgtctcacaaagcacgcggggtttttttctcccccgtccccttcttttttctcgtctgtcttcaatggttgtatcagctctctctcgggggtggcaatgtttcctcgccacgacggtgaatctctgtggtgcgaagcactcaacgaaaagagggggggggtagtctactctctgtcgcgtcgccacctcgctggtcttctggggtgatggtgtctcgccacagagaccacagcggaacatcatttatttgtgagggggagactacccctctcccccgggtcgacttttctccccgtctaatgtttttgtgcccgtgtcgtctgttttccgaccaccgtgggggggaccccactaaggttggtcgtctctcttcgcttttcctcacccctgctcagcagcccggcttgttagctgtcgggggtgcttttttctttttggcgcaacgtctcttttttggtggggggggtggcgctcccttctcctgtagagttggcggttgctcgtgccgcaccccaacagctgttggttagcgtttatgtactattggggcgtgtcggaacgccaccacgggggtgggtcgttctcctcctgtgtgggggcaggtcttctcttttgggtgtgcgccacacggtgatagtagtatacctcttgcggggcgcacaacacagcacagatgttgtggcgtagaagcagaccctgtgctcttttgtttctcccgtaatatatgtggggcgcgccactcttctctcatcttcttgggagactcttctcacacgggggttctatgtttggatgcattcttctatcgtgttgcgctctcttggtggggcacgcagctcgctcctcttgggggtgttttttatcgcctcagtagagaggggccgcccctccttattatgtgttgttgtcttgtaggtgcgtttctccctcgtcgcgcgcccacaatggagtgtatgacttcacacacactctttgctcgccgacgctcacgtcgagtgcggcgcacaacgctggactcatctctcttgtggggagagacatcactcttccaccacttcgtggcgggccgcgcgcagtggggccctactcttcgttgagactcaccgccgcgcaccactctcgtgggtggagatgtgagacagattatatatctctctcgttgttttgtctagtagactctctctctgcgagctgttcttctgttgggggagagattgtagagtatctcatctctctctcgtgggtgtcgtctcattgtctcagcacgcgataatatatatcatgggggagtgctctcgtggaggagccaatataaggagctatctggggagctctctcactcccccacacgcgcccatattgggcgcgcgctaatatataagacaccacccacccgcggcacgagaaaccccaactcttcttcctctctatattttctctatggagaaatgataagaatagtttcccgctgggagaagagtcacatctgtgaacaacctgtgtgagttaagggagacacacgaacctcccccccccgctgtcgttctttgcacccacacgcgccgccgatataatgacgcgggctcatcttctccccgcgggagccacgaggggttgaaaattaggagaactctcttttttggttgggtttaaaaaaaaaaataaaacaattaagacgaacaaggaaaaagta

SEQ ID NO: 635978 - DNA, 99 bp, Homo sapiens
tcaagcttctaacgatgtacggggacatgagacgcaactagttggtgcataagaaggccccacttggctatttcatatctacctacaattgaccaaaaa

SEQ ID NO: 635979 - DNA, 87 bp, Homo sapiens
gcggccgcctactactactactgctcgaattcaagcttctaacgatgtacggggacatggaaatatatgatgtgctaccaaatgtgc

SEQ ID NO: 635980 - DNA, 1856 bp, Homo sapiens
agcccagatagagtatgtgtttgctagcgctgaatctgtacacagacatcatcaacatcttcctgtacatcctacaccaatcattggtcctgcggccaacggcagtacgaccgaagctccagctcagacatagtatgcccgctacaggtgagcacggttaggcactaggacccctagaacacctaggacatcggaatgatggccacgtcgtagtacctatcactccatactcatcattgatcactcctagtgctagcagcccgtgatgtgcgaaaacagggatcgcactcgtcatcgcgaaaccgcataccttgatattgatacatcatgccatgcatagcgtattcccaattgttgagcagccccagtctggatgagtacgaacaaagacacatgggacacgcattgtatagattacccatacaccctgagacccctcagtcacaacatgggcgagacgagcgcataggggtcacagcgttgtttaccagttttgcccaatacatcacatggttacataagcatcaattctagcttttgacattggatgacgctccgtgatacatggcgccaagaacacgaacatcctctaggggggacctagagcgagagacacggccaaacccaacggttcaccccgtgcgggttcagacaagtgcgacatgtcgtaggaccccaagagacacgcggatcgcacaggggtttagaccaaccgatcattatacgccctttcacttggatagtcattagatactcgcccacaacgacaacttggacaccgacttcggaactaaaacaaacgaccatacactgagcgtccccacaacatcagaacaccgcaacacaaccatcacataccgaaaagacataacagcaccaccaccattgacgccaacacacacactcacacgagcaaactagcacgaacagcacccaaaaaacacaggccaccctataaacacaactaaagcgaaacaccacaaacaagcggcaaggaccagcaaacagaaacacagacaacacacagacacaacacaaccgagacacaacgcacaggcagcaacccacgcccaaccacacagacgcacgcgagcacatcacagccgcacgtacgaacaacacgtacacgccagacaacacacagacacgcagacacacacgatagcataacgctcactacaaccctcgaccatcaacaacaccacacaccacagcacccacaccaacagaccaccaaataacggaccacacactccaccagcacgatacacacacaacatcaatcaggaccgacacactaaacacagacaagactgcaccacgaccaacgaatctaacagccgccctcacatacaaacactgaacatccaaacagcaacttaccaacgcaccacgaccaaacacacaacaacctgaccgactacgcacaaacaagaaagacgaaacgccatgacacgcagcccaacacacaacaaccaaaaagtaaaacaaaatagaacctacaatcaacaaacacaaaacacaccaccacagaactgtacacgaagcaacaacaacccaaacctcaacaaaaccacataagcagaacatcaaaatatagcgggcatacaaaacatacttcaacaccccacaacatgtacagaaccgatgcaacaccacacacatagcacagccacaccacaccacctaccatatataactaacaccagcagcaccgaaccaccacaacgacaaacaaaacaccaagaagacgaaacaaccaccacacgtaccacgacagaaaaagcagataacaacatacacagcaaaaatgcaacaaacaaacactaccaaacgacacatcagagcacaagcac

SEQ ID NO: 635981 - DNA, 332 bp, Homo sapiens
actcttctgttaccaaacagcgcctcaaccgattttgtcaccagtgagtacttctactacgtgctgatcggggctagatatctagaagttacgactagtgacactatggaggcccaacgggaaagtggagtattcagttcatgaatactttattctacagagagcagattctaggggtacttgggaagattctctagtatctatcctagtattctcagaccactaatgggatttctggtactatataaactatataaactatatctagtatgcaataccgtgtagagtctcccagtaaaatactgctcatagggaacaagaactaactaggg

SEQ ID NO: 635982 - DNA, 423 bp, Homo sapiens
tctgtactgaggaggagctgatctgtgtctggtcttctctctaaactctcctcggattagtcagacccaccatgaactggctgcaggttcactcttcaggatctgcttttattgcaccgaattttggtgagatgccatcagcccgcactgaggagctttagaacagcctgtgaaactcggtggtgtatactgtgagggtgtcactgacagcattcattgcatcacagagtgtcctctccatggggccccatgggaagcgtttgcctcatgcttccatagcagggacagccaggcttctctgagtaatcgctttgtatgtcctgtggaccccgtgacccgtgtaactgatcaggttttcctcatccattgactgctataaaattgagctccaaatgcatggctaaaacaactgaatttctatgg

SEQ ID NO: 635983 - DNA, 252 bp, Homo sapiens
catgttggccagcacgatggtcggcgtgatcggcgtcaacggcggcaccggcatgtcatcgagtaccgcggcacgaacgatccgcgcgatggacatggaacaacgcatgaccctgtgcaacatgagcatcgaggccggcgcgcgcttgggcatggttgcgccggacgaggtcaccttcgactacgtgcgcaggacgccgtacgcaccgaaggatttcgacgccgcggtggcaaagtgaaagcagctggtacc

SEQ ID NO: 635984 - DNA, 160 bp, Homo sapiens
cgggcgactctagaggacccctataggcgctaggtgaaatagacaaattcctagaaagaaagaaactgccaacaccgactcgtgaagaaatagaaaatctgactagacctataagagagaattagtaatcaaaaacctttccgcaaagaaaagcccagca

SEQ ID NO: 635985 - DNA, 231 bp, Homo sapiens
ggacagtatccatggcacatctattctacaaatgtccatctatccagttggacatctgtcctacagatagttgatatatgtgtctgaagttctcagaatattccaaggctagaaatatttatttgggagttatgtgtgtaagtgatagttcatatcttaagactacatagcaaatagccaagaaggaaggtaaacattgatttgtaaaagattgtggacggttggacacag

SEQ ID NO: 635986 - DNA, 174 bp, Homo sapiens
cggcacgaggccagctgcgggtctcaaagccagcacagatcacaagagcaaggccagcagctcctccagggaagagcaaaacgctgccttggaaacacattttaattgatgaaaggattctttgttttagccgctgatggcagtgcaagtgaacttcagggctaaaaaaaaaaa

SEQ ID NO: 635987 - DNA, 178 bp, Homo sapiens
gtggctgtggtagcactgttcaaccgtgttcctgctccgtcctccactatagcagatgcgatgcgcggagtaggagagagggaggtaagagtcagaagctaatgtagtatatgcggggaaacgccgatatcggtggtgcaccgatttcatataggggcaactatgtcagttgccaaag

SEQ ID NO: 635988 - DNA, 219 bp, Homo sapiens
ggtcgactggctctggaaaactgctttattcacattaaaatgtacgaagctcagcagtttgcatttaatgtgcaagccttagagcctcactctggggtgtatcatcctcaatttaggatcactttttaggaatatgatgcttttttgcctcattcctttcaaaagtgttcattatatgtcctaaaaattcttacctctgaaatgattttgatttcttcc

SEQ ID NO: 635989 - DNA, 517 bp, Homo sapiens
cctcgctgcgtcgcataatcgactgactgcattattcatcctaagtaaatattcatggatcatccttctgttctagggggcgtactagtatgccgaggagatacagataactaagatattgaagtccttgtggtcatggagctatgacgtgtagtgagtgggaaagacatttcagtacacaagtaaacatatcaatagatgagatcaagatagtgctgtgagctcggaaggatataatggtgatgtaaaagagagagtaacagggacctgagaggttagagaaggcctctgagaatgacgtatgaactgtgagctcaaggatgagaagaagccgttaatgtgcagatttggggaaagttcctttctggacaaagggaacagctgtcaaagctcctgagggtaggaaaagagcttgacatgcagaacggacacctaggaagtcatcattgttagaatgtagggagcaagggggtgtcgggggtggaggatggtggcacaactttgggataaggtatgg

SEQ ID NO: 635990 - DNA, 414 bp, Homo sapiens
  misc_feature (22)..(22): n is a, c, g, or t
  misc_feature (34)..(34): n is a, c, g, or t
  misc_feature (66)..(66): n is a, c, g, or t
  misc_feature (123)..(123): n is a, c, g, or t
  misc_feature (146)..(146): n is a, c, g, or t
  misc_feature (410)..(410): n is a, c, g, or t
aaaacccccctggctgtaagtnaccccttagccnaggcccatggaggccccccattgcttccaagntcctgctgggccccccagggcccctctctatttcatcaacatgaatgaaatcagtcnagagacaatattggccgggtgcnggtgctcacgcctgtaatcccagcactttgggaggccaaggcgggtagatcacttgaggttgggagttcgagaccatcctgaccaacggagaaaccctgtctctactaaaaatacaaaattagccaggcgtggtggcacatgccggtcatcctagctactcaggaggctgaggcaggagaatcgcttgaacccaggaggcaaggttgcagtgagccgaggtcatgccattgcactctagcctgggcaacaagagtgaaactccnactc

SEQ ID NO: 635991 - DNA, 168 bp, Homo sapiens
  misc_feature (145)..(145): n is a, c, g, or t
gcgcccagagacagactagagagcagtacagagacccagagagagtgcgggacagagacccagagagagagggagacagagacccagagagagagggacacggagacagagggcgacagagaccaagagacgctaagagaacgtnaccccctcagagagaagatagca

SEQ ID NO: 635992 - DNA, 459 bp, Homo sapiens
  misc_feature (459)..(459): n is a, c, g, or t
agcccgaagatgaccgccttcatgccgaggtgtcttgctccggatcctatagtgagttcgagctacactatatgtttgacctggaggctagccagacaactacaatgactgagttgtactaagagtttgcagtaaagaaggaacgagctacatacctagaataggtctgtgactgcgttacgttcatccgacatgaaagctgactgactcctgatcgcatagaggatggactcattggcccttcccaacatgactctcagcaagtgctggccgatccatcgattgggctgcactgagatcacgacgccttaaaatgcagagtgtgcctgccgcagggaccatgggactatgtcacagcccatgatagttcaaagttgtcgagacaagtaaccaggatcctgatgaatggaagacactgcataagacttggatgatttgcgcacggaggcgtggggttcn

SEQ ID NO: 635993 - DNA, 886 bp, Homo sapiens
agcgtgcctatcggcatggctcttaaagagagacagcattaatttttgaatcgcgttgtggcggccggccaggcgagagaatggcggtatttgtgagaggagtcgagacgtaccgaacgagagtggtaactacctagtgggctctactgagagtgctgatatagaatgaatacaaatcatgtgctgaacacatgagtgtattaacatccactactggtgacggcactagcttggctagactcttccatttgtgaccttctaaagttactgagattgccaaggaaaacttaattattggatctacttcatatgctagaagaagaagatgtcctcagattgaaatcatagagtgaatatcggtttcaggaacgtgtggaccaattacaggacgtaacttatatataagcctttaataggacattagaggtggcctttgtataaggattggagtcatgatggacgaacttcgatatggtttggcacttctccggaacttttgacacctgtatttgtagtcacggacttatccggattcctgtcttgtaactgtagctctacaaaggcttgacttgtaagagattatgtggcgaccaagacagctcgtactgacaacttcggttcaacagctaatggcaagacgctcgtttggacgatgtgtgcatgagtcgccccggtgagtctttgtgccgaggttctgaattgaattcctagttcctactgaatgttaacttgcgattcgtactgcaaacacacgaaaccaaagaactcaagcttggtggaactttgcgcctccaatcatgtggtgtggaaggccttgcgcaaagagaccctcaaagcccacacagtccacaaagagtgggcaggaaattaggcatcgagggggacg

SEQ ID NO: 635994 - DNA, 440 bp, Homo sapiens
  misc_feature (42)..(42): n is a, c, g, or t
ggagagtactggagcctgcaaatgcattgtgtttgctctggnggtggtgggcatggggtctgttcggagatgtggaggggttagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctgggtttttctggaatgaataccctcatatctgtcctgatgtgatatgtctgagactgaatgcgggaggttcaatgtgaagctgtgtgtggggtcaaagt

SEQ ID NO: 635995 - DNA, 989 bp, Homo sapiens
ggtctgatgcttgacgtattatctgagcttttatagcatatctctaggaacgtgacagtcgatgtgaggtctcgtgatccgatgtcagtgtgctgttctggtcggtcggtacggcgtggtaggtatactcaggtccatcagtacgactaagcggtggacgtatcagtggagttgcatgagaacggaataagctatggcttaatctcgtagcgcatcccagtgaatgattggactccttggagcggttatattagacaatgcgtgtaaggctataggctcttgcgatgtggaatagcctgctcacgcttatactccatgctgcgaatcctaagttctgatggatcttctcgatgaaacaaatttctcctgtatccaatatgaggatttgacaccaggtcaagcgcagtggtaggatcaagcgacagaaggcgctgatgaagagtacaatacgactcagtaccacccccatgtactcttgggagagctgctgctatgccctattggtgactttttcgtcccatcaagcttatggctcgacttgcgaggctgtagatggacggagttccatggtagaccaagcttgcacatggactgggtagatggaacactcatggtcgcgtagaaacgtatcttgcagtatacccatgaaatcagaacacgctagatttatagtcgcttagtcccaagctatatactgatactccttcgtggtaatagggcagcgacagagaagcgcgaaaccaagtgtaaacatcaagcccccgttgacgttatccattaccgttgcatgtgggtggacgtcaccaaatttacgcttggggtgccacgaaagcgccaagggtgagcttgcgtgtaggaattacatgaacgtgtaattgtccggggaaattgacgtccagttcctttttggggggttggcaagcaagattttgttcggacggaacttctttgcatggacggggattcgcagcttaaccataacgaacaat

SEQ ID NO: 635996 - DNA, 429 bp, Homo sapiens
cgtggttgtcctaggacgttcgttgtacgcgcactgtgttgatagtgagaccccgattcctatgtgggccacgtttgaatcgtgggagtccgcatgtgtattgattgctcatggtttcccccgcagtcttggcccccacctttcccgtgtgcgatctctggagctggatgactggcctcctttgcacaggaaggtcatgtcatctattgtcaatgacctaacaaacagcatctgggaagggagcagccaggggcagacaaaaccctcagaaaagtccacgagggaagagaaggaacagtggatccgttccaaatatgaggagaagctctttctggccccactaccctgcactgagctgtccctgggccagcagctgctgcgggccaccgctgatgaggacctgcagacagccatcctgctgctggcaca

SEQ ID NO: 635997 - DNA, 322 bp, Homo sapiens
  misc_feature (97)..(97): n is a, c, g, or t
  misc_feature (120)..(120): n is a, c, g, or t
  misc_feature (161)..(161): n is a, c, g, or t
gggcaattttttgcacccccccccggggccccaaaaagcatgggttgtaagggggttcctccccttggcccccagcttgggcaaccccgggccgggntgccacccctttgtttctaaggngggggacccagttggtttccccttgttttttcccccggcangggggggtttaagggggcccccaccctggtcaaaaaccccagatttttttggtccctccccccttgggggccctgaagtccttgggccagttttccaggaagggggggtttcccatttttgggtttttttggggaaaaaaaacatgatttttgtttcccta

SEQ ID NO: 635998 - DNA, 141 bp, Homo sapiens
gtatacgtcgaggggtaagaacgtaagaagaaggcactgaccgacttacaagaagctgcgggcctactttgtggaggaggatggagcattccctgcaggaaagctgacaaggaggaggagctcctctgaagtactagctgg

SEQ ID NO: 635999 - DNA, 180 bp, Homo sapiens
taaatctggccacatcttctacaattgagctgcgtgtggctcccgaggagcaccccgtgctgctgaccgaggccccccgtgaacccctagggcaaccgcgaggcaagatgaccctacgatcaggtttgagcacctatcgacacccctgtcgcatgtatcgttgcttatccatggctcgtg

SEQ ID NO: 636000 - DNA, 1667 bp, Homo sapiens
  misc_feature (718)..(718): n is a, c, g, or t
  misc_feature (1406)..(1406): n is a, c, g, or t
tctgttcgctgcgaagtatcagcatgttgctgtgggggcgccccctctttagctgtgtctgcggcgcgggtttgatggataggaccacacatgggggggggggttattattgctccccctcgttcgttgatggtggcgagtcgcgctcacttgcttcttttttagactgctgccccccaacagctgggttgtttgttgtcgccgcccgccccgacgaagtaatgatgtgtttcgtcgtgccctcgttcgtcgaactacaacaaggcggctgtgcttctattaattgtatgtttttggtaggcagcgaggaggattgctatgtcatcacgtttgctgtttgtggtctctctccgcgcgtcctgtttattgtttgttctgttcgattgacgcccccccccccccgctgctggcgatgtatgtttgtggtttttgctcccccccaccatacgtcttttgtggtcgtcgtctttttggtgacgacagggcgggtgtctcttttgtttgtgctcagctgtcctcagtcatattgttggtgttttgagtctgctcccagctacctactggggggggccgccttctcactttcggaaggatgtaagtgatgtgtgcctcgtccgaagaagaagatatagttgctgggggtcaccaccaccggcgggtgtttattattgatgagatcattaatgtttggggcggtgatgttttatactccccccgntggttattacagcagcaggaggtcgccgacaacaacaaggggggacgatataataaaaggcaggtgttgttgatatcaactacacggggggtgcccctacacctcgttgagacaaccccacacgacgacattctgtgtgtgtagagagagagtagagtgttgcagagaagagagtacgggggttgttctcctctgcccttgtgtggtgcacaccacacatgtatccctcgcagagtatagtagtggtgagaagagtgtgttctcacaacgcgctgagagagaagagtgtggagtagagaattcctgcgctgtgtttgctcccacaactgtgtgtgccaccacagctcgggtgggggagaccactgtgtgtgtgtctctcttctctattacactctctctgtgtggttgctgctgctgggggtttttttctgttgtgtgttttgttatagtacatgaggtggcgcgcccgctcatcactctcctctctttctctcagacaccccctctgttatctctgtggggagtgtgttttttgtgtgtgtgtgtagacacagtgtgcgccccctcatctctctctctctctctcacacactgtgttttgtgccgtctgtttgtagattatctctctctctgtgtgtgtgtgtgtgtgtgtgtgtgtgtgtgtgtgtgtgtgtgtgtgtgtgtgtgntgtgttctcttcatgagaatactggcccagcagtggccacataaatatttctccacacccagagagagagaaagacttgtgtgggtcgccacacacaagactctggaagagaatgtgaatttctccaagatgatttgtccacacagtgggaaacgggacaccagagagaggttatataccaggaggtgattttgatgttgcacccttcaggagaccaatttttttcgcccaggttaataaattgtgaaataatccacccca

SEQ ID NO: 636001 - DNA, 215 bp, Homo sapiens
aaggtatcacccatgtgcctgataaaatacgcaccaaagtaaatacaaaccagacgcagaagtggagggctcgggagggagggttaatccagcaggagggaggccgagctgggggtgcaggccgcacagggggtgccatggagcacggtttggacggctggcctcacaggtggcagtgcaggtgtcaggctggagtgcaaggatgtcccagacag

SEQ ID NO: 636002 - DNA, 121 bp, Homo sapiens
gtgtgacccacacagagttgagtggcctgctaatgatcaggcgtgtgttaatgcagcagcacatagtcccctccctgaagcacggctgagcgaaatgtgcgtctctggcctggaagcccct

SEQ ID NO: 636003 - DNA, 390 bp, Homo sapiens
aacagctcattcaggacttgatagagtgttacatacactttagtcataaaacttagtgttcatcattcatcttaccaatgctacagttctttgtcattggactgaaaaatcccaaatccttcactttactactcctagtctttgggaagtagttagatatgcctcttctttaacttggaggtgtacaaaatttacttcttggtgtttagtgaattaatgtgaatatttttacttcacaaaactttcccaaaaagtattaaaaaggaaccttagcacatttattttattaaaacaagaaaacccaaaatatataaaccttttcttattatgataataagcttatatatgtgaataagttataacctagtgtataaaaaattatttctaaca

SEQ ID NO: 636004 - DNA, 270 bp, Homo sapiens
  misc_feature (11)..(11): n is a, c, g, or t
  misc_feature (26)..(26): n is a, c, g, or t
  misc_feature (41)..(41): n is a, c, g, or t
  misc_feature (99)..(99): n is a, c, g, or t
  misc_feature (144)..(144): n is a, c, g, or t
  misc_feature (155)..(155): n is a, c, g, or t
  misc_feature (185)..(185): n is a, c, g, or t
  misc_feature (211)..(211): n is a, c, g, or t
  misc_feature (221)..(221): n is a, c, g, or t
ctggttttttntatttttagtagagncggggtttcaccatntgggccaggctggtctcgaactcctgacttcaggtaatctatctgcctcagccatctnaagtgctgggattacaggtgtgagccactgcacccagctcatagnatcttttttangttttatttaggccactgtcattttgggtntctgtgacctgtagttgaacttaatnctaataatgnactaatagctttctccagaagattaaatgagatactgtgtgcaacttga

SEQ ID NO: 636005 - DNA, 218 bp, Homo sapiens
ttagccttacgatcaaatcttaaatggcaccttagtgaagctcaacaaggcttcaataaccatgctgaggatagtagagccatatatagcatgagaggtacccatatctgaagtccgtcacttaactgatctaccagcgtggttctaggcacactcaataagacgcgcattgctttgacaagatcacgctctgattagaacaatctcgggtaccgagc

SEQ ID NO: 636006 - DNA, 254 bp, Homo sapiens
  misc_feature (13)..(13): n is a, c, g, or t
  misc_feature (149)..(149): n is a, c, g, or t
  misc_feature (151)..(151): n is a, c, g, or t
  misc_feature (157)..(157): n is a, c, g, or t
  misc_feature (159)..(159): n is a, c, g, or t
  misc_feature (174)..(174): n is a, c, g, or t
  misc_feature (183)..(183): n is a, c, g, or t
  misc_feature (194)..(194): n is a, c, g, or t
  misc_feature (216)..(216): n is a, c, g, or t
  misc_feature (231)..(231): n is a, c, g, or t
ccggtgcaagttnaccagcagcagaggacttgggaacccgatgaagaggagggaactttccgcagctccatccgccgtctgtccacccgcagcggtagaaacacctggagcgatggaatccggccaggactcccctggcacctgacatntnccacgntncacctgcggggccancggcccctncgcggcccttncccagccctgccccggagactncccctgccgcaaganttccaataaaacgtgcgttctct

SEQ ID NO: 636007 - DNA, 1187 bp, Homo sapiens
gcaggccatggcccttccatggaggattcctctgctgtcctcatggaaagcctaaagtctatctggtccagttccatgatgcatcctggaccttctgcctctggagcagctgttaatgcagcattaagcagaaacagcaacggggcaacaaggcaccatgaaccctcacacactgaggccaaagtggcaacttggaatgaaggctccataaaccatggcatgttgggttagcagggactggaccacacagtaccccttgcaggtggacagaccatcttatctgttatctcgctgtcaagagggatgtaagtataccaccaggcccgctgagtgtgcacgaacaatgtacgcacgagcaacaaaaaagaaaaaatccatcaggaactactacacggaccccccggggaccatccggacgggagaagagagaggaaaatgaatgaaaatctcagatcagaaacgtagagaatcaagacgagcatctccaacattcagccaatcgttacaatgtcaccaaagacacaatgggaagctgaaaagcatgaaaaagagggaagagaagatagggaaaaaagcacaaaaagggaacacacacaaacaacaaaaaacgacataagagagagacataagacaggaaatccagaaaaacggacaaaggacaaagcacagaacggagccaagagacagagaagaaaaacacaaaaacagcaaacaaacacagaagacacaagagaacaaaagtaaaaaagaagaacaacaaaataaacaaaaacaaagagaaccaaaaaagaggacgaaggcaacagaagagaaagagaaaaacaagaaagaaaagccaagaagaacacaagaacacagaaaaaaaaaaaagaagaagaaagagacgagaaaaaagaaacacaaaagaaaaacgaaagccagcacacgaggaaaaacaagagacaaaaaagagaaaaggaaaggcacaagagaacaagcaaagacaggaaagacaaaacaaaagaagacagaagcaagagagcaaagagaaccagaaaaaagcagagaacaagagaaagaaagaaacaagaagaaaaagaaaaaaagaagagacaaagaaaaacagaaaagagagaagacagaaagagagaaacaacaaagcgaggcaaacaacgaaaaacaaggacaacaggaaaaggatctgcaca

SEQ ID NO: 636008 - DNA, 702 bp, Homo sapiens
  misc_feature (352)..(352): n is a, c, g, or t
agcgggagaaatgccccgatggctctccggggcacacgagaagcgcaggcgctagcgggattgggatggcagtcagccatcgagtaggcggccgtttaggcagcaatatccgcaacaagtgtagacaaggtcccggcttgactccgtctctggtaacagtccttttgaagaagatggacctggtgaggggcggctggtctgtgggagacacgtagtctcctatcctactcgaccgactggtaagcggaactggttggccctgtggctggacgggaccctgggatactagctacggatgagacagcgcaggaccgaggaggaccgtgatgcatcgtccatcttcaaatgtccngtgacactaaatgatccggaccacgagtgcccatgactgtgcaaggcacccagagggccaggagccgagagtggccgtgctgactgtgaacctacgggaaggcgggcggctgcagcactcgtgtgactggagagcaaaggatgatgcgcctagcgtggacagacaggcactgccggaggcgaaagtccacaccctggggcagcgtcatacgagcgccgtaccaacgactacgtacgagagtggtagacccacctaatgcacatcgaagggcgacgtatggtccgcacgctactacaggaccgaccatacgcaggcgctggcgatgacggcacgtgatagtgccgggcagg

SEQ ID NO: 636009 - DNA, 1340 bp, Homo sapiens
  misc_feature (218)..(218): n is a, c, g, or t
ggcaggagctgacaagcaggcaacccaaattcgcagaggtctgacaagcgtgcggcatcagataccgcacgtcctgctcagagtacgacaaagcccgaggagggccaggtcggacctgggcgtcaactcgcgaactcctagactgctcctcatgattccttcgtagtcctacggcccactggactgcgtatgtcctgtgggaccccatgacgcgccgncgaggaccgtcgacttgatcgaagcgcgtggctcggccgctatgggggactcctcacgtaccacgattcgggcgtcgacccacctcgacacgctggtgggcgcagggagcgcagtttgccatgttgcggctgatcgtcccattctcagactatttaccacaccgttgaatttgacacgtgtagccaaagggaagagcaacgcgtgccaagagcattgacttctacactagaatcagactcttgggtccgggatcgtataagggattcgggaccccgggggtcggcgcatcgggcttgtggagcatcgggcaagaccatgcgatgggagctgcagcgcatatcacgcaaatcagagcaggtaggttcctgcagcgcaagtgtggggtccaacgtctcgtgacaagggttggtcctcgggccatatcgcagagggacacagggcctcaatgcaaagggttcgtgtaaggctttccggcgccggtccattttgccttcgtggagggaagggcaaccgccttctggtgacttccaaaacctaaaggccccaacaggagcacgccaggctgggccctccggaacctttgtcgataggcgttgggggaagtcgttagggaggcgaaaagaggttggcgcgttgtggagggggccaggatattgtcaaaaaggggagaggcttttggaaaaagagcgggacttggcggaaaattaaacccgtaagggcaaaaaagtggcaaaggggtttgggaaccctttgggaattacagggcttgggttgttccaagagggccttccgggggcttgggaaaagggggaaccccttgagggcagagggcttgccatgggcacttgggcaaagcttcccaaaaggtgacagggccccggtgacaccttggaaggaccaacctagggattccttccaatgtaggacgaaaaaaggcgggccacaggagcttgtgggaatggagggcgagaaggctgtaggatttgggaatactatggaggggggggcccagaggggtggggaccaaaaggcttttggaatggggaaagccccttaaggggatggaagagggccacaagaaaagggcaaacgttttacacgggattgacgatttgcttagg

SEQ ID NO: 636010 - DNA, 376 bp, Homo sapiens
  misc_feature (327)..(327): n is a, c, g, or t
  misc_feature (354)..(354): n is a, c, g, or t
gagcggccgcccgggcaggtacttttgaaagctacattaaaaaaatgcacttttaggccaggtgcggtggctcatgcttataatcccagcactttgggaggccgaggtgggcggatcacctgaggtcaggagttcaagaccagcctggccaacatggtgaaaccccgtctctacaaaaatacaaaaatgatggtaggtgcctgtaatcccagctactcgggaggctgaggcaggagaatcgcttgaacctgggaggcagaggttgcagtgagccgaaactgagccactgaactccagcctgggtgaaagagcaagactccgactcanaaagaaaaaaaaagaaaaatgtatttnttaagtgaatcagctgacaagg

SEQ ID NO: 636011 - DNA, 250 bp, Homo sapiens
tctcgaggacctccaataaattgttggtcattgatacacggctagaggaacagttcacccagtacgatattgagcaaattagcggtttatcgagtgcatatgctgttcgtatgtacgaactgctgatttgttggcgtagcacaggcaaaacaccaattattgagctagacgagtttagaaagcgaataggtgttttagatactgaatacactagatcaatgaccaacaatttattggagatcctctagac

SEQ ID NO: 636012 - DNA, 662 bp, Homo sapiens
  misc_feature (231)..(231): n is a, c, g, or t
  misc_feature (375)..(375): n is a, c, g, or t
gtttttcaaaagtataaataaagtgtgagtacctgttttcaaatttgtattatctctttggagtaaagtctgacaagtagaattgttgcagtgaagagtctgcacatcttatgtttgatacttcttgtcagatagccctttcgagaagttgtgctattttatataccccggaaaaaacacaaagtgtgtgtttctcctaaccatgtcaatgcatgtgtttgatcaattttnagagatctttgccagtctgatagatgaaaatcatttcattattgtttaatttgccttctgaatatttgtgaattgaacatttttccatgtttgttgaccatttgcatttttaatttatctgtgacttatacccattatttctantagattgttaatttttcttgatttatgtaagctcttttattattgtgtggatattaaccctttgcctttggacagtattgttaatattttcctgagtttgtcatttgtctttcaactttgtgtatgatttttttgccacacagaagttttcaattgtactcaacattatttatcattatttttcccctgtattattttacttttgtgttttaaagtgttcacatgtaaatttttagcctgtctaatttatttggtgcaatgaggtaaggatttaatattttcttgct

SEQ ID NO: 636013 - DNA, 417 bp, Homo sapiens
cacacattcatggctcttccaacatctcatctctccttccaacatctcatcgccccttccaacatctcatcccccttccaacatctcattgctccttccaacatctcatgcctccttccaacatctcatgggccccttccgacatctcatagctccttccaacattcatcgctccttccaacatctcatcgcaccttccaacatctcatcactccttccaacatctcattccgccttccaacacctcatacccccttccaacatctcatcactccttccaacatctcatcactccttccaacatctcatcgcaccttccaacatctcatacccccttccaacatctcatatctccttccaacatctcatatttccttccaacatctcatcgctccttccaacatctcattgctcctt

SEQ ID NO: 636014 - DNA, 852 bp, Homo sapiens
  misc_feature (551)..(551): n is a, c, g, or t
tggaaggtcggaaagcttctttatgggggggaggggcccggcccccaaatttctgaccccaaaaacaaaccccaaaagggcagttgcaaacggggattggtgtggttgaccagggcctgtgtgtgtgggcggggacgggggcccagggacgccatccgcctcagactctctggcccttctggtggcaaggggctatgtgcgccccgggctcaggcttgcagagaagcgtgttgagaagggctgtgtgtaggctggatctcccggtgtcagaacagctattctggacgcacctggtgatgtcgcccagtctctattctggaccgccgaaattttgcgccgtctccaggtgtgttcttggcacgccatctggtgtctgagacccctgttctggggggcgtgccctcacaaatgtccggtgtgggagaatggtgggtctcaacattgcggtggctttgggttctccccaatcacatgtcttcttcgaccaagtgtccggggctgggagatttctcacatcccccttgtgggcggcgataattctccacaagagncgacatgttttggtccccaatgagacccggtgggatgagaaaacacgcagaagaacccaccttgtttctgggcagaatgcgacagggtgttgagattgtgtttgcgccctgtggtacagtctcttgagaatgggtaagatggggcgccggggtacctcctctttgggatccctggttcccttgggggccatggtggggcattgcccccgggggggggaccttgggcggggacagaaatctctggccaattaaagaagcggtggatttctctggaggcctctgggaccccttgctctgagag

SEQ ID NO: 636015 - DNA, 1064 bp, Homo sapiens
  misc_feature (19)..(19): n is a, c, g, or t
  misc_feature (32)..(32): n is a, c, g, or t
  misc_feature (48)..(48): n is a, c, g, or t
  misc_feature (163)..(163): n is a, c, g, or t
  misc_feature (172)..(172): n is a, c, g, or t
  misc_feature (405)..(405): n is a, c, g, or t
  misc_feature (415)..(415): n is a, c, g, or t
  misc_feature (716)..(716): n is a, c, g, or t
tttcttttcctccgctccnacgcgaggaagcncgccgcccatcttgangattaaggattacacccggcgtgactgtcacgccacatatcatagcgccccggcgcacaacactatcgcccgcaccgcagaagacgcaggacgaggcgggcgccgcgccgccgcnaccaccacncataaccacccgatcaggccaatacacaggcgcgacaacgctatatataaatgttacgaattatagactagaagcttagcagcgtgtagctgaaaccgtgctcgcgcgcagctccgctatttatgctctactcgctcccctagcacaaataggagagcgtccatgaaaccatatgtgtcaataacaaggctttcaaacgcatcatcgcggtcgaggcggtccggcgagtaganataatataanataaaatacaagcgtcaacgcaacgctcacatgcactacctaacgactcgtttctaactccttctccgtgcgagtcatagtatggtggggatccaagataatatgatagaatattttattatattgtgtcatgtctgtgctctctgcgcctagtacgtagcgacatagaaggtccgttcgcacgttgtcgtaactatcatacgcgacttaacagacatacataccgtagtgaggtcatgcacacctaggataacgaactagtatcgacattacgatcgacgtaagattctacaacttcttntacttacacgtttttatgatattctactgggtactagatattcgaactaccgataataggactagacaagattaatgtgaaagatatagtaaggtaattggtgaagaagtagatgaatagggaggatgtggtagggtgggaggatagtaagaggtgtattaaatgtgtaagaggtagtaaagttgaataggagatgagggtagagaaggtgaatgagagagagtctgtgcttgcttgtcggcgcgccacttctattagtacctctttcattagtagattttgatatatcacacactcatggcactaggtattaatataagataactctgcaccactcaaactacagct

SEQ ID NO: 636016 - DNA, 515 bp, Homo sapiens
  misc_feature (1)..(1): n is a, c, g, or t
ngggttgttttcttctaaaacctaaggcctaatttttgaagctaggggtgttcaaaggcaatgattttcttcattggaaccccccggggcgtgatggtttcccaccaccaaggcgttttgcaaaactaaatccaaaaaggactctcctaaaatgtcaaggccaacacgagagtgagggtgggtggattaataaacccaatagtggaggggattgggggggaaagccgcccggtttggagggagagtaccaaatggaggaggattaaacgcaagagaaaaggaactttggagaaggaaacggataattggagtaaggaagcgtatagtaggccatgtgaaggaaaaggacggtaagaaaatgtagagagagggaaggatgcagggaaagtgccctgggtgttgtggcaacggacaaaggctatggataaagggcaaaacatcctggaataggtgaaacagagatattattctcccctgtcctctgttgtctttgtcttttcacgtcttaataaaag

SEQ ID NO: 636017 - DNA, 356 bp, Homo sapiens
cgctgccgggcgctgtggaatccatcaatgtgttggaatgcgactgcgccggcgcttggaacggcggaagccgtggatagatgcgcttccaggcatcatcgtactcgcgctgatacgccaagagcttctgaacgcgttgcgcttccatgcgcacctggagttccgcgatgtgtcgtcgttcgctgtccgtgcgcgcctcggagccgagcgcggtgagcggatcgagattggggctgtagagtcccaacggcccgtgcatcaactgccggtatcgtgcccactcctcacgtgtaaggccccagtcacgtgcggtctgagctgagaggtcctgttccgccgaaggacgttgtgtcgtg

SEQ ID NO: 636018 - DNA, 506 bp, Homo sapiens
acatacctcaccatgtttgagtgttcttctggcttccggggattgaacccagggccttgtgagggctcagcacagtctacaactgacagagaaaggcagacctctcagaggaagaagtgatgattcctggaagaagtaacaggtatactaagataaaatgtgtaagcagaagttagacacgggaaagtcagtagaatatgagttcaggtggggctcacaatgaaaagtgaaggttagaattaacaaaataaaaataagtccaaacacagcttacaagagaaaataaggtatattgctgaggttaaaagcatccagcccatctctgtctggtgcagttaccatcttcaatggccgtgcagtccacattagtaagtttagactgtattttaggagaacgggggaccttgcccttcctcatgagaaatcattttggtgtatgatgtgaaaacagaagacagtaaagaaacacggaaggaagcagctatgggttaagagtcaggaaggag

SEQ ID NO: 636019 - DNA, 297 bp, Homo sapiens
tctgggttgtggtgtgtctgtgctgtgaattgtattctgcttcaaagtgtgggacgtttcacaggatgagaatggtcaagatagtgagaccaaatgcctatatcgattcaaagaagtgggagatccatgaaagtttcccgtacgaggcgtgggggcccaatcccattaccacagtctcgcctctgggctcacgacactagtaaattaatatgacggattcaaggaacgagacccctaaccttggaaagcagctgcatgaaaattcgatcctggctttcacgaagccatgcaggtgac

SEQ ID NO: 636020 - DNA, 660 bp, Homo sapiens
  misc_feature (655)..(655): n is a, c, g, or t
acctcctaccccacgtgctaaaagtataatatgcctaaaagaaaacattggccacactttcatgacatcagattgggcaatgctttctgggatgtgacaccaaaagcataggcaacaaaagaaaattagattccttggattacatctaaatgacagacacttttgtacatcaaaaaacactgtgaactgagtgaaaagataacccgtggattaggaaaaatatttgcaaatcatatatctgaaaagaggctgatatccatcatatataaagaacagccagaactaaacaacaagaaacccaaagcatcccattaacaatggtcagaagatttgagtagacatgtccctaaagaagatatagcaatggccaataaacatctaaagtgatgttcaaatcactaatcatagggaagcacaaatcaaaccaataatgtgataccacacattaggatggatatgataaacaagcattggtgaaacgagagggaagtaggaatgctcgaatatgattggagggaatgtaaaccatgaaggaacagggaaaatagtatggcgtgtactggaaaaattagaaacagaatcatcagatgttcccgcagttgcacttgtgggttcctaccaaaaagattaagagccaggggtggaagagatcggngggag

SEQ ID NO: 636021 - DNA, 214 bp, Homo sapiens
  misc_feature (27)..(27): n is a, c, g, or t
  misc_feature (76)..(76): n is a, c, g, or t
  misc_feature (147)..(147): n is a, c, g, or t
  misc_feature (153)..(153): n is a, c, g, or t
  misc_feature (174)..(174): n is a, c, g, or t
gtggactctcactcctcccccgacgtnaaggcctccctgtctctccgggcagctctgagtcccagggcagactggnacatctccaggaaaccagggccatctgggcaggaggcctggggatgagggtggggggggacccaggttccngagganagtgaagcaacagcccagctngaagggcgtcttctgcggagaaataaagtcacttttgagt

SEQ ID NO: 636022 - DNA, 350 bp, Homo sapiens
aggtctcttacttaaaaacaaaacaaatgcacatgggaaactatctcctctgagaagtcttcctttacccgtgcgtcaataaacattcccttctgtgttacctctgcacttggtatattagcaccctgagttgtgtctatcagctccaaggagcagagtttccagccaggcacagtggctcatgcctgtaatcccagcactttgggaggccaaggtgggtggatcacctgaggtagggagttcgagaccagcctgaccaacgtggagaaaccaaatctctactaaaaacattagccaggcatggtggcgcatgcctgtaatcccagctacttgagaagctgtggcggacg

SEQ ID NO: 636023 - DNA, 477 bp, Homo sapiens
ggaacggggggccccacaacttgggaagaattccgcaaatggtttactcagcatacctttcttcagcaatcctgttgtctggacctgaccacgtcatacaataacctggctacgtatgtcttccttcatacggtgaaagggacaccttttagactcctgaccaaggaaaggctcggctactgcacactgggagcaaatggactatgggctccagtttacctcttcccgcaagttcctcagcatctctcctaatgtgctttattttctggccaacttttaaaacaaagaataatctgggcactttctcaacaaacacaccccaattgttaagtgtactgctcccaaagttgccccagttccatggggttcgtgtttttggcatcaccaaatactgagggatgggttttggaacagctccatgggcatggggaaggcactgaaacagaggactataaaacatccttctcttattctcca

SEQ ID NO: 636024 - DNA, 436 bp, Homo sapiens
ctctagagtacccccccaaggaatccaatcttactccccttgaatacaggcagagtgaagtgcaatgtaagacaagttaataaaaaagcctacctgcatactgagcagtaattttaatagatcgataacatgcttaatataatttaatgtcttataaactacgaacagcttgtcactttatctatgatctcaggaattgtgctgacacgaatatctccatcatacagtctccatttacaatttaaaataaaaacgtccgctaggctgacctatatctgccaaaactttttaggtttacatctatggtcaagtacatatacaaccatcagatgcgtctctgttggactgaaaaggtcaggacaaactttgattcttgtctaaatgcgatcctagttttttggaatgaaatgctgtttctagaacgcaacatgatagt

SEQ ID NO: 636025 - DNA, 239 bp, Homo sapiens
ctgctggtcgtaactctagaggtatccccgcacgctctctctgtgggggggcgatcagactgacctggcgcaggatctgctgccggctgttccctggtatcattgttgtcattttagtgtcacaccaagcttgtccagcccagcttattttgttgttgttctattttgttttgttttaggcttttagcagcctgaagacattgtttttacgtttctgtctgtccccacagagagagcgt

SEQ ID NO: 636026 - DNA, 472 bp, Homo sapiens
cttgagaaatgatgtgcatctccaaactgccagctgtcctcctcatcctctctgtggcactgaaccacttgagagctacacctgtcagaagtggtagcaaccctcagatggacaaaccgaagttccaacacggccacgtgtgccacacaacgcctggcaaactttttggttcgttccagcaacaaccttggtccagtcctcccaccaaccaacgtgggatcgaatacatatggcaagaggaatgcggcaggggatccaaatagggaatccttggatttcttactcgtttaaagtcaatgtacttctgcagcacttaatactttatgtgtaaatgctctggtgatttcctgaatattaacagtacctttttcattcccccctcagtgagaatgcacaatgtgcttgtgcttgatgactgtgtgtgtaaattctcatgctaagaattgctttaaactgagtattgatcaaaaaa

SEQ ID NO: 636027 - DNA, 432 bp, Homo sapiens
gcacctgcccactccccttcgtgagcactgtgattatgcgatcgtcctccccaagcttgtgtgtgcgcaggacaacggcataatcgcggtacagttttaccaacaatccccctgtgaattagatcacccataatgcaaaatctgtgtctcagtttgcataaaagacagtattaggcgaacaatgctatttgtgtcatacccatcataaagacacgtcgcgtcaactggcgacgcgacccacctaatcctggaaggaaagaccgcatgagcgagcacctagatgccgtcagccggtccgaacaacccaacaaggtaaaaacgttttttgggcacccgtttgggctaacgacaatcttctttaccgagatgtgggagcgctttagttactattccatgcgcgcgatcctgctctacttcttggtagatacagtt

SEQ ID NO: 636028 - DNA, 329 bp, Homo sapiens
ttttagtagagtcggagtttcgccatgttggccaggctgatctcgaactcctgacctcagatgatccacctgtctcggcttcccaaagtgctgggattacaggcaagagccaccgggcccagccaaaatttctttaaaagctatctctaccaaaaatacaaaaattagccagcatggtggtgcatgcctgtaatcccagctcctcgggaggctgaggcaggagaatcgcttgaacccaggaggcggacgttaaatacagagtagttattaaaggcaactgatttgtacactgaacacttttcaaagtgcaaagcgccatttgccctctg

SEQ ID NO: 636029 - DNA, 445 bp, Homo sapiens
  misc_feature (352)..(352): n is a, c, g, or t
  misc_feature (381)..(381): n is a, c, g, or t
  misc_feature (403)..(403): n is a, c, g, or t
  misc_feature (434)..(434): n is a, c, g, or t
tgagatagtcttgctctattgcccaagccaaagtatagtggcaccatctctgctcactgcaacttccgcctcttgagttcaagcaattctcatgcctgagcctcccaagtagctgggattacaggcacctgccaccacgcccagttaatttttgtatttttagtagggatggggctttaccatgttggccaggatggtctcgaactcctgtcctcaggtgatctgcccgcctcggcctcccaaagtgctgggatcacagccgtgagcaccgtgcccagccaagtgtgcatgttttcaatcttctccctgttcttgatgctcagagttggacaactacacaaacactggcaangggcttttgcttttttgttcccgatgggnatcttcacaagggtttccctantgcaggcattttgttttttaggacattttancaaccttagtg

SEQ ID NO: 636030 - DNA, 265 bp, Homo sapiens
agtatccggcacggacactttcgtcaagataaactcctatcatgaaaacgctcccacgtcaaaatagtttaactcacccactggcttcactctggccagtagcaaggtctggcaactcgggcattgggcaaaggggattaataataagagaaacccgggactctggcatcaaatggatggacattcaccacttatcacatatttgctatcggaaccaagatactaaaactaacggaaactggcacaaaccgatctcggtggaggt

SEQ ID NO: 636031 - DNA, 1825 bp, Homo sapiens
ggacgtcgttggtatagtgaaatccagtgaattcacatatgaattctgatcccatgggcaaaaaaaaaaaaaaaaaaaaaaaaaaaaaaaaaaaaaaaaaaaaaaaaaaaaacaaaaaaaaaagaagacaagagagcgagagcgacaccccaaagaacgaccaacaaagatacagcgaacaacagatagcacgcaacgaccccactcccatgagcgcacagacggatgcgcacatgggcagcgagatagtactcacacgcaggccggccagagagagaagcgaggagagacagcagagcagcagccgagcggagccaacgccaaggaaaacgagagagaggaacaaaagggaagagagaagaagaaagccagagcagcaacgagagggcgagaggcacaccgaaaggagaggaaacacgcacagcgaagaaaagaaggatatgttcactactcatacgctagtgacttgtattcttcactcctttacacctctactgaatgaccgaaccagagccgtgaatctatctgatactagagtgagcgcctcactacttctgtttgtctacgtatagaattgcctaatcgtacaattgctacaccaccactcaatgtagagcaaaataagcataagaacacatagcgtgacgctgacagcgagtggcgagagtatcgagccagacggcgcacagcgcgcggacgactgaggaaaacgacagggaaagagacaaacggaaggagcaagagggacgcgcaaaggcaacgggagcaagcagagcgctagaggggggagaaggggcgaggcacggagagagaagaacgaacgagaactgggacgcgacagagcgagcacagaccagagggaagcgcggaggcagaagcgaacggagacgaagacacgagacgaggacggcgcgcgcagacaggagacacaagcgaatgacgagcacggcgtcggaaagcgacggcgcaggcagggaggaggacgacgcgcagagaacgagagagcgacggagagaccaggccgcaagcggacgagagagggggagcagacagagaacagcaacagcagaagaggggaaaggggagcgcaagaccgcgaaggacgagaaggagagggacacaggagcggaaaggagggagagaggcggaagcaagacagagaacggagagaccaaagcaacgaaggcagacgacacaagagagagacgacgacgaaaaggacacaaaacgcaggacgggatcaaacaaagagcagggagcgcgcgagaagaagcggaccaggagggagagagggagcgtcggagagagaaaaaacgagaaaggagcgaacacgaagcggagacagggacaagcagaatgacgggcgaggcacgcaccagcgaggaagcacagcgcgtaagagaacaacagcgcgcaaggagagacagccacggacagaagagcgagcagagagacagatcagagggaccagcggcggcagagaacccagagagcagagagacaggagacgagggggcagaggcgagtgagagaaagagagcagatggagagcgaagaagagacaaggagagagagggagagaggtggagagatgatgaggaacagcagtgcagcgggagagggagaggagagatcacaggtagagagtaagggaagagaagcgacgagaacgaagagagagcaagtggaggaagggaggacgaggagtagcaaggaacgggaaggaggaaagcgtgagaacgagaaggacgagagcacgcgcgcagaggaaaaagaacagacataaagcagaagaatgaggcaggacgaagaagaagcgaaagac

SEQ ID NO: 636032 - DNA, 1056 bp, Homo sapiens
cgaggatgagtggcccgggctgtccgtgaccaatgaggagatctttggcagtgatgctgattctgaggacgatgcctgactctattatgaggacagaggacaggcccaagtgctggctagtgactaatgattcagacagcggctagcatatgggggtggccagccggtatcctggagcctgcgagtgcgcagctgccagtcccttccccagtgtggatcgatcactcggcccaggaaggatcggccaagtgattgcatgcaagccttctgacttccatgtgaaagctgatagtgacacgtgactttgacgatcccagggcgattcaggggcgtggcttcaagactgcctattaattgtcgagcagctaaaagcaatcttttctaagtggtcgtgtatgtgagcctttcagcttgttgtggttccccacgacccaaacactttgcatgttaagtaaagtcaaaccttctcttttatacacaacaatacaatacaacggagatgataggaccagaagatttccctgggggtggtgctctttgtcgtgggcgtgcccgtgaacatacatcagtgccattttagattgcggccctgggtgtttgattgcttggtttttcctgtgcccccactcgtgtttttgttcgccagccgtggtgatgaccggaccgggtttgcctgatatcaaggtgatccacggaatcatggtttgagaaattacctggcgtaaaccgccgtggttaggaaacaggccgcgggcgactcgtgaaagaaaactttagaacgcttgtggaagacctttgggcgtccacgtccaccattctgctctgataaaacttggaactcttgactccaggaaccggatgacagtgggccccacatgttggttttgaccatctaaatccctgaaggtgataacgacagagaatcccaagtgggtgtccctttggacagaattcccggttactgggttgtctcggcaaaaatgggggtcttgggaccagggcgggttccgctaccagaaactaccatttaacgggagtgggaaaccttgtatagct

SEQ ID NO: 636033 - DNA, 735 bp, Homo sapiens
  misc_feature (592)..(592): n is a, c, g, or t
  misc_feature (645)..(645): n is a, c, g, or t
  misc_feature (659)..(660): n is a, c, g, or t
  misc_feature (671)..(671): n is a, c, g, or t
  misc_feature (706)..(706): n is a, c, g, or t
  misc_feature (712)..(712): n is a, c, g, or t
atacgttgtaaccagcggccagttaaattgagtacggctctctataggtaatatgggtgtccgagctccccccagagcatgggtatttcaataatagctcaagagatgtcgagcagacagagaatattcagttgtattagattcgtgactataatgagttagacccactgatagatattccatagtcataggtcgcgctatacaattaggtgcattagtagttggcctgcagtagtgtaaagcatcagctgtgtgaccagctctatcggtagaatgactcgtcaaatgctgtcgataatttccagtatcagtataaaagtcgtatatgtcccctataataacagttgttttagcccagttagtatagtagaagcatacagtataaacactgtgaccgatgataataagagcttgatagcttcgtttatatacacttcggtgtgcgtctgagtgtgtcctaagtgaaggcgtcaagtcccaatatggtctatgatgatggcaaataggtacactgatctaacgtaaatactaagctatgaactagtatcgagtgtctcagtgcgctcctatgtggtgcgttgtcatcgggctnattcgattctgtcctttagtgatcagagttacatacaagtgcacttagagtcnctgtccgctgcttnnacgacgccgcntgtctagatagaaatatattccctcggtgaccganattccnctgcaagcccgggggatccacta

SEQ ID NO: 636034 - DNA, 319 bp, Homo sapiens
cagtgagacaaaattatgccactgcactccagcctgtctcagaaacaacaataaataaacttaagaccaaaataataaatggtatgttttctgaccaaaactgaaagaaactaggaattaaaagaaatgtgaaaataaaacacattcttcaacatatttttgctcaagggtcaaaaaacttcattttgggccgggcgcggtggctcacgcctgtaatcccagctctcagggaggctaagaggcaggaggatagcttgagcccaggagttcgagacctgcctgggcaatatagcgagaccccgttctccagaaaaaggga

SEQ ID NO: 636035 - DNA, 297 bp, Homo sapiens
attgatagcggatagggcaggctcgaatccatatgccgtgtcaccacaacaagtacattgtgactgaacgcgccacctacatcggaaacttcaactggtcttggaactacttcacggagacggcgggcacctcgctgctggtgacgcagaatgggaggggcggctgcggagcactggagccattttcctgagggactggactccccttacagcatgaccttgacacctcacgtgacagcgtggcaaccgctccgcctgctctgagcccgatcagtggcagcaagctctggcccgcgc

SEQ ID NO: 636036 - DNA, 251 bp, Homo sapiens
  misc_feature (77)..(77): n is a, c, g, or t
  misc_feature (112)..(112): n is a, c, g, or t
  misc_feature (168)..(169): n is a, c, g, or t
  misc_feature (184)..(184): n is a, c, g, or t
  misc_feature (241)..(241): n is a, c, g, or t
acttaaagctcctaagccactgcctgctggtgacccctggccgcccacctccccgccgagttcaacccctggggtgnacgcctccctggaaaagttcctggcttctgtgagnaccgtgctgacctccaaataccgttaagctggagcctcggtagccgttcctccctnngctgggccttccaangggccctcctcccctccttgcaccggcccttcctggtctttgaataaagtctgagtnggcggcaaaa

SEQ ID NO: 636037 - DNA, 634 bp, Homo sapiens
gagcgggctcgccgccaccggactgccgggtccctagccaggacgagacccctcccttcccatgcggacagcccggaccccggaggatggattctcttatgttaccttcctgcagtttagcccccatcccttcaaaatatgggttccccaccactgacactgtgatgcccatagctaatggttgcgcctggaaaatggtgacaatggggactgggctgacagcgtggctcgtggtcctccaacgaccccggacatagaccaaaagggacgacggggcatctcggacgggcggacgcggaggcccaattcagacacaggacgatccggaccgaccgagcatcgcactgcaaatcccacagatgagcaatcgcgctgtcaacagtgaaagtaaactgcaatcatgaggaagggacggagcgctgatcactccagcgcaaacgtacagagcccgtatggaccccaatcggggacggcagggggggggcctgggaggcccgagaaaaaggcagggggcaagcaaggataccaggcctgaggccgcgagggaaaggggaggccaaaccgagaccaaggccgaagatggacgcgtgcggcggcagaaggacggggaggcagggacatagcaggaaggagg

SEQ ID NO: 636038 - DNA, 429 bp, Homo sapiens
gagagagagagtagagagagagagagagagagagagagtagcgtagagagagtgaccgtgagcgagagcgcgagcgtccgctccatccctgtcttccccctcctcttttacccctgcgctcttcccatcggcgttcccctgccgtgtgtcccctcccttgctcctttcccacttctctttcttctcccgtgctcctttgcttcttgggcccccttggtctccattcacgtctcgtcgtttcatgttacctctgccttgctccgttctcctgtctctccttgctgcggtcacttcctggacttttccattcttttttctctcctctcattgccttactttctcctcatgttcttcttcttctcccttactgttttcttctgtttcatcctctttcacgccctattcctctctccttttggtcttcccgtt

SEQ ID NO: 636039 - DNA, 211 bp, Homo sapiens
atcctgtagctgtacagtgagctgatcagcatcgtgccgtgacatctcggaactgctgcggctggtccggggatgatgggtcggctacacaagcggcacccaggcgtccggttgaaatttaaccccccccaaaaaaaaagttttttttggggccaccatgcgccaagtgacgcacgggcgcattgcaagggtgctgatcgacggtcgctcg

SEQ ID NO: 636040 - DNA, 377 bp, Homo sapiens
agtaccggttcagtggcctcctctttccatgccttcaactcctctgaaatgagggccatgacgagggtaggaaaaactgtctctgcgatagagaggtggaaaaagtcccgcgaagtgtccccggtatctagaaagcgctcagtagtgtttgctgttatcttagggatatcaggctgcctggacatttctcagaggatgaaggggattgtagtaaggaagaccaccttccagaggatgaaggggattgtagtaaggaagaccaccttccagaggatgaaggggattgtaggaaggaagaccaccttcccggggctgggcacacattattgagctccataatgtgtgcccacagaggctgaagatgatgatacaggacc

SEQ ID NO: 636041 - DNA, 140 bp, Homo sapiens
ttcaacaaacaatcggttcctacgaactccctcctgtcatgctggcctcactccactctcaggttcctagaaccaatgccactcttctaggtcctgcaaaatccatggtcagggatgcacgggttggggataaaccgcga

SEQ ID NO: 636042 - DNA, 103 bp, Homo sapiens
tgggagtctgcgttttattaggctgtcatgtgaagccaagaggtgatactgtgttcttgtgacaacaatgtaagtgttccccgattactttccagtcattcgt

SEQ ID NO: 636043 - DNA, 845 bp, Homo sapiens
gagaataaaaggatgcacaataaatatacatcccctaatcagagacagtttcaaattttagtttataatttgtaggtgttcctcttcacagctatatattagaatcatatgagaatgagtgaggaaagccaaaaaaacaaaaggatcatcgagaagcataaaacaaaaaggttaggagcggtgagaggcaggacccaggcttggtattgttctgttttaaataattttctaaagttttgaattgtaaaaaaagcatgcatggaactgaccatcatagccatgttaagtgtacagttcagcagtattgagcacctccacattgtcatgcagcggaactccagaaattctccgtcttgcaaaactcagcctctgggccgttaaactaggtgtccccacctcccctcccccaggccctggtgaccaccgttctgctttctctgtctgtgattttgaccactttagatacgtcatttcagtggactcatcctgtgtctttttgtggcggaatcacgttctgttgtgtgtatacaccacgtttttcttgtccgttcacctgtggatggactcttgggcgtctgccgtaggccgtgtgaatgctggcggcggtgatcgtgagtgctgcggcgctgatcgtgtgctgacgtctcctccacgtactgagtcgtgtcttttggatgcgcgccagagggtgggactgtggatcctgtgctgggtcatactatgttaattctctgaggaactccggctgtcctcatagcagcggtcgttcaccctggccacggggcgggtcggttcccacgttctccgggaaggggtccggtcccagttctcccgggaagggggcg

SEQ ID NO: 636044 - DNA, 304 bp, Homo sapiens
ctgtgtttatggtgtgatgatgatggtatgatggtggtgctgtgctgatggtatgatgatggtatgatgatgacggtggtgatgatggtgctcatggtgctgatgatggtatgatggtgatgatgatggtgctcatggtgctgatgatggtaatgatggtgatgatgatggtgatgatgctggtgctgctgctactgactgatgatgatgcgggatgtgactggtgatggcatggatgatgactggtggtgacgcgtggtatctgctaatgactggtgatgatgtgtgctggtcaatgatggtg

SEQ ID NO: 636045 - DNA, 329 bp, Homo sapiens
  misc_feature (275)..(275): n is a, c, g, or t
tcaataaagggtcgtattcaacaagaataatattccaaatagaactattccaaatacgtatacacccaatgttggagcacccagattaagaaaacaagtacttctagacctatgaaaagacttagacagcaatataacagtgggggactttgacttctcactgacagatcactgaagcagaatactaataaataaattttggacttaaactctgcacttaaccaattgctcctaatggacatctacagaatatgccatccatcaaccaaatatangctcttcttatatgcacctagaacacactcgaagattggccacatgcttggccg

SEQ ID NO: 636046 - DNA, 355 bp, Homo sapiens
tccagctggccccaaggggtgggattagaggcgtgagcgcttttcttaaaagagtccaggttctatgtgggaagagcgagttggtcagtttttatgggaacaaagaaatgaatggacagcatggtgataaacactggaagtgtcacttctaaaattggtccatggctgaaagtggtggctcatgcctgtaatcccagcacgttgggaagccaaggtgggtggagcacctgaggtcaagagtttgagaccagcctggccaacatggtgaaacctggtctctactaaaaatacaaaaaattagctgggcgtggtggtgtgtgcctgtagtcccagctacttgggggccaggctggag

SEQ ID NO: 636047 - DNA, 277 bp, Homo sapiens
cagccagggcccttcccaggtttaatttacaggcctggatttcctcccctttcccccttttttccaggggttaacattgactttcccttgggtttcccctggggtttcacctgggggtttttttgcagcattcttccaaggcctaatttttcccatggggcccaaacccgttaaccacccccttttttgaaaggggattcaaaggcttttggggttgttgaaaaggcctttttcaaattgttccaatttaacttcccttggaagggccttggttgga

SEQ ID NO: 636048 - DNA, 433 bp, Homo sapiens
  misc_feature (177)..(177): n is a, c, g, or t
  misc_feature (406)..(406): n is a, c, g, or t
  misc_feature (423)..(423): n is a, c, g, or t
tggaagaatagatgacattatttctcacaccacaccctgccctgctcttcatccctattttaccaatcagggtcagtcatctccaacaccccacaaacacacccatagctccaaggagccagcaacaagcacacaaacaaagataagcaaacaaacttatcaggcgcaggcagctgncttccacacaggccctgccagctcctctgcaaatacagtctctggtaggctgccctgagaaggatctgaaggaggccgtgcatagcaccggtgagcttacctacctgctggctcacagtactgtgggaaggtcaaggccaaggccaggtcagtagctgagcttgctaaactgggttctttgcttccctatgggacaaagccttctggccaaggtttgttgtgggggggnggggaaccatgggtttncaaaattaaa

SEQ ID NO: 636049 - DNA, 876 bp, Homo sapiens
ggagttactgagaactcataagacgaagctaaaatccctctgcggatccacaagtcatccgccctgaacacatcctgcagaaagcccagatcaaaggagacgccatggaattatctactaggaaaatatgtcgagcttactctttctgggtcacatgtgtctggtgatttcgtcgcgaatgttcttccacttccagtcatccatgatcgtgcagtgagttgccccagaaatgctacgcttgactagggaaaactccattctttcttgcccagtccgggtgcccctatatacttcgagttgtcgatggtgcatgcatggcgttctcttagtagcaataatccgcgactctcgactaagtgtcctagaggaagtacggatgctctcggctcccatacacgaagcgtcaccttccaggagtccatcttgcatgtgtagcgtaattcatataacaggagtcgcgagtgatatgggaggagtttcatagagtggtagtaacctactactgggcgtagcgactgcaagctactatgtatgattatcactaaaatcttagatatgcttctttaaccagagtgctgatcttgtatgacgttgtcttgcatttttcgtgggaaaactggaaataaattgacatggttagttggagtcgtattatgcgctgtatgatgaggaatataaaatctctccttttccttaccataccagtttgacacgcttcaacggtatatactgcagcttctagctgacgttccctgcctatatcctagcagtgacaaatcagcaggtctaggttctctctctcaatttggaattgatgtacccgcgatttgtagctatggttccactgcgaaataaagcccttttaaaatcagtcaa

SEQ ID NO: 636050 - DNA, 124 bp, Homo sapiens
tgctgtctagaggtcccatgctggtttctctgatacatgatttccacgcactcccgggcacatttccctagcttcttgtctgcggcagtatcctctgagagtcttgggtagcgaaggagccgga

SEQ ID NO: 636051 - DNA, 330 bp, Homo sapiens
cagactcttccggggccttcgccagcataaaagaggaggatgctcgcgtatgcagcaactgctccagcgcaaattgcagccgcggttgagtatcactgaataaaggatcgttttcgtcaatcaaatgtggctgagcaaatatttcctgatagctatcggtatcaggaaccaggtcacgccatgcaagtttcgtaatggtcaaagttgatgttttttagtctgttgtcaaagccgcgattatacgtaaccggcactacagcacacgtagaaagcaccgacaatactcctggcatgggcgttaaagctcacaggatggagattcttttcttc

SEQ ID NO: 636052 - DNA, 570 bp, Homo sapiens
  misc_feature (245)..(245): n is a, c, g, or t
cccagttctactacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcacctcaatttttttgagggcccaaataggatggggggtctgtgttatttgtgggatccagagatgaaagaggggtgggatcccccctgaaanagtggagagtgacatgtgctggacactgtccatgaagcactgagcagaagctggaggcacaacgcaccagacacttccagcaaggatggagctgaaaacataaccccctctgttctggaggccctgggaaacctaaaaaaggctgtgagccaaggagggagggttttcctttggcatgggatggggatgaagtaaggaaagggactggaccccctggaagctgattccctatggggggaggtgtattgaagtcctccagacaaccctcagatttgatgatttcctagtagaactcccagaaataaaaagctgttatactggtcga

SEQ ID NO: 636053 - DNA, 202 bp, Homo sapiens
tgctgattaagttttcttcttaatttcacgtatacttacatacactcttggaaggtgctgaagtcatcaacctgagtgccaaagacaaggtatgccaactgggcatatgctaagaaaataatgaagaacataattgcaaagccaaagaggtctttggcacaccgagacatggttgtggagagctgactcccgcttttgtgtt

SEQ ID NO: 636054 - DNA, 950 bp, Homo sapiens
cgcggtggtgcctcccgccatgattctgaggcctccccagccacgtggaactgtctgctggagtttgctggaggtccacgccacacccttttgcctgggaatcaccagcggaggctgcagaacagcaaagattgctgcctgttccttcctctggaagcttcgtcccagatggacacctgccagatgccagccagagctctcctgtatgaggtgtctgtcaacccctgctaggaagtgtctcccagtcaggaggcacagggatcagggacccccttggggggggcagtgtgtcccttagcagagcttgagcactgtgctgggagatctgctgtctctttaggcccggaggcaggaatatttaagtctgtgaagctacacccacagcgcttcttcccccaggtgctctgtctcagggagatgggagtttatatctataagcccctgactggggctgctgcctttctttcagagataccctgccagagaggaggaatctagagaggacatctggatacagcggtttgctgggctgtggtgggtccatcagttccgaactttcctggttggttttgtttaccctgtggacgggaaaacaccctactcaagcctcagtaatggcgtcatccctccctcacccaagcttgagtggtccggtggacttccgacatgctgggctggcagaagattcaggccagggaccttagcaacggcccaggggggggaccgcgaccataaccatgcggcggacgaatcaccacctcaaggaggtaagggatggacacgggtgtccacgagccactggtctgacacaccaacgtcggggccgtgtcgtgtcgcactactgtcaacaaccgccagtataacgaggacatcgataacgagcgactgcagcaacacgtcgacacacacaagagaccaacagacacaacacacgaagcgctcagacagta

SEQ ID NO: 636055 - DNA, 1206 bp, Homo sapiens
tttgctgttgtgtcgtttgcttttgtgtgtggtgggttgctcttcgattctccgtgttttgcttttctctactgggtagtcgcgcttggatttgggccggttactttttgtcgtcgttttcgtatggttcctctggtgaggtggctcttttcgccagctgttggcggatttttggtgccacagtgtgtgcgcgtcgctggtgtgcttatggtgtgtcacaccgcgtcgccacgtttgtgtggggctccggggtttacccacgtggtatcttcctcagcgtgtgtcggggtggtccctgggtcctggggtgctcctgtgttagcagttgtttacctgctttccgcggggagtggacaaggggtggggttgtagcgcactggtgtgagtgaccggtggaagtttcggtgttggctttggcgcccgttggtgcacagtggcttaactcgaggaggttgttcgtcttgttgtgtctgtgttacgtctcctgctcgacatgccgcgtccagagtgatcactctgagatctgttggtaccgttcagtggccgaggatcccagtgactgtggactttgtgattccctgagttcccctctatcggggagagggccttctaggatttttcccgggtcttgttcctcgcccttttatggtggcactcccgttctttgtggctggtgtgactccctggcctaacctcgtccatatcctagtgcacctggacccgctggggctttttatccctcggagtgagaatgaagaggttatttctcccaagctcgtgcacccggatttttttggcgaggtattgttgaccctcatgccctctgtgtggctttgttcttcccattctttttggctcgtgccacccacctcgttggtcttgctgtgtggaatgccctccctctatctcccccactatatacgcttcttggaatatgactcggttggtgcactcgctacccacaaagaaggggaatattgagcccgcgggagaatatgcttatttttttcgcgaaggtcgcctcttgggaagaacttattgttgtgagcctgaaaaatgttaatttgaagaatgtggggcccgggaccacgtgacactttctgtagtcccacgaatgcaccacgaaattatatgggagagaaatgttgagtttctataccgtgtggcgcgcttttttaataatcctttaatcttgggaaaattcca

SEQ ID NO: 636056 - DNA, 301 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (18)..(18): n is a, c, g, or t
  misc_feature (37)..(37): n is a, c, g, or t
  misc_feature (82)..(82): n is a, c, g, or t
  misc_feature (134)..(134): n is a, c, g, or t
  misc_feature (150)..(150): n is a, c, g, or t
  misc_feature (162)..(162): n is a, c, g, or t
  misc_feature (193)..(194): n is a, c, g, or t
  misc_feature (203)..(203): n is a, c, g, or t
  misc_feature (221)..(221): n is a, c, g, or t
  misc_feature (294)..(294): n is a, c, g, or t
  misc_feature (299)..(299): n is a, c, g, or t
aantntngtatttttatnggagacagggtttcaccangttggccaggctggtctcgaactcttgacctcaagtgatccaccngtctcgggctcccaaagtgctgggattacaggcatgagccactgcacccggnccttttattattcatngtaagacacacngggaccacaattgtctcttctactcagtagnnggattctgngtgcctagttcagtattnggcaagtaagcgttctgcatttgatatcccggtttacccgggacaacaaagtatctccaaacttcattcattnattcntt

SEQ ID NO: 636057 - DNA, 111 bp, Homo sapiens
ctctcccccccaacccccactttcacaacgcggccccccacctttacctccctaagttcttcatctctttcgacattttttttgaaggctgatgggggggagggtggaaga

SEQ ID NO: 636058 - DNA, 416 bp, Homo sapiens
agaccatgtggattggaaaagattagttgccaattagccccccagataggggcagggcccccacaaccttttcctgtgcacttgcctgtgcttgacagccaagaaattctggtctcctttggccttaacaatccttacacctttaccaagttctagaggggaacactggagaagagcaggagaagagacagacaaccacgggggaaggctccacaggggaacggcagatgtgcgcggtgttgcgggacgaaatgtggactttggcctccagtgtcgacaggggacaacccaattggcccatctcgggttccccccaaaccccaaaccccctctcttctggtaagctgggtcttgtactggcaagtctctgggaggcaccaaaatgttacctggggagaaagaccccacacacccgc

SEQ ID NO: 636059 - DNA, 479 bp, Homo sapiens
  misc_feature (109)..(109): n is a, c, g, or t
  misc_feature (135)..(135): n is a, c, g, or t
ccctccttaaccatgtggtgttttgagctgtttttagtggggacgcccagaggttgtgtggcctttattgtggccccccccattcaggggaaaaagggggattgttggnttgggggcccctggacccaattggcnaaggggggcaagcttcctttttggggggtttttgtccagttcttttaaaaaaaatggaggcccaagggcttcccccccctggttgggggtcaaaaaacaccccgcaagagttgggggccttggggccttggggtgttgttcctttgaagccgctttgggcccgggcccttatttgtttttttggttttttgggcctttccggttgggcccggtccccccccccccttcggttgtccgggggcaaaccccccccccccccccttcctttttcccccccttttggggccctccgggccggttgttttagggcccccctgtttgtcattaacccccgggtggggcca

SEQ ID NO: 636060 - DNA, 205 bp, Homo sapiens
tgtcccgaggattcgaaattttccccctacattgactcctgtgctacatcagccaaacttcaccttggggaggtttggatttgatagccaattagttctagtgctggttgcaaagaattgatatttagatggtttttaatactcacgcagattgtcttccctatatattagtgtctatttttatgttagcagtagtgcatatccg

SEQ ID NO: 636061 - DNA, 445 bp, Homo sapiens
gaaaaagcaagaacgttgatttatcgtcttcgtggagtgttaacttggccacgagtatgtgattattaagagtctcagcccaaaaataagatgtgtagagaaatttgtgaagaatgcaagttcctccagtgccagatgccatttgttgctatcagaagtgccatggatattctaagatccagatatacataactgatccagactttaagggttttatacgcatcagctgttgccagtgactgtaaaatagagtatcacatggattgagagaccagatccagatctcgttactgcttggataagattgacaaggattttttacaaggaatatgtataacccctgtcaggcaaggtgtcatttctaagattatcatcttcagcagtggtggtgaagttaaatgtgaatttgaacacaaggtcataaaagaaaaggttcctccaaggc

SEQ ID NO: 636062 - DNA, 353 bp, Homo sapiens
ccacctatataccggggtaggcagcgcgataaatgcgcaagtggatccagtgctatcaacgatgtagactagccatcatctacgggtggccagcagcagctacaacataggttcatccgcggaggacaaccagaccaaccgcctgcaggaggctctagaacctctacaagagcatctaggaacaacagatggctagcgcaccatctactagtagaacctgtacctacaacaagcaagatactagctacgctgagaaagtcctagctagggaaatcgaagatagaggactaactattccagaatttgctccctacactaactacctgaggatgctactacccgagcccggagag

SEQ ID NO: 636063 - DNA, 480 bp, Homo sapiens
gaccacgcaacaatttacactaagatgatcgtgatacctaacctacgaatttacatagagacagactatgagctagaattagcttagctcatgtatctaaagaactactgtaatggatacaaagctagctaacgccatgggtggaaaatacttaagaatctagaaagattaaatcttgagctacagacctatacaaatagaaacaatactattactacaaacaagaaaagacacataaggaaacaccaagtacaaaggtatactcctctcaagggtggagagcatgtggcactccaatgtgcgatctagatgctaacaatgctatgagaacatcaccacacttacacttggactgcttcctcctttgtctacatgagaaggtaggactgcatcatctctccaggtactctcttcctatcagtctaactcttccgagataaagcctcactataggatataaagaatccctaagaaaagctt

SEQ ID NO: 636064 - DNA, 686 bp, Homo sapiens
  misc_feature (244)..(244): n is a, c, g, or t
  misc_feature (594)..(594): n is a, c, g, or t
  misc_feature (630)..(631): n is a, c, g, or t
gtgactccactgacctcgatggtggtagaccaatgacctgaggagcaatagaggatgagtagggccattgcctgacaagcctggaggaagatgcagagagccacaccggtgagccccgccatgtcctacctgaccagctaccagcctcctcaaaaccgctactactatgtggacggggatcccctacttcatcagtccaaacttcccggaggaaagacagagtgcccctcctggctgtcaacantcgaatgagagccccatggcatcagctgactgcgctcgttagttccaggcatgcaaggtcagcaggcgctccacagcttaagtgcggcagagtcgactgggcgcacaagtagaggcagcccgtgactccgaagaccagaaaggacttactgtcggaacacgtgggcagtcgccatatgctctacgatggagcttccacggtgggcaggtgaacaactgagagaacgatcgacccgtggtggaagcatgggcccgtggccggatgcaacgtttcaacgcgtggcttaggacgacgagtacacatgtctagcgcaccggagtagggcgtagtcccgagtgatggattcagancatgggagacgaatcgagtggcgtgcgtcgtccgtnnttggaccgactggcggtatacccgttccgtgggatccgttccctagcaacctagg

SEQ ID NO: 636065 - DNA, 132 bp, Homo sapiens
  misc_feature (37)..(37): n is a, c, g, or t
aagtcggtaccgacgctctcgggggacagtgagaatnttggtacagccaggtcggccttgagaaagcaggctgtctaggtgaggtctacgcaaggtacagttcttgcaccccaagtttgcatttggacttta

SEQ ID NO: 636066 - DNA, 804 bp, Homo sapiens
  misc_feature (476)..(476): n is a, c, g, or t
aatcatcgcgtatccccaccgggcgtcaaagtatttagctgactcgccacgactccacggtaagcaatgatgaaaatagatctgctagtcagttgcatcatgatgctcctagtgattcatctttcttgttcatccagtagagtgagcctgatttggcattgtattacccaactcatcactaggatatcgtactaaagcagacaggtactacgtggtggctcaagttcgcatctatgtccttatcgaataggagcatgtatttcgccattcgagtacggacggcttctaatgtcgagcgtagtattttcgcgccgtattcctcgagtgctacatgccgctagaattcaaaactctacagttcccaaaattccattgttcacatagtcgatattcgaatcagcgcgtaacatcgtaatcattacgttcccactagacactttctcgggacctaatccctgcgaatggcacccggaacncgtatacgtgccggacttactcccggaatagccgaattacgactcgacattgataacgatccgtatcatctgtaggctccattcattgttgctcataacaagctagtaatcattaatgacattttcgatgatttgagaaagccttcggttcgaagtgaaaagtccgtactagtagaagaaggcctgcagtaaacctggagtgagctatatggatgtccgcactagacctaccacacattcgagagaacccgtatacataaaatctagacaaataaaggaaggaatcgaaccgccaaagctggtttcatgccaacccgatggctccatg

SEQ ID NO: 636067 - DNA, 100 bp, Homo sapiens
cacagaatgggataggggatcatgcatctggtggccggctcctcaagggcatggttgtggaccacatttacttctgcttggtcttctgctggtgctggtg

SEQ ID NO: 636068 - DNA, 107 bp, Homo sapiens
cccgcgctcagctctgtccctctcatccgcgtatttggaagagatgtttttctcctcggctaacgactgatcaaatttcctctgcttcttttccagcttgagacacg

SEQ ID NO: 636069 - DNA, 205 bp, Homo sapiens
gtacagagacaaccacatacaaaatatgcaaactatttgactatagatatctctccatagaagacataccaatggccaataggcacaagataagatgtctaataccattaactcattagggaaatgcatatcaaaaccacaatgagattccacttcacatgcactagaatggctcaaatagaaaagacagcccttctatggtagt

SEQ ID NO: 636070 - DNA, 418 bp, Homo sapiens
  misc_feature (412)..(412): n is a, c, g, or t
gtaggacgaccattcttaaaatttctctcgttcatttggccttaagttcaaagctgttacaagctgttacccaccatgtttacagtttctgctatctatcagtaagcaggaggtctaataagaattgccttaaactggccgggcacagtggctcacgcctgtaatcccagcactttgggaggctgagcgagcggatcccctgaggtaaggagttcgagaccagcctggccaacatggtgaaaccccgtctctactaaaaggacaaaaattagccgggcgtggtggtgggctcctgtaatcccagctacttatgaggctgagcagcagaatagcttgaacctgggaggtgaagattgcagtgagccgacatcgcgctactgcactccagcctgggcgacaagagcgagactcncatctc

SEQ ID NO: 636071 - DNA, 161 bp, Homo sapiens
tctggccctgtagagaaaggccgagctaccagttcatgtcgttcctcttcatcatcttcatcatcttcatcctcctcttcctcctcttggtcatcattttcttcctcctcctctacctggtcatggcaagacctcgtttctcctccgttctcctgcttcct

SEQ ID NO: 636072 - DNA, 476 bp, Homo sapiens
gctccaaaggctgtatcctagctttatttttaaagggcctgcgccgcagagtcaatataaaaacacaaaaagtcccgtcagtttaataacaataaaaaaccccaaaagtggaaaactgagggcaagggaaatgacccctaggcaggggcacggggatccctgctcatggcaccaggcctggctgcagggtcccccggtattgctgttgctacgaggttggggggcagcgattgtcctgtgggagccacggccgtctgagtcaggaccctcatttcttctggggtgtgctcagcttctgcatgccccggatcttgtccagcaggccagagatgaaggcctcagtgggtttgtaacagtcaactaacagctccttgaccctagcagcccgggtatcatcactctccatgtctaaaagttcatccacatctatctcgagctccgggatctcctcctcctggcagtcgtagagtcgcgtg

SEQ ID NO: 636073 - DNA, 954 bp, Homo sapiens
gtatcagatgtgagcgcttgacccgatgcaatcaggtgtactagcgaatacgtgaagatatattgtgcaagctgatgatcctccctaatatgcgtagaaggaataacgggcgtacctgcggttcccttatgagcatacatctcatacatcctcaaaatccacatcgcgtctatagcccagttgattgtgcctatagccaatattgaggtctatggagatgccgtgtcgatgtcatattgggggaccattagaccacatactatttctctcatgtcgaacaaatatggcactagcaagtaggtatcatggagcaaaagtataatcggagatgcatggaactcaattcgtcctcgactcagttgatattactaccgcaaagtgactactgaactgtctcaagagacaatagagtacatcaggaattcagagatgaatgcatgctcaaccagtctagggtatttagcactcatcgcctctatctatttttaaactgtggtctatgacaaacctatttaggtgtacccccaaccttttcctccgacgcccctaaaacgacacctcctaataataactactgagggctaacgcctcacaatcaatgggaaggcaaacggcattagtcgagtgaacactatcgcgaaaaaaacttctagcctggtctataactaatctacctaaaaatcgtcgttaattatacgttcacagcacacaagtaagcattttggagatcctctttcgaacaaaattatcgccactgggtattataccgatagcccgcgggtgaagccgtgagcgggaaaatcaatttaaccaagaggtccttccctatatggctatattaaccaaaccagggaaattttaaccctctggcaaattactgcacacttatgatctcacagttgtggaccctggcccttaccaactgagccccgcttagcgctgaagggtgtccca

SEQ ID NO: 636074 - DNA, 1079 bp, Homo sapiens
ctttccagagaagcataatgagaacgtcagactgaggtaataagaccagaattcaagtgatagacgaaactgtgtttggttaaaggacacagatttgcaggaaaaacaactttgatgtagcaattttctaaataaaattttgttactgtaatgtcactatttgctgctacagtagctcaatattttacagggctatctataaagctggctccattataaaaactggaggatacttcctaaatgcagaacagaacataggcggaaactgtacaccaatggtcttccagatgggtgactgatggcatatagggtagctgatagcatgctttaactattatgcctaatagcaccggaaaaccaaggaaagtcagagaagacggggagagacattttatatataaacctgccaagttatagcattagtgatctcctttactgggacactgacaattttgtgaaactctcaaaaggaacggtgatgcagcggagacacaatgtgaatatcagataacatacagatcgggacgtacaagcatgttattagtacacccctttacctagaacattagtacaaaaatctttaaactgtgcaagtaccaagttcacccagacttggacttccatgtacgtaaatcttaatatcaagattataggcttaaactaagtgttgacacaactggaccattagactacagtaaaaactatgcgcatgttagactaaggaagacatcaaacacaacactggtccacggattacgggaaactacaccaaactaactggaatacaaaatacaaaatacaccaacaataatacaaatatcggcaaagaaaacagacacgaacccaaaccaggaagcaacaacaacgagcacacgagcaacacaagaaaaacgagaacgaaaagcacaaaactagggcacgaaaaagcgaaaagaagaacaacgaaacaacgacgcgaaacagcagacataaagcaaaacaaaaagaaagcaaaagcaaaaagacacagacagaagacaaaagaaaacaaaacaaacgacagagaacgaacaacaacagaaccaacaatacaacacaat

SEQ ID NO: 636075 - DNA, 132 bp, Homo sapiens
cactggacacgctggccgcataaaattgcgcgaacgccataacatcacggttgtctgttgaaacactgagaaaatgtatgacggctgattgactctggagtcccatactcaccttgcaagccacgtattcat

SEQ ID NO: 636076 - DNA, 288 bp, Homo sapiens
ggatccggtgagagcagcctggccaacactggtgaaatccatctcgaataacaataaaaaaattagccaggcttggtggccacctgtaatctcagctactcaggaggctgaggcacaaggctcacttgaatcctgaaggtggagattgcagtgagctgagatcatgccactgcactccagcctgggcgacaagagcaaaactccgtctcaaaaaagataaagaaaaaaagaaaaatgtcacttttaaaaaacattggagtcctgttcctccacttgacctctctcgct

SEQ ID NO: 636077 - DNA, 225 bp, Homo sapiens
tcagctcagcagactgaggtatcccttgcgtgcccactaaagcactctcactcacttttgcaccacttgtacttttacacctcaggtgcaatacgatgtacagcaaagcgaccctcggtgtcatagatcagacggaaattctctcccgctcttgtcaatgctgatgacctccatgactccagcagggtaggttatatcagtacggaccttgccatcgattctaaa

SEQ ID NO: 636078 - DNA, 541 bp, Homo sapiens
  misc_feature (82)..(82): n is a, c, g, or t
gaaaggcggagggaaaaggccagggagttaccagccccccaaaaagttagaaaaaagttcgagagggccaaaccaaaaaaanccaaaaagtatggtggcagtgtgggttttcaacccccccccagtggcaccaaagccaggtcctgttcccttttttcccagccaggagcctccccccaagcgggagtatgaccagtgttgcatacaggtcaggctgccaaatgggacctccctgacccaaacgttccgggcccgggaacaactggcaactgttaggctttatgtggagctcccccgtggggaggaaataggtgggggccaggaccctgtgcaattgttcagtggcttccccaaacgggccttttcaaaaactgacatggagcggcctttgcaggaactgggactcgtgccttttgctgttttcattgtggccaaaaaatgtcccaactgagggcctttgtcccattgtccctttgtgaccccttcatttttgataaagccctgacatttccttcctaaaaaatagcccctgggttttgta

SEQ ID NO: 636079 - DNA, 342 bp, Homo sapiens
  misc_feature (7)..(7): n is a, c, g, or t
  misc_feature (24)..(24): n is a, c, g, or t
  misc_feature (111)..(111): n is a, c, g, or t
  misc_feature (164)..(164): n is a, c, g, or t
  misc_feature (182)..(182): n is a, c, g, or t
  misc_feature (210)..(210): n is a, c, g, or t
  misc_feature (275)..(275): n is a, c, g, or t
  misc_feature (300)..(300): n is a, c, g, or t
ccagccnaccttgccccctgaccnaccttcacccgtgccccttctttctgcccttcctcaccgaagaagggctaggaacaccctggagaggctgcaggccggccacggacntcagctgagccccggctgctccttcagcctccttgctcatgttggagcacagncccagcttcctgccaggncccgattcttcttatgtcctccagcccnccctggcgtggcatccactcactccttccagcaataagaaccgtccttggcgtggagagtctgtnaacaaaccaatgacttaccaggagnacaagctcttgaagaagatgtaaatgaccttttttttttttt

SEQ ID NO: 636080 - DNA, 224 bp, Homo sapiens
tagaacaatcacggtcagtgtaccattgtcgtgaaacattggatcgcgctttgatatgcatgcaggttgcggacggctgacagaagagcatgtgcttggggctatctgttcctgtcgacgcgaggagccgtagagccagggcaagagccagtcttctccacatggcagggattgtccataccacgtcccaggggcgtgagtgctgtctctaggctgtactccag

SEQ ID NO: 636081 - DNA, 783 bp, Homo sapiens
agcgtccgccctgggctgtggaccctgcgtttgccgagcgctatgccccggacaaaacgagcacagtgctgacccggcacagccagccagtcacgcccacgccgctgcagagccgcagctccattgtgcaggcagctgccggaggggtgccaggagggggcagcaacaacggcaagactcccgtgtgtcatccagtgcctagcaaggtcatccggtggctcgctacctggtggcgctggtgccacgcgtaccagccggaggagtttgtgtgtagccagtgtgggaaggtcctggaagagggtggcttcttggaggagaagggcgccatcttctgcccaccatgctatgacgtgcgctatgcacccagctgtgccaagtgcatacgaagaacgattacagcgcgagatcactgcactgccctgaatgatgatcctgtgcacgtgcacatgctttacctgtgctgcctgcaagacgcccatccggaacagggccttctagatggaggagggcgtgcccgtatcgcgagcgagactatgagaacgatgtttcggcccgacaatgccatgggctgtgacttcaacgatcgatcgctggtggaccggttcctggaggccctgtggcttcagactgtgcatgacacctgcttcgtctgtgcgatagtgtcaggatcaacctggaatggcaagacctactagctccagagaaggacaggccgtctctgcaagagccatgccttactctcatgtgtgagccccttctggccacagactgcctcggtggccc

SEQ ID NO: 636082 - DNA, 257 bp, Homo sapiens
tccgtacgccaactcagcacttcagacgtatcaagtctgccaatgcaacaggtggcatcccctaaaccagtgctctctctcatgcaggccctgctgactgctactccaatcagctccacttcccttttagcatagaacagatgaaaagccctttttagatcaaaaatgcatttcggttaaggcttcatgaggagaaatgtgatttacattattctactacattaaagagaaatcttaattttttgggcgtacgggga

SEQ ID NO: 636083 - DNA, 272 bp, Homo sapiens
tcttgagcgcaatatggagaggtccatgtgacaaggaactgaggcttttgccggcacccacttgagtgagcttggaagctgatcttccagcccaaggcagagcttcaagtgactgcagttctggctgacatcatgactacaaactcatgagagattctgagccagaaccagccagctaagccattctctgattcctgactcccagaaattgtgcaagataataaatatttgttgttttaagctgcttagctttaggggtaacttaatagcaa

SEQ ID NO: 636084 - DNA, 970 bp, Homo sapiens
caaacggtgttcaatatgaatgccccagttcctcctgttaatgaaccagaaactattaaaacagcgaaatcagtaccaggccagattattaccagaggcttttctaagtcagggctcaccaagtagaacaaacagagcgttccagcaagaacaagcttcaaacaggtggttggcacttaccatggttccccagagcaatcccatcaagtgactggtaaccaccagcagcctcctcagcagtaaccacttggatttaccacgtagcaatcaggcctattaccaatagtcgtaggttgtgtctacgttggatggcttcccgtggttgctccgagcgcttgcattgacattggattaccggggggacccctagtctaaattgagatttccccgcacgcaagtgatcatcgatcaggtgtaaccgagacctatccatgtcctcgtaaacacgttcccaatacccaagttggttctcattaacacaacgacttacaagtttccacgtgtgcatacccccccgggcaattttacctccttgtgccttgattccaaaccggagcaatatgggattatatcagggcagaaactttttccaagggcccgcaaagggcgtcctcagcgggcccacgaaagttgagaaacccaaaccgagggtgaaaggcccccgaacctgacagggagcccacctaggggacagcgggcgcacccccgacaaagaaaccccgaatacaaagcaaggcgggataagcccccggacggcaaccttttgcagaccaacctttcccaagctcacgaagtcttcggcaacattttcaaactccctcttgaccttatttccacgaacgggggaagttacaatcggctctcacaaacttccacgcgccgccacataataacacagccaaaccttttgggcgccccaggatcggtttaaaccccaattacaaacacttaactctggtttagactccca

SEQ ID NO: 636085 - DNA, 364 bp, Homo sapiens
gggtgctcaggatgcatcctgaatcgtgatgggttcgatgtttatcatcctaccgttgttctggataggagcacctggatgggcgggtattagtgcaggtaaggcgctagagggacttacgagtggaacactagccgttcgaggtgctggagagaaagttggtcaaacagcagaaagcaaaattacaaagtgagggatgtagacaatgcacaacacttcatgcctcaccacttttggctttcgtcttcacgacgccacaaactgtttggaccattccgatcccagaggctctgagacttgctttgaacattaacagtctcttgattatcaaccttagccatgatcagcgcggtagtcgcgatga

SEQ ID NO: 636086 - DNA, 154 bp, Homo sapiens
catatatatatatatatatatatatatatatatatatatatatatatatatatcctttgtatatataaaggaaaattcctgtggactcttctgtctcctcaagctgtcacttcctctcctttcctttactgtcagcatctttattcatccgtct

SEQ ID NO: 636087 - DNA, 641 bp, Homo sapiens
acaaggtcggaggatggttgtgatgtgtcttttgttttttttctgaacatatttcaaaagcttttattgggggagtttggggaggtggactttggggccaaattcttgaaccccgttgaacccattgtttttagaggggcccccaccgggggggaactccagtttttgttcctttaagggggggtaaatttgaggttgggggaaaaaaggggaaaagtggtttcctgggaaaaattgttatcggttaaaaattccaaaaaaaatacgacccggaagaataaagggaaaagcttggggggccaaaggggggagctaactaacattaatggggtggggctaagtgccggttttcaagggggaaaacctttggtgcaagttgtataaagaaatcggccaaccccgggggagagggggtttgggaatggggcgtttttccgttttctggttaaatgaattattgggttggggacgttggttgggggagctgtttaagtttattaaaagggggtaatacgggttttccaaaaaatagggggaataacccagaaaaaaaaaatgtgagaaaaagggcaaaaaaagggcaagaaaccgaaaaaggggcggtgtggtgggggttttaaaaagcctccgcccccttgaaa

SEQ ID NO: 636088 - DNA, 955 bp, Homo sapiens
ggacgcgtgggtcgacccacgcgatccgcgagaggaaaccctgaacaaactgatccagtcacgcccagtatacccccggaggatagtgagatcatcaccaagcatggcatcaccgtcgagcgtgcccatcagtcaccgatatccacgctagcgatctgccgtgagcaagccggagcggaacggaacgcatcagcgacgcagacctaccagctctcacggtggactccgattatcaaggacatcatggaggacactattgaggacaaacttgagcaaccaaagcactacccttatatctctaccctgttcctctgcctccttcagcaccaccgccgtcaagcgcccgctatgggcactggcataagaacaaggccccaggcgaagtaccgcagtggcaccccgacctcatcaattttccatccttggcgggtgtgaagacctgcaatgagcatgcgcttgagcctaacgagggttgaacccaggccaaacggaaacttgggaggttgccttgatagggagtcaaaagagcattcgctaagccaacagaaaatgtggatggaacaccacgtggaacgcaactttgaattaaaaaccagaattgaaggaaacatcacgcaggttaagaaaaatacggatcggacacaatcaaaaaacgaagggaccacccaaaaatggacgaacaaagaggcatcctcagacggagaagtagcgacgacagaccagacgaggccaccgaccatagacgaagaatgaccacatatacgggagacaaacaggacagggcccgatgacccccacaagccaccaatggcaacacaccacaaagtgaataccaaggacaaccaccgtgcaaactgcccacgccatgcgcaaaagaccgaccaacacagggaacacgaagggagacatagccgagcaccacacaccgggagacaggacagagaagcaaaggaca

SEQ ID NO: 636089 - DNA, 126 bp, Homo sapiens
gtcaaacttacacacacatgagcagacacacacccggccttctggctcttctttcttactccataggaagcatggcaaggtctcgcagactttcctccatggcagattctggccaccccacaggaa

SEQ ID NO: 636090 - DNA, 786 bp, Homo sapiens
cgcatgtggctcacacctgtaatcctagcgcttcggtgaggccaaggcgggggatcacttgaagtcacgtgacttctgaaagccagcctggccatgttcttgtggttttcgttgagtgattttggcggcatagaaattcccccagacaccgaaatgctgtgcaggcttcctaagtaccaaataggctgcaatggctgggctcggcggctcatgcctgtaatcccagcgagcttgggagactgaggcaggaggatagcttgagtccaggagttcaggagcagcctgggcaatttactgagatactgttctctacaaaaaaatactaaatagatttagtcgcaggcatggtggtgtgtgcctgtagtcccagatgctggataggcgtgagattgggaggatagttgagcccaggaggttgaggctgcagtgaactgttgtggatcaccagcagatgcactccagccgtgggtaccagggcaaaactgagcccatggaacatgacggatcgaacaactctaatttagattaatatcaactcgaagttcagcaggtgtataaaaactttggcactctgtatagctcattttgttccactcgtgtggcttgttatggtcactagattggcagtcttctacactgtgtgtgtatcaatgttagattttgaaagtatttggttagaagtggggtttttagaaatcccgatagggggaaaaaggggagtttaaacaagtggatgcttttaatgtcctgtatgttgacttatgtaattccctttcctgatgtgga

SEQ ID NO: 636091 - DNA, 372 bp, Homo sapiens
  misc_feature (314)..(314): n is a, c, g, or t
ggatgggttaggggggttcggtgaacttcgatcctcccgcctcagcctccagagtagatgggacaaggggcatatgccactatgcccgggctaatggtttatttttttggtagagatggggatctggctatgtggcgcaggcgggtcctgaactggtggcctcaagtaatcctccggcctccatctcccaaagggcggggattacaggcacaagccaccgggctcggccagtttcctcattttttaaaggggggggcccacctcaggggtcggcggtgagaattaagtgaaaaattcaaggcaaagtccttggnacagtctctaggcaataactacggtaagtatcggaggtagagagccgggcaagggtac

SEQ ID NO: 636092 - DNA, 271 bp, Homo sapiens
cctgtaattccagctacttcgtacgctgaggcaggagaatatcttgaactctgggaggcattatgccgagatcgtgccactgcattccagcctgagctacatattgagaccatctcttaaaaaagaaaatgaacacaggataatcaggccttgagatcctccaaacttaccttttcattatagggctcctctcgtacaacctctaggtgccatccagaatgcggaagccaccacggtcagcttcttactccccatgctcatcaagctgcgt

SEQ ID NO: 636093 - DNA, 217 bp, Homo sapiens
ccatggccggtggtacccagcagaaggtttctgcaaggatgagagctccttaagccatggaccaggagcaaagttgcaggtacactgtcaggctgtgttatggatgttagcagttaatttagctctgcgtcttcagagcaattattcttagctacttaaaaaaaaaacaacaaggaaaaaaatgacccccataaagcatttgctgccccatataatg

SEQ ID NO: 636094 - DNA, 120 bp, Homo sapiens
tggatctggaggagcgaggcgctggaagggaaagatcttggccctgccctggccataggacactcacaaacactttataaaaattggggccacagagtagaagaaaaacgagtcatcaga

SEQ ID NO: 636095 - DNA, 198 bp, Homo sapiens
  misc_feature (157)..(157): n is a, c, g, or t
gcacccctgaggaaacgctgcctgagaatgaaacaagcataagtaaaagctgagctgtgagatggagcagatgacaggcacatggacatcttttgggaggcactgggatttaacttgttgcttaaagctagtctaaaccctgaaacatttcatcatnttcattgacacgagccccaggttttcttttttttttggatg

SEQ ID NO: 636096 - DNA, 929 bp, Homo sapiens
ccgaggtgttgtgtaccggggacccgaaagtgggcacaaatggctgcctggggacgacgaagaggtaaatcaccaaggattgccgaggaatttctgcggtttcccaaaaggaaaggggatgggccattatatgggggaacccgcgacaccacggcacacagtactagtgaggagcacgccacgcagattcactggggccccgccgagggaggtgctcggacaggggacaacacctcgctgacaccacacgagactcttgtggactcggtgggggacgtgggtgttcgtgcgtcttacagaaggaatgccttgttgttggcggaagtctcccccacatttccaccaccggggggagattaattaagcgagaggaagggtttctttcttaccaagcgaatgtgctctcatccagctagagagggttcttgcgtatcacgcccccgcgtttctctgggttctcgcgcgccgagacggcccatctggcacatcatatggagagaaaaggcgtcgctttttcggggaggaaacccacgaccgcgggagagtgctggggaaattttctatcgagagaggagaatgcaaagagaatttggaggacagcagcccttttttaaggacgtcgttggctgggagaaccccgttggcccggcgcctgcgccccaccccatttgtgcccacgcttttctggcgctgcatcctgagctgtctatgcacacttctgtagcgaggaggttctactcccgggagggcgccccccacatgaggcacgccccccgagcgctccggccccttacaaccccggggcaggcaaactttctggaatttgaatttttggccgcggggctttagcccccctcccccgtcccctgcccctccccttcccgagaggcttttagattttttaaaaagcctttgggattttccggcca

SEQ ID NO: 636097 - DNA, 149 bp, Homo sapiens
tcctatgatggtcttcaccaggggaatgtggcttttaaagaaaatcttctattgggttgtaactgttcatatcttccttacttttctgtgttgcttcttattgccatggtcttgggccttttaactatctgcctctgagtcttcaattt

SEQ ID NO: 636098 - DNA, 1011 bp, Homo sapiens
cagagagtacggaacgtcctggtttcgcagcggcagtgtttgttgtgccatggacttaagacagagaattagataatagcctgatgttgaaaggtgcaatgaagtattcaataattgaaggtgtgcccgagtgccacaccggtttgtacgtagggcagaccaccgcgcataggacttgctcaaagttctccatggtcttctattgggcggagtcaaggtccaggcccctgtatactctttacacagcccgtgaataagaacaaaaggcatcatcttggggagaggaatacactgattggaagtatttggagaaatcccaaaggaaggtacatcccttggaaacaaaaatgatctttgtcgccattaccgaagaagggaagaaatgggcagacttaactcagattatctcaccaaaagctactaatgagtactacattgggcccgtgcccttatttattcacacaaaccagaacatgtctcatgacttaatatttgtgtacccatcctttaatagatctcataccaccagaattcaagatcatgaatgacttgcccagaactatttgttggggcacgtcctgatttaaactacgactggctggtggtcacatgaaatatgtcacggtttatgacattttacatagtaacctccaacttcccgcaaaattggtatcactgatacaccccctttaaagacttttgattagacgtccgtcaagtgactggaccaacttttccacactcattgtgagtccaatcataaaacctactgggagatggttaatattttagacatactataccgtggtatgtcacttatatacactccttgggcaatgttcacgtgttcaaaccagcaacaccctggtttgtgcatcgcaatggcataaaggcgggcacacaactagcccaccaagtttcgcaaatagcgcactaatccgacaggtaaatccggcgagggtgactaagcaccctatctatcgactcaggaccctcatccaatctacccca

SEQ ID NO: 636099 - DNA, 319 bp, Homo sapiens
  misc_feature (17)..(17): n is a, c, g, or t
  misc_feature (26)..(26): n is a, c, g, or t
  misc_feature (52)..(52): n is a, c, g, or t
  misc_feature (188)..(188): n is a, c, g, or t
  misc_feature (301)..(301): n is a, c, g, or t
taaagtatgggcaaacnacctatatnatcagatgacctacctatcacacatnaaaagcctacacatggcaggacaccgtggctcatgccctgtaatcccagcactttgggaggctgaggtgagagtagcacttgaactcaggagttccctgggcaacacagggagaccccatctctactgaaaatacnaaaatcagtcaggtgtgatggtgttcacttgttgcctgtggtgccagttactcaggaggctgaggtgggaggatggcttgagcctgggagttggaggttgcagggagcagagntcactggagcagcctgcg

SEQ ID NO: 636100 - DNA, 256 bp, Homo sapiens
  misc_feature (5)..(5): n is a, c, g, or t
  misc_feature (66)..(66): n is a, c, g, or t
  misc_feature (68)..(68): n is a, c, g, or t
  misc_feature (70)..(71): n is a, c, g, or t
  misc_feature (76)..(77): n is a, c, g, or t
  misc_feature (79)..(79): n is a, c, g, or t
  misc_feature (82)..(84): n is a, c, g, or t
  misc_feature (88)..(88): n is a, c, g, or t
  misc_feature (91)..(91): n is a, c, g, or t
  misc_feature (93)..(93): n is a, c, g, or t
  misc_feature (102)..(102): n is a, c, g, or t
  misc_feature (105)..(105): n is a, c, g, or t
  misc_feature (111)..(112): n is a, c, g, or t
  misc_feature (116)..(117): n is a, c, g, or t
  misc_feature (119)..(122): n is a, c, g, or t
  misc_feature (125)..(126): n is a, c, g, or t
  misc_feature (128)..(131): n is a, c, g, or t
  misc_feature (133)..(134): n is a, c, g, or t
  misc_feature (139)..(141): n is a, c, g, or t
  misc_feature (145)..(146): n is a, c, g, or t
  misc_feature (149)..(149): n is a, c, g, or t
  misc_feature (151)..(151): n is a, c, g, or t
  misc_feature (158)..(158): n is a, c, g, or t
  misc_feature (160)..(160): n is a, c, g, or t
  misc_feature (162)..(164): n is a, c, g, or t
  misc_feature (166)..(167): n is a, c, g, or t
  misc_feature (170)..(170): n is a, c, g, or t
  misc_feature (178)..(178): n is a, c, g, or t
  misc_feature (181)..(182): n is a, c, g, or t
  misc_feature (188)..(189): n is a, c, g, or t
  misc_feature (192)..(193): n is a, c, g, or t
  misc_feature (199)..(199): n is a, c, g, or t
  misc_feature (204)..(204): n is a, c, g, or t
  misc_feature (208)..(209): n is a, c, g, or t
  misc_feature (211)..(211): n is a, c, g, or t
  misc_feature (214)..(214): n is a, c, g, or t
  misc_feature (216)..(216): n is a, c, g, or t
  misc_feature (221)..(221): n is a, c, g, or t
  misc_feature (224)..(224): n is a, c, g, or t
  misc_feature (226)..(227): n is a, c, g, or t
  misc_feature (232)..(232): n is a, c, g, or t
  misc_feature (235)..(235): n is a, c, g, or t
  misc_feature (241)..(241): n is a, c, g, or t
gtccncccacccctgacatacctactgtcaccctgccccagtcctaccccttcctctccatgcaantntnnccagnncncannntaanatntnaaaattggnagnaatatnnttanntnnnnatnntnnnntnnttttnnntttnnaantntattaanantnnnanntangtgtcctnatnnttaatnnttnnaatttnctgantttnnanaananaattnttncnntttcnaanattttnccctatcactctctc

SEQ ID NO: 636101 - DNA, 784 bp, Homo sapiens
ggcttcttcgccagaaccaaccggtggcttgcttgtcccagcggcgccccctcattcaccgtctgccatgccgggaggtctgcttctccggggacgtgggtcccaacttgtgaggccacataccaccgtcggccgcatccgtttccaccgatttctgggagactcatggggcattctcttctcccaccctcgggactttaccccagtgtgcaccaagagctggggagagctggcaaaagttggcaccagaattgtgccaagaggcatgtcacgtggatgggccctttcaatagaacagtgtggaggaccatctgtgccgtgagcaagggatatcaaggtcttacaatgtgttgagagagccacagaaaggttaccttttccccatacatcgattgataggaatgggagctgtgcaatcctgtggggcatgctggatccaagcagagcaaggatgaacaggggcaatgctggtgacagtcgggtgcggtggtaaggggtccgtgataaagaagtggaagtggtcatatcctcttaacccagcgtaccattggcgaggcacttgtgatgacgacttcctcaggggataggccatcctctctccaagcttgacgagcagatagcaccgtggtggcaccccagtttggctttggcaggctggcgcatcgtgtgatgggcctttccaaccattccttgaagagatgcaaaaaaattttcccgaaaggaggtttccacaaaggaggtccatttggcagaaatacctcggttaaccacccaaggctaagtt

SEQ ID NO: 636102 - DNA, 517 bp, Homo sapiens
tgagaatcgagctcggtaccgggagtggagagagaatggaagaaaaggggagagaagggaaaggaggaagaaaaggaaaggaaaggaataaattttatttcttaacagttctggatgttaggaagtccaaggttgaggggcctgcatctggtaagggtcttcttgctgcatcatcccactacagaaggcagaaggaaaagagagtgcaagaaagcaagagggcaaaaggggctgaactctgttttataataagcccactctgtgattactaatctattaccacaataacaacattaactcattcatgaaggctattttattaggccccacatcccaactgttgcattgaggattgagtttccagcacataaactttgggggacacatttaaaccatagcagagcacttaggttaattcaactaagaggagctgggaaaatcaaaggcatgagaaagacagcaaaagctagcagagagaaatgcataggttaaggaaaaaagtcacagtgaatcctgt

SEQ ID NO: 636103 - DNA, 107 bp, Homo sapiens
gcacagttttcgtaaagcccttgcacagctggataaatggcatcatgataagctatggagttgaaatgttgctagtcacaattgtgtctcacatctacactgtggct

SEQ ID NO: 636104 - DNA, 185 bp, Homo sapiens
aagctttttttttttaggtaaaaataggatccttaatttctggaaaactaagctccttctggctataactataggcctgggaaacagcaaagttctacagataaggcaaaatctttaagataatactacagtggaacattccatagtaatagctcgagtgctataatgaggtcaatagctccatc

SEQ ID NO: 636105 - DNA, 83 bp, Homo sapiens
aaaacaccctcatgttcatacacctatcccccattctcctcctatccctcaaacccggtaatgatgtcggggttgagtcggcg

SEQ ID NO: 636106 - DNA, 509 bp, Homo sapiens
aacagcaagaagaacaaagctccctgggagcttgtgggactataacaaaagatctagcatacatgtcatcatgagccttggacgctgatgacacggaggacaggactgaaaaagtactcaaagcaatagtggctgaagattctcacactatggcaatggactgtcaaccaacagattcaagaagcacagtgaacccctacacaagaaaaacccaaaggaatccacagcaagacacatcataattaaacttctgaaaactaaagacaaagaaaaaacatcttgaaagcagccggagaaaaatgacaccttacctgcaggagaaaaacaaattggaatgacgaaagatttgtcatgataagccatggaagccagaaggaagcagcaaaatatttttcaggtgtcgaaagaactgtcaaacccagattcttatatccagtgaaaacatccttcaggaatgaaggagaaataaagacaatctcagaggacaaaaaactaacagaatctgctgc

SEQ ID NO: 636107 - DNA, 1425 bp, Homo sapiens
gctctactctgaggcgtgtctcgcacgcgtgaaacgcggcaaccctgttgtctgactcctgtcggcacattcgcctactctaactcacgcttaccgctcagctaatgctgttgagctgctatggtccacctcctccggtatgtcacacggctgcgatgtccaagaattaggcaagtgctctgctggagagctcctaacgtgaccgtggtacatcacgtgcgagtcgcgagctccagattggcgcaagatgacctagaggtgacacatgaccattgcggggaggaggatgacttctcgttcgaacatacgttcgttcatgtgtagaccggggcgcatggcggatgcaaacgttgccccaggtgcatgatgtaatgtagcgacttggaaaccctatcagatcagtctgatgaaagcttctgcaacgtggtgaaccgtaccagacaagcgtctttgcaaccttgatgcaagactgcatacaacagcgcaaagggagaggattgacttgaccacgaattacaacatattgactctcgaattgggaccaacgttagcgaacacgaatattgtgcgaacggggacgcattccactctgtaccccattgatggtttaggggagcgccgcgacattcccgacaaaggtccttggccctgcagccatggttgcagcgcggaggatccatttctaggacggcatatcctatgcgggtataatatcaccaccaaagaccgttttgaggctggcgcgccgagaaaaccttgggtttatcttgggggattatccacactttcccctttgcacttctaattgcgaaaaccgctccatcttcaaggcacatcgacgtataatagaggcaaacggacacggtcccaaaagcgccgtgggaagagtatcatccgcaattttttagcacacgaagacaactacacccaaagagagtttatcccaacaaagggccttgtatagggctctggacgccccgcattaccaagcttgcgcacgatccgtttcaagccgagcgcgatcttaatcagaggcgcctttgtggatgccgacgttccgtggaattttggtggcccctatcaagtagggcgtagagacgcaacactcggacgggccaatattataacatggaaaccaaatcccttgatctcggttatggaaacacgccttcctgaagttaattacgaatggccgtaccccaaatcccatatcacacgtacaacccatttataacccgcacccttttatttaaggcccacgcacttttcttgaattcccttccaatatcaacacttgttattccccctttgatgcactttttggtattgtgtatatgccccacttgtaactattgtttgaaacccctgtgcactatgtaaaattccccataaccaaaccctgtgtatgtacccttatcccccctg

SEQ ID NO: 636108 - DNA, 933 bp, Homo sapiens
gcctagcagccccacctgcctgccgccggcctagttaccatcacaccccgggatggatgcctgcatgctgccgcagcctggccccagtcaccatcaccgcaaccatagcatgcgaggccgagacccagcatgccgcccgcctgcccctccccggctgccccgccctcagcgccgccgagcaccagagcccgggcacgtacgtggcagtctggccgcttggggaagcgggtggccccggtgctgggccttcacaattctgtgcggctgcccttgccctggcggtgggaacaaggaaagggttcatcggcaacggaagggggttcagggacgaaacaaggtagaagacttgccttcaaatctgctagcggggacacggcgcatctgagtattcaactccacagcatcggaatttgaccacccaagtgtgaaaagagttgtattctggataccaccacaaggactttgcgcatatacacctgcagcatattatagccacgcagggaacgattaccctttccccagagttggcttagtgacagcaaattgcgcaagaagaggtaactttggttgaggaagagattttgggaatggatatgtgcactcggggacaacggggcaagccgacacagagcgagacctgacactgagcgaagacgcagaacgcgagaagaagtcgggtttaacccgcacaggcttcgccgtttagcggtaggcgatacggttcccccagagagtttacacagagaggcgaaggttaagatttattttcgcagcggcaggaagcccgggtaaaaacacgatttacatctcaggaaccggcgttattcccaacaggttcagcaaggagggggtccgttccgaatcgcccaattttacccaagcacacaatttacccacgaaattagttaccgacgttggggcaaagcagatcga

SEQ ID NO: 636109 - DNA, 266 bp, Homo sapiens
cgtactgatttgagcgctaatgactgatgtggggaaacccagcgatggcctgtctgtctagattcttggcctctctcggcagcattccttccttctgggtatgtacaggaccgtctttggaatgggggtcttatgacctacaatctaaaacaaagtagctcagataatttattcatgagccagtttttacacaaaagcaaggcggaagttagagtagttttttttttttttttttttttgggcaacaaattttggcttggtcccca

SEQ ID NO: 636110 - DNA, 197 bp, Homo sapiens
gtaccgttatcattaggaggtgctacacctccataagactttgtatggattgagtagataatgcatgttaaaccacttgtatagtttctggctaactgtaaacaagatgttctagaagttctagttatcttttttttttttttttttttttttaaaattcgggttctcattgtgccaccaaggttgtatggccgggg

SEQ ID NO: 636111 - DNA, 226 bp, Homo sapiens
cccttgcggttctcatagggtgggaccaaatgacgattccaatggttctctgcattcataacgatcctcctttgcgtggagggtcactctctttagatgtgccatgaggtaccggaggatccgcagatgagcaggtggcagtagttccagtgcttcatgaagggttcccatttgctcatccggatccataatttgggcagattctataaacttagggtaggcatca

SEQ ID NO: 636112 - DNA, 1175 bp, Homo sapiens
  misc_feature (164)..(164): n is a, c, g, or t
taattctagtcgacgatggcgtgtctccctttcttcgtgtaggttgatcgagttttctatgtgtgcgctcttgaaccttcttgccgcgaaatattggtgcccgattgtatcactgttataagatgctagcagcattggactaaagagatacagaatgagacctngacactcaagataaagagagaacagggccatgccttacaagtgcatgcagctgcgagctgcactctcatcctcaagtctccgcacagttgtcccaccagaagctctgtccgacaagcctggtcagaaaggcagacatcaatacaaaatgggcagaccacacgatgggccaagaacgattgcaagccagagaaaggaaagccaagactgacagatgggtggatcgcttctctaaacgtgtactgaacggccacacgcaacaatgagtgaacagcacactaagtcaacgaacttgaacgttcctgaacgctgtcaaaaggcagctcctcctgaacacgcttctcccaaaaaagcacctaggtactaacgggtaactgctagctagcatagatagcatgtttgcttgctagctgctagctgcttgctataagctgctacagtaccagcaaaaaagatcaccgccgagagtaaaaaggctccagaccagaaggttcctgcccagacaagccacaggccaagaaagcagccgcctgcttccaaaaagctcagaaggggtcacaaaagctccagcccaggaaagcagctgctcaaaggcatctggccacgacatgctcagtggcactccataacacagtactaacacggtacagctagaccctgtcgaccaatgtatctcacgccttgcatttcacagcctgttgaagacaagcctaggaggcaacttgacagcacggatcaaactaacattcactcactccaaaacaaaacaaaaaacaaacacacagggcatgaaacatccatacctgaaggcaccagaatacgacggcacaactaactggcagggggacaaaaggaggggatacaaacaagcgccgcagctactaactaagaggaaacaacccagtcgacactgacgcccacattgtggccgacggaaccgagcaagccgccagacacactccggtcagctgtcgccgctgtagccacaccacacaccgatgaagccaacacaa

SEQ ID NO: 636113 - DNA, 229 bp, Homo sapiens
tatattatttatttattcttcgttagtttcttcagattatcacccactggagggtggaaggggagtgagcagacacacttgggaggtgtcttgagattatcatccgctcacatggtggagctgaggtggaagggagtgagcagacactcggaggtgtcttgagattatcatcgctgaggtggaaggatagagcagacactcagtaggtctgagctcaggagtatcagta

SEQ ID NO: 636114 - DNA, 348 bp, Homo sapiens
actcctgaactcatgtgacttgcctatcatcagcctctcatagtgctagggattacaggctgtgagccactgtgcctggccttcctttcaatctggatgccctttatttctttctattgccttaattttctctggcaaggacttccagtactcatgttcagttacagtggtgaatgtgggcatactttccttcttctaaatctctgagttaagacttcctatgtttctccattcactatttcatcttttggtttgtcatatttcgcctttattatatatagttatgttccttctaagcccactttgttgagagtttttatcatgaagggatgttgaattttttcaaat

SEQ ID NO: 636115 - DNA, 698 bp, Homo sapiens
caattatcactttttatgtgtgaggctctgtgtgctttcctttacatacattatctctttgagttctcaaagcagccctatgtactaggtactatgattatctccatttgtagatgaggaaaatggggcatacagatgttagataactttcccaaagtcacacagttaatagatttgaacccaggtcatctgcttcccaagatgtgttcttaaccactttatataaacagttatggacaaatactaacaattttattctgtcgttttcctggctcatagatttatttatttttctttgaatgattcatttgttcatttaatcatttaataaatatttgctgaacactctgtgtgcttgcctctacaaagcactggcctgaaccagctgaacaaaatggatttggaccttgctgtccttacagtatagtaggattcagagagtataggacaattacaataatagcatgctctaaatgctataataagggaggtactatgtttatggaaacaaaaaagatgcacctaaataagacttgggggttttaggaaaggttttccagacaaagtaatatcttttatgagatctgagagatgaatgatgataatgatgaaggagggaagataggaaaaaactccaggaaatgagacaagtttacaaatcagagtgggtatgtattttgcggaacatgaaagggggt

SEQ ID NO: 636116 - DNA, 102 bp, Homo sapiens
acaggatccctgcgcgcatcaccgcagcagcgagctctatcgcatcggccagcagctggggatcacgttctcagtgtgggactcggcgagccttgagaatgt

SEQ ID NO: 636117 - DNA, 111 bp, Homo sapiens
caccaggacgcgcagtgcttcacacggtgcatatcatgacaccatggacgcagcagagctgcatacagtgttgctgatatcaaacaccatgcatgcaagagccgcttacac

SEQ ID NO: 636118 - DNA, 114 bp, Homo sapiens
caacctgaggagttcagtcttgcgtccttcccctccccaagaagggagggggctacttcagtgcccttctgtgtgttgcctgggcaggataccttgatccacaccagctaccca

SEQ ID NO: 636119 - DNA, 185 bp, Homo sapiens
agtcattctacacggatccccctggcgtgctcaggtctacattatctttgctggagttgtgctattgtctgaatgtgtctccacaattgatgtgcttgaatatgcgcagtccccaacgcaaatagctgttagaacgtggggttttttgtttttgaagcggtgaaatctggctcggttgcccaggt

SEQ ID NO: 636120 - DNA, 488 bp, Homo sapiens
tcaaaatcttgataaatatatcttggatatctatgtggcctttcagctcagtctttcctgaatttttattgagacagagtctcactctgttgttcaggcaggagtgcagtggtgcgatctcagctcactgtaacctccacctcccaggttcaagtgattgcctcccaagtaaactgcgattacaggtgcccgccaccatgcccagctaatttttatatttatagtagagactaggtttcaccatgtctgccaggctagtctccaaactcctgacctcaactgatccgcctgccttggcctctgaaagtgctgggattataggcatgagccaccgcacccagccataataatacttcagttcaaaaactagactgtcttgtagccattacacccgaacaagatcatgtatattgtgggaacatggatggagctggaggccattattcctaagcaactcatgcaggaacagaaaacaaatacacatttct

SEQ ID NO: 636121 - DNA, 150 bp, Homo sapiens
catatgaatgagcgcggtgggagtcaggacgccatcgaggtcgaacagcacggcatggaacttctcatcgagggagggcgagtccataatcctcatgctattcaccatgtggggaagggtcatctcgattcgatctccaggaggttgctt

SEQ ID NO: 636122 - DNA, 610 bp, Homo sapiens
gtatatatacgcatgttcttcataagtcatttgtcttttgatttcaccctggtcatttggaataatgtcaccgagattagagttcttcaaaaatctgatgtaaaatttaacccatgtagaaaagttttcttctgatgttaaagtgtgtggtggtaagacattatttctcacctttgtcttagcttgaggtacttcagagtgttgatcctgtgaatcgattggatcaggtgaggaagtactcagcggtgggatatactgtggcagcggatagtgtgtgtccggttgataatacgcaggtgacgtttgataatgtgaacacgtcatcatagatggttgttggtaatgtgcccagttagaggccatagctttgtttggggtcatcatgccgtgctgttggtactgtccattctgtggaggtggtactgaagcaggttgaggagagacatgatgatggttctctggaacagctgatgtcccaggtgttgtctcttgttgagaattaaccttagtggaatctctatcaaattccggtaaattggaagctgaaacggctaacggatcttgatttgatgggacttccttagaagtaaccgaagcataggcgctacca

SEQ ID NO: 636123 - DNA, 103 bp, Homo sapiens
gagctgcgtgcagcatggtcacacacttcttctaaatgacaggctctgctcgatgagcagtgcagaagaggattgctgttccccacctcccgcaggttctgga

SEQ ID NO: 636124 - DNA, 463 bp, Homo sapiens
cccatgttgggggtgtctgcagtatttctcacttagtccagccaccctgcctgatttcattcattcattcaacaaatatggttcccaaagtcccaggtgagggaactgaggctcccagtgatgaaatgatttgcccgaggcctcgaaggtggcgggtggtagagctggcctgcaaaccaaagaccattgctatcaagagtggtgatggggccgggcgcagtacgtcacgcctgtaatcccagtagtttgggaggccaaggtgggcaaaccacttgaggccaggagtttgagactaccttggccaacatggtgaaaccccatctgtaccaaaaatacaaaaattacccaggtgtggcacgggcacctgtaatcccagctactccagaggctgaggcatgagactcacttgaacccaggaagtggaggttgcagtgagccgacatttcgccacagcatccgtctc

SEQ ID NO: 636125 - DNA, 164 bp, Homo sapiens
aggacgctcttgggacggcggagctatcagcgtgaccagctgctgagatctgcagtagctgacacagccttcacaggctagggagtgatggggttatcacacctagaacagcagctagctcttcccagaggaatgggacagaaatcaggcaagctcctgtgagg

SEQ ID NO: 636126 - DNA, 546 bp, Homo sapiens
  misc_feature (256)..(256): n is a, c, g, or t
  misc_feature (280)..(280): n is a, c, g, or t
  misc_feature (286)..(287): n is a, c, g, or t
ggatcacataagcctggtggttgaagctgcagtgagcctcccacctcagccttttggatagctgggactacaggcaagcaccacaatatccaaaaggctgaggtgggaggatcacataagcctggtggttgaagctgcagtgagccaaagattgcaccactgcactccagcctgtgtgacacagtgagaccctgtctcaaaaaggctgaggtgggaggatcacataagcctggtggttgaagctgcagtgagccanaagcaactttgggccaacccaacntgggcnnactccagcctgtgtgacacagtgagacccggtctcaaaaaaaaaacaaacagacagacacagaacaaaatttttccaggggttatggccctttacaaaaaaaaaggtttaccccaagaggaaggggggggccactaagaaaacgcaaaaggggggggggataaaggtacttgttcattacttatataaagggggggaaggggaagggtgcggtgagacttaaagggaaagtgggtgaccataagggaattattttaacg

SEQ ID NO: 636127 - DNA, 876 bp, Homo sapiens
ccaggctctggactaacagagcgcggatctcaggttggcaggcagggggaactatcctagtcccctgctgaggctgtgtttgggtaaaaaagtccttcttggcaactgggcgatttaatccaggttgcttctgtctctaggggctcacaggacatctggaacatgaaggaacacaacacaacccaccaattatcttggtggccacagagggccctccaaggagctgatgccctttgtgaggctagtagccatcagttaaatactgtaatccattacactgagaatagaaatgtaaccaggatgtagctgaacatgcccagctttagctgccatgtggctgggccttccatggaaaggaccagccttctctaaggagaggaggaagcagacagaggcagtgagccctcccactctgcgcttcccctcactggcctgctcacaccgctgggtgaaggcacatgtcagggttaggtagttattcaatggtatgcctgcggctcttcaggaagggctgattggattcctatctacatcttccactgcattttggcacaaaatgctctggctattgcctgaccaatcttagcggtaactccacagggatggcgttacctatgagaggccctagggtcggagtgaagctgtgtaagaaggagacccagcgggtctggttctctaaccttgggtccaactatttacaggggttcccgaaatctttacggccggaatggggcggatcccacagagaggtcggaggactcccaaggaaaacacccacccttgagaaccgggaactcgaggcccggggagaagcccacccgggagcacatggcacagaaccaccgcgggaacaaacaccgggcacaggaaaagggg

SEQ ID NO: 636128 - DNA, 447 bp, Homo sapiens
aagaaatgcagggccggagggcttgcagactgtgcgcagaggcagtccgggccatttggtagacccgggcaatttgtttagctataatgaccttgattaagaatgagtggacttagaagagaccatgagacggttggaggtaaaaattttagtgcctagtaatggctacagaaatacaagtaacggtgttgggggcattaggtaggaggggagcgcgggttgggaacgagggggaagcgtgatgggccgaaaaaatgaatgcctagaggggcccttaccagacttaatatacctaagcggggtaaatgatagatgggagaggacatttaaattatatacagaagcgagggttttggggaagtagaaatgaatataaatggagtgtatagactgggatgtgatgaaaaaaggcgtgcattgaaagttctagacaccacgcgacgtggg

SEQ ID NO: 636129 - DNA, 272 bp, Homo sapiens
  misc_feature (201)..(201): n is a, c, g, or t
ctattttgtataattaactttgatgttgagaatccacactttattgtacacttcattgccacttgaaattcatggtcttacagtgagatttgaatttctattgagcgcttttaaaaaagtaatacctaaccataaagttaaaatctatgtatattgagtcatatctaaaaccacgtataaacataaattgtatttcctgtnttaatcccaggggaagtactgtttgggaaagctattattaggtaaatgttttacacattactgtttctcac

SEQ ID NO: 636130 - DNA, 465 bp, Homo sapiens
cacaagaggatcacggcgcggaccttgtcactaaccccactcacaccctacacccgcataggcccagcgcgacagacacactcaggagctcttacataacacatgaagcaatggaatgaagaaatgactgatccaaaccctctttagagactgaatttgcatgcagaatcctaggcggttctagccacacctgtacccttgtccttcagcggctgacacccacgtattcatccccccactacctcttgaccctaaagcaaccccacctcatgtaactctgaagctcttaggccaccggagggttctcagggctccttggtcctggactgtggcactgggggcaccttggtccctggggtctctgaagtcagtgtagccctcactgctcactgacatggtgtctctgcctctctctgcttctctgtgtccctcatcttcctcccacttcattctgactggcaagcc

SEQ ID NO: 636131 - DNA, 138 bp, Homo sapiens
accggacaacggggtactgagcccgaccccatgaaagggtctggatctgtgcaagaaagaattcagggcgagtctgcagtgcaaagttaaagcaagtttattaacaaagtaaagtggtgaaagtacagctactacata

SEQ ID NO: 636132 - DNA, 295 bp, Homo sapiens
  misc_feature (15)..(15): n is a, c, g, or t
  misc_feature (26)..(26): n is a, c, g, or t
  misc_feature (49)..(49): n is a, c, g, or t
  misc_feature (55)..(55): n is a, c, g, or t
  misc_feature (102)..(102): n is a, c, g, or t
  misc_feature (123)..(123): n is a, c, g, or t
  misc_feature (126)..(126): n is a, c, g, or t
  misc_feature (175)..(175): n is a, c, g, or t
  misc_feature (191)..(191): n is a, c, g, or t
caggggggggggcanccctccctggntgccaggaggttttgaatgcccncagtcntgccctgcctgtcccctcaacccggcagggcctgtagccccaaggancaaagggggtggatggggggnttnaaaaaggggggagccccccagcctggcatccatgttgacattttttgantgtcccctggttgggnggagccaggcccttccctaaagttttgtcaaaaccctcctggggaaggggtcagggggtttgggttttgttttttaaaataaaaaaaacatgttatattcccca

SEQ ID NO: 636133 - DNA, 596 bp, Homo sapiens
tctctacctaagagcagctgacttcccgggatcttccccccactcctcacacctcacttgtcccaggcgctgccttcatccgggcgggtagcggcactggggcatggggtggtgggtgggagctcaccgccacctatcaagctctcagctactcctgaaccgggcagagatgatgaccagacgtgtatgtacactacagcatgctatgtggcagagcaccagtggggcctaatcctgcctcatcatgctgggcaggaatctggaaagggaaacatggtgagtatcagcaatcggggaagggagggggtaaataattccttcccagaagtctgtatcatgagattgggaggggaccgagcccgtgtaacatggatgtgaacagggaggatcagaggtttaatcagaacacattcttttatacaaccaactctccagagcgtgagtataggagtgccatgagcttttaagtcagcagtttggtaacctcggtatataaaatcataacccacgcgtggggggggaggggaagacgatttcagctgacagagttagtggcacccagtatggtgggcctgtagctgcaaagagcttcaggc

SEQ ID NO: 636134 - DNA, 107 bp, Homo sapiens
cgcttagagaaaacactgtttactgaacagtgctttgaaaccacgatgggtgatcagagccccatttctgccttctagagataaacctgtctcccttcctgcagggt

SEQ ID NO: 636135 - DNA, 280 bp, Homo sapiens
tgcacctgtcctgcccactggcactcggtggatggtgtgcgggcggatgggtgagttagcggacaaaggtgggtctgaggctggccctgtgttggtgtgaggtttggtggtcaggacctgggcgggtggtcctcagttcttggcccgttttctttaaagggtgtggtgctattgggtcctactgttttcccaaggtccccagcccccggaaggcaatagactcctaaggactttggtccctcagctacttgcctttggaggttggcgtccttggcccagc

SEQ ID NO: 636136 - DNA, 321 bp, Homo sapiens
cttagaggatccccggtatcgggggctaatagtcctagagaatacactaatctatagattttaatcctccaagtttgccctgccttctatttgtctaacatggcttcctaatgtatctccttctctggaagctgatagagacgctgagaacaatgggggagtcctcagctaactgccagtatgcccgggtgtgaaaggaaatgaggccgaaagcccaagaggtcgcgggctcggaaacaggacttaggaggattgtgagacccaaaggctgagccataccgtagcccctcccatactccctgcccccccccgtatacagcg

SEQ ID NO: 636137 - DNA, 139 bp, Homo sapiens
ggcttaatggtcgaggccatctcctgggccgcctggccactcgtggctaaacaagtactcctggcccccaaggtggtggtcgtacgtttttaaggcatcaacattttcccggaatttctacaggaacaagttgaaggga

SEQ ID NO: 636138 - DNA, 123 bp, Homo sapiens
ttttacctttctgactgctaccgacttttgacctacctctgacgtaccctcactactacggtaggacactctacgtttagacgacctacactacacttccacggatgcattcttgaccttacc

SEQ ID NO: 636139 - DNA, 404 bp, Homo sapiens
atatatacatgcagtactcatatattcaaaagtagagaaaggataaataaatcacagtgtacccattctataaagcagagacgaattgaacaatatacagctacctgtaacactatggattatgaaaccagatgaatatacatgatactgccatacatatccttgatagtatatacgtaagaggcacctcgtcaatatatactatttcgtgaaatcacgactttagggggatcagagatcgaaagggaagacagaaagggccattatccggaggatcatgcatactgttgaccttagatcggggatgtcctccgtcttatggaagtgacattgaactatacaccaactggatgaatgctgcgtatgctacatgtatactttcacttcactgaagctttaaactt

SEQ ID NO: 636140 - DNA, 102 bp, Homo sapiens
gagcgcgcggggagggtgcctccagggggccctcggcgggggccgggcccctccccctggtctggggggcgggaccggccccccgcgccccccgccaggcag

SEQ ID NO: 636141 - DNA, 350 bp, Homo sapiens
acactccaatatgcgggatctctgggagggagctaatgtctgactagggcttcatagagggctgcatgctgaagagcgtgttgaagctggggttctgaagctcacgtaggagtgtaccaggtagacaagagtatgtagaacagctcgggcagagattgcactggtacggcagataatatgcaggtttaagatattgtagcacctctctaaaaaactgatgccaaaagccaggcacggtggcttacgcctagaatcacagtactactggagtcttaggcaggacgaacacctgatgtcagctggttgagaccagcccttcaacatggtgaaaccccatctctactaaaagt

SEQ ID NO: 636142 - DNA, 1853 bp, Homo sapiens
  misc_feature (2)..(2): n is a, c, g, or t
  misc_feature (382)..(382): n is a, c, g, or t
  misc_feature (822)..(822): n is a, c, g, or t
  misc_feature (1149)..(1149): n is a, c, g, or t
  misc_feature (1400)..(1400): n is a, c, g, or t
tnttctgcagacgcgtggcaggcaaagaggacaagacgggagcgggtcgttcttgtgtgcgtacttcctactgtcacttttgctttaccttcttctatgtctagtgtgtttgtctgtggccagtagagttgttactgtcgtgtgttgtctctctctctcgttgtagtctgtgtcttagtagtcgagtgttttggtctgtttctcatcctgcctatgtttgtttgtcagtgttgttgtttcttagtatctttatttgtctgtggtggctgtgtctcgtgttgtttgtgtgtttgcttttttactttcctttcttttgtttttttgtcgctcgctccgcgcgtgtgttctttttctgcgggttagctctgagttgggcgctctnggactattaaatacaatcccccctgtgggggtcgctcagccgaacccaccacgcggcttgtgttggggggcgaccaccaccgtttgtggttgtcatcgctgcggggtgggtggtcgcccccaacacgcgggtgggtgcgccacacacaacatgcagcgcgggccgttggttttgtatatagctctcgtgcccgcccgcctccgtctgcttgttattatgtcgcgcgcggtgcttctcttcttagtgtgttgtgagtcagcgtcgccctcgtcggggggggcgacacaaattttttgcgcgtccatgctggaggggccctttggtcgtactcccaccccttgtttgtggtgcgaacacaacaaaagataggggggggtttgttttgtttcgacgaaacaaccacaaagaaggcagcacagagggagctcctctgtcaaaanatattttggggcccgcggcaacatattttgtggagtgcccccacgataggtggtaagtatcatcctcgttttgtcgttgctcacaccggccgctgcttcgtctgtgtggggttagaataaagacaccacacaggcggcgtgcggggctcccaacacagatagaatttttttctcccggggagtttttatagaacacacaaaaaaagaggggtctctgaggagaagacaacactcactctcttctctctctattaaacacgttgtgtgtctcactctttctctctcgacgggggggtcgacacaacacacacggcgagagtctcctcnccctcacgcgagagagggtacatgatctactctgtctgtctcgcgtgtttgttgtgtctctctctctctgctgctctcttcttcgacacacacagtgtgttgacacacactcgcgttatatgtcctcgggtgtgtctctgtgaggggtgtgtatgtgaggaggagctcagcagtagtttctctctctctcagcgtgatatagagacacacacacacgcgcgtgagagagagtgaggggtctcttcttctcncacgcaggtgtcttattgtgggagagaggggacacacaaaagactctctcgcgcggtgtgtctatagtgctgcgagagagacacacaagtgttctctcacacacagagaggtctgtgtgtataagacacacaccccccacttctctccgcgccccaacatagagagagatatgtgtgataacacagcgccacacgctgctttgtataaagaatgggaaccaccactcctcgagagagagagagcaccaaaccccccctcgcaaatatatggatggaaaccacgcgcgttttgttgtcacccactctttttctataaggggggtatatttatagagaaatattgggttttataaaagagaaaaatataaataggggggggtggtttggcccttggggtttggggaaattcggggtttaaaaataaaaaaagatttttttttctgggggaattga

SEQ ID NO: 636143 - DNA, 201 bp, Homo sapiens
ggggattacagttcaacatgagatttgagtgggacacagagccaaccatatcaagggttttgaaggggatctgtttccttctctgtacacattgctgaattctgccattggtacaaagacagagtggtttatgaaaggttgtgatatgataggaggccatactcactcatctccttcactcatctagtctctctcggatct

SEQ ID NO: 636144 - DNA, 93 bp, Homo sapiens
gcactggatgtattgagccaattactgaatctcggttcggtttatccgttccagcgcgagggagggggcaatggataattttcttgctctgac

SEQ ID NO: 636145 - DNA, 605 bp, Homo sapiens
ccggtaattccgccattatgcgccgcggggaatgaaagactatttgctggatttcattgatgctgactggcgcttgggttattaaccccactgttaaaattgcccttaaactagaaaccacgaaaggggagacaaacgagtggctttttggacatttctcccctgatcccccaccctttaatcatccatgtctggggtggggcaggaattttagggaattctgaactcacaaccacgtggcaggggaagctcctcgtcttgccatttggcctggtcccatttgaaaattggcgcgctctatttctataaagcaagtttcttcaagatgcaagccagattcgtctttctgatcctcatcatatatgaaaagagcaacttacatatcctttctttcggacaacattaaaagggaaaagctacctggttttttcttctgggcgggcggactttggatgatcaacccttaggcacgccatttgttctttctttttcctaacacaaaaaaagagggtcttttacttcttgtcaccgagcacttacttatctgccgctggtcggcttttattaaaaggaaacaccacatctctttctttccctaacaagag

SEQ ID NO: 636146 - DNA, 664 bp, Homo sapiens
  misc_feature (31)..(31): n is a, c, g, or t
  misc_feature (412)..(414): n is a, c, g, or t
  misc_feature (457)..(457): n is a, c, g, or t
  misc_feature (460)..(460): n is a, c, g, or t
  misc_feature (463)..(464): n is a, c, g, or t
  misc_feature (517)..(517): n is a, c, g, or t
  misc_feature (519)..(519): n is a, c, g, or t
  misc_feature (527)..(527): n is a, c, g, or t
  misc_feature (533)..(533): n is a, c, g, or t
  misc_feature (535)..(535): n is a, c, g, or t
  misc_feature (537)..(537): n is a, c, g, or t
  misc_feature (545)..(545): n is a, c, g, or t
  misc_feature (553)..(553): n is a, c, g, or t
  misc_feature (555)..(556): n is a, c, g, or t
  misc_feature (558)..(559): n is a, c, g, or t
  misc_feature (568)..(568): n is a, c, g, or t
  misc_feature (573)..(573): n is a, c, g, or t
  misc_feature (582)..(582): n is a, c, g, or t
  misc_feature (631)..(631): n is a, c, g, or t
agaagaaaaacgtcttgcaagaaagacttcntggtttacaacgatcaaatgtatgggctatttgcctgattggtggcctggactcagcaagagattcctttgcagcagaggttggccacacatctgggggctgcaacaccactgaaaagacagctttctaagcattagtgtaaggcaaaaagcagagtgcctaaacttggccatttccaccaagaaaaaaagtttcatagcaaccttccttcaccagaaaggcttactttatgatatgctaacagaacagaaaagcaggttgggacaagatacagactttgttgcatttagctatgacccttctctcccctctgtggatgtgggcagggtggggagaggcaggaagaggcagtagagggaaatgacatttgcactcaggctnnncgcccctacccacccctacccttcgcccagacagacgttgganttnatnntcaccaaggggtgggtaatggagtcccagctaattgccaggagctgaggcggntncaagccantaaaanangntgcccacnggctcccncnntnnctgtccttnatggnacttgcatntttaaggctgccagcttcagagctccctggtacattccctggccaattntcatccctgtgtcaaatggatgggatgccaggg

SEQ ID NO: 636147 - DNA, 248 bp, Homo sapiens
aacttgacgatgatatatagaaagtgacagagacatcaggcattagattctcatagggacagcgcaacgtagatccctcacatgcatggttcacaatggggtgcatgctcctatgagaatctaatgctgctgctgatctgagagaaggcagagctcaggcaggaatgtgagcaatggggagtggctgtaaacacagatgaagcttccctcattcaacaccattcacctccggctgtgtggctccttac

SEQ ID NO: 636148 - DNA, 116 bp, Homo sapiens
cgcaggacaagctgtatcttactaggagatcctcatagcagatccccttttactcacttgtctgactgcttttgtgctacaatgagcaagacgctcagtaagttgtaacaaaagat

SEQ ID NO: 636149 - DNA, 360 bp, Homo sapiens
acccgtctcacttctgaatccttcaacatcgtgcatactgcttctcactgttctgcaatcgaaatactgtgcattctgtatctggtcctgtgtacctgtaatggtaatagtatctcgatctgcgcgatccttctaaaggctcatcgaatttatgatctaagctcccgagctcatgacgtgactttgttcaatccagtttgactatcttagccaactcatagatccagctaaaactatgagaatagtaacttgtgtagtaataataggtccatcaagatcagcatatgagccacgatcccctgcatcggaataatcatatccggagccaccctaaaaacagaaagaaaaaaatagaaaatt

SEQ ID NO: 636150 - DNA, 129 bp, Homo sapiens
ccggaacgtactacgtagtagctcacttccactaatgtcctatcaataggagctgtatttgccatcataggaagcttcattcactgatttctagctacatctcatgtactcctattacgtgtccggcca

SEQ ID NO: 636151 - DNA, 446 bp, Homo sapiens
  misc_feature (15)..(15): n is a, c, g, or t
  misc_feature (67)..(67): n is a, c, g, or t
  misc_feature (113)..(113): n is a, c, g, or t
  misc_feature (140)..(140): n is a, c, g, or t
  misc_feature (144)..(144): n is a, c, g, or t
  misc_feature (146)..(148): n is a, c, g, or t
  misc_feature (150)..(150): n is a, c, g, or t
  misc_feature (164)..(164): n is a, c, g, or t
  misc_feature (167)..(167): n is a, c, g, or t
  misc_feature (169)..(170): n is a, c, g, or t
  misc_feature (175)..(175): n is a, c, g, or t
  misc_feature (289)..(289): n is a, c, g, or t
  misc_feature (292)..(292): n is a, c, g, or t
  misc_feature (338)..(338): n is a, c, g, or t
  misc_feature (366)..(366): n is a, c, g, or t
  misc_feature (369)..(369): n is a, c, g, or t
  misc_feature (381)..(381): n is a, c, g, or t
  misc_feature (385)..(385): n is a, c, g, or t
  misc_feature (437)..(437): n is a, c, g, or t
tgtagttttaaatangataacaagtattatgtgttacatatagatatataagacgaatacatttccnatagattacaaatgatttattaccaatctaaatctcattatttttnataatctgtataatgaatatgtaaacntgtnannncncacacgtcacatcngantnnccggncttcccgccctccatctcccgcagacatgtgaacaacaagtctgacaacctactactaggagccaacatctaaaaaggcatttcgcatcctacagttggcaatgcctgagaatnccncttgtcctctgccttgtcccacacttattaaggacgtcttcccccncccattctagtagatgtgtagtagtggnatntacttcaggttnaatncgcatttacatattgacttaacgaacattgggcatctttttgagtgcatgtntgccattaa

SEQ ID NO: 636152 - DNA, 135 bp, Homo sapiens
cactgtccactagattcaactttcatgtgaggggtattcggcactgctactttttaaaaaatccgatgcacattcaacttttcacccagtaactcaactgccaggaatttattgttatgaataaatatttatttt

SEQ ID NO: 636153 - DNA, 1060 bp, Homo sapiens
accactgacatgactttccaaaaaacacataattgtgaatcaacacaaccacccacagccgtaagttattagcatcatcccgtctacgtattttttaagccaaagtcaagcgaacaaccgtatttagctggttgcccaaccgttgttccgtccgagcccccgtaagcaacaccccgcgtccgtaagtagcgtaagcgtaccgtggacgtccgtaccgccgtcaacaagtcatggacaaaggccaagcgcgcacgttagtcgcaggtgaaaccagcgtagtcagcgaaaaaagaagagcgtcgtaacgcgtcgtcgtagttaccgttacagtctgttccgccggtaagcgaagaagtccgtccgcgtgtgaagtgtaattaaacccacttgtcaaccgaggacccaagcgagggaaaacgcgttgaggtccaagtaactgttggtgacacatcagttccccattccttcacgcgagaaagaacccagacaagcgttataggtcgcccgccaacacgtttggggccttcagtcaaatccaacacacggaagttagaagggacgagacagccaaggcacgaagaaaaccaggcaccagtggaagaacagcaagggacaaacaagtacacatttccacaataagtagtcataagacaacccccaattaaggataagggacatcccgccgtttccccacccgtaatgcttcacagtccggggcacaccttacaaagttatagaacgcagacgcatccaagccaacagcacagccacccgataagaggccgttccaacgccgtttacagaacccaaatttttcgttaaacgataaagagttcagagagtacaatttacaaagcgtggaagcccacagaagaggaaagaacgcgttatattgcaatgagaaatattcacaattgggaaacggagcccgaaagaactgaagagacatttataagaaggtagaagtggggacacggttaagggggagttttgaaaccaagccaaagagataaaaagcgaatgttatagtcgaagtaatgtataaaaaagaggaacatca

SEQ ID NO: 636154 - DNA, 650 bp, Homo sapiens
agcgggggttttccaatgctggttttgaagtcgcggccgctgttcctgggacgtccggttgaccgcgcgtctgctgcagagaccatgtctgccgacggggcatggaggctgatggcagctacccaggtgacagtggaagaaccggtacagtcgaagcccgagtgtggtggaccgtgtggccagctatgcctctgatcagctccaccgtgcagacaatggtgtccgcagcctatgcctccaccgaaggcagagctacccgcacatcaagactgtctgctgcacgcaactagagaagggagtgacggaccctccacggcggctgctgtcagcggggcatcagccgatcctctccatagctggacgccccagattgcatcacgccagcgaatacagcccactagggggctggacaagttggaggagaacctcccaattcctgcagctagcccacggagaaagtcctggcggacaccaaggagcttgtgtcgtctaaggtgtcggggggcccaatgagatggtgtctacgcgccaaggacacggttggacacccaatgtgtcggaggcggtggacgcgacccgcggtagctgtgcagagcggccgtggacaagacaaagtccgtaatgaccggcgggtccaatcagtcatgggc

SEQ ID NO: 636155 - DNA, 331 bp, Homo sapiens
tcactgtcagacggtctacatatacagtacacaccagtcggtgtctgtcgatatcacaatgatagaattcaacatgcagccaggtgcagttggctcacaactacaatcccagtagtttgggaggctgaggcgggtggctcacaatggtcaggagttcaagaccagccgtggccaagatggtgaaactccgtgtctactaaaaatacaaaaaaattagccaggcctggtggtgagcgcctgtaattcccactactcaggaggatgaggcagagaattgcttgaatccgcaaggcagaggttgcagtgccgattcttggctgatgtgacgatt

SEQ ID NO: 636156 - DNA, 814 bp, Homo sapiens
gatttaggatgaggcttctgctgcttctcctagtggcgggtctggatggtccggagcagaggcctcggccaatctgggtgggtgcccaggaagagattaaagatgcacgtacgccagggggccgcgtgcgtctaagttccagattggtgttgcctcgaggttataggcgggtgtcagatggagtcgagtgcggggtgattaggccaggtgacccagacatccgcattgaaggagagaattaccttcccgtcaacctagtatatagacactgtaagcatctgtccgtgtcagtcttcaaacctagtattaatagggttgataattgtgtggcaaggatcctttgtgctttcttgtggatgaaggctgttaggatctggcaggggggccatgatgttaaggttgatgcatgtatgatggtttgcttcttgagacaacatgatgggagaaccagtgtatgtcgaatcaggtgcgtttgaggataacctttaaatgatgtacctgtgtggtctaagctggaatctggtcacctttccatccatgcaacaactgtgttcaaaattctgggacaatgacatggaggctcaatgtgcatatgggattcaatcccacaccacttcgatcatagcagcactatcagactgaaagctcttggccttagggacattgcaagacgcggtgactgacattttgaggctgtacggagaagccagtgttgtcagacaaatcttttgggaggcggtgctctggaaccccggggaatgttcgggggaatgggacggcctcggggcaaaatgtggttccccccaaacaatgg

SEQ ID NO: 636157 - DNA, 1339 bp, Homo sapiens
agtagtgcttagatcgcaagtcgtgctgaccttcaatgctgcacagtgagtaagcatgaaaacaggtactgttatggataccaaggatcgatgaagttaacaactgagatcaaagaactgaaagaaactctatgaagaacaaaaccaaggcaggcagatgactacttgcgatcagtactgttcctatgcttcataagccatgagagaagttagagaaacgctacagagatgttagagacacaagtggcccatctgtgtgcaggagcaatcgtaaacaagattccgcgagggtctacctatagccaaggtccagttgttaccaggaccatctccaaataccctatctgtatactgaaaacgaggttactcatctggccaaaaatacaagcttcaggcacagaggcaaagatccagtggaatatgggacgaatggtagaggaccaaacaactgcataccaccagagagcataaaactacaacaaagcaagaaagcagcacaatgagaaggtatacacccatgcagacagacacggaaaggtacatgcgctagagccagagaggacataccagaagatagacaagaaagggcttagcatagaacaattaccgacccgggacgacgaacataagacacatatactcacgtgacggaaagaaaaatccaatggacgaccatcaggacccagcacccacagcactggcattggcaccggaaagatatagcgcataatcccccactgaagcacacgacacaagaaaaatctatgacgaaagctccgacaaaaacgcaagactgccatgagatggacaagcatcacacacacaaacggaccacagactcgacaacaggcacaccagcgacgattacatggaacacattacaaccagaaaatacacacaggaaaacacaatgccaagcaagacaacttcacttaaagaaagatcgaagtgaagtcccacgtagaagccgtctgcgggcacagacacggcagaatatgaccgacaaacaacaatactaacaattggatccaacaatataaccataaacactgcaacgaccccacatcagcgactttgcttaacctaacacacaccatacaatcgtaagctaactaaacacaaaatatgccatacaaacaccataaacacgacacacgatctagagaacaacctccacacaatctgagattacagtaactaaactaaagccacacacaacaagcacactaccactcaccaaacaacacaagaaatcaacagacatacaaacaaaacacacactactcatttacatacaccaccaatatacataaccacatcacacactaacaacgaaacg

SEQ ID NO: 636158 - DNA, 362 bp, Homo sapiens
ggcccctcagaatgatattgggcctcacgttaggacatagcctatgaagtctgttgctatagttcctagcaggaggataatgccgatgtttcaggtttctgagtagacatatgatccgtaatataggcctcgcacaatgtgtaggaagaggcagataaagaatattcaggcgccattggcgtaaaggtagcggatgattcagccgtaatttacgtctcgagttatgtggtcgattaatgcaaagtcggttgaggcgtctggtgagtagtgcatgtctaggtatagtcctgtggggatttggaggatcagtcaggcgccaagtagtgagcggaagtttcatcgtgcggagatgttggatgggc

SEQ ID NO: 636159 - DNA, 141 bp, Homo sapiens
gggttggcagataactctttcaccctactcaatgtaagagctcatcttcaacctgggtgacagagtgagactctgtctcacgagaactacctgtaagtaaacagttactaatgaaatgggattatacaccaagggcagaac

SEQ ID NO: 636160 - DNA, 725 bp, Homo sapiens
  misc_feature (699)..(699): n is a, c, g, or t
gttttcccctttctccctgttccctccttcttgtctccctcttctttcgtattttcctctatctttttttcttctcatctccttttgttcctctcccttgactctcatgtctttcactatcttttcttcttgaacaagttgttaggtgtccttcgcctcttatttctgtacctcttgatctcttacatgcgtatcctctctttgcgccgttttgctttgcgtgccttgtcttcccttgtatccagatgtgtctggctgcctgtggagattctgcctttccctgtagcatacttgtgtttctattgcattatctggtcagtatatcagttatcatagtgtgccatttcaagtcctacggtgtgggcttccatgactgctctttaatatgaagtactcaagtctctcttgggtacttgagctggaaagcctatcacggacaactgacgggctacctgttttcactttgataaactttgacttcactggaacctttacaaactaatctcagacaaattttttggtgcccatgcagctgtagttgttcactgctttcctggatggatgggactcttatgtcataacttctgtactcctctggcaccatagctaatggtcatccttctcccacaagccccggctttgggacttgaatgatacagctttgcttctgtgtagtatacctgtacatacctgtttcantaccccggggggggggaatgtatttt

SEQ ID NO: 636161 - DNA, 390 bp, Homo sapiens
cacccggactggccttttcttcccccatcacggccctcgcttctccctgcaggagctcgggggcgaaacctgtgtctggatttcagtgcatgacttcagatcctgctccaacatgtcaggtgtgcggtcatgttgccggacaccctaatgtaagcaaatgttgttcagtgcgatcaatgtatattgacttccgtactggtttacgcaaaacccaaaggtacctgtgaaaacccatgtctggaaatgtttggcgcgttaagctgaatgaccttctgaccctgggccgttgcgtacgtatctaattcataactgcgttaattgtattgataaagtgtttgggagtattttgcgcttgtgatgtggaaataaagtgtttgatctaaactttga

SEQ ID NO: 636162 - DNA, 544 bp, Homo sapiens
  misc_feature (12)..(12): n is a, c, g, or t
  misc_feature (24)..(24): n is a, c, g, or t
  misc_feature (87)..(87): n is a, c, g, or t
  misc_feature (111)..(111): n is a, c, g, or t
ccagggcaaggncaagttcagttntggcaagcctgcttgcccatagacttccccccaagtagtctcaggccttttgacatgtccttnaggggcccttaagaaagaaagtgnagggacactccagaggctgtcgtggaggatcatgtgagcctgggaggtcaaggctgcagtgagccgtgattgcaccactgcactccagcctgagtgacagagcgagaccctgtctcaaaaaacaaacaaacaaacaaacaaaaacagaacattctgggcacggtggctcatgcctgtagtcccagcactttgggaggccgaggctggtggatcacaaggtcaggagattgagaccatcctggctaacacagtgaaaccccgtctctactaaaaatacaaaaaaattagccaggcgtggtggcggtcacctgtagtcccagctactcgggaggctgaagcaggagaatggcgtgaacctgggaggcggagcttgcagtgagccgagatcacaccactgcactccagcctgagcgacagagcaagactccatctc

SEQ ID NO: 636163 - DNA, 270 bp, Homo sapiens
  misc_feature (5)..(5): n is a, c, g, or t
  misc_feature (7)..(7): n is a, c, g, or t
  misc_feature (15)..(15): n is a, c, g, or t
  misc_feature (40)..(40): n is a, c, g, or t
  misc_feature (147)..(147): n is a, c, g, or t
ccagngncccagccntgtggattgaaaccacagcctacgncctgctgcacctcctgcttcacgagggcaaagcagagatggcagaccaggctgcggcgcatcacccgtcagcagcttccaagggggattccgcagtacccaagacanggtgattgccctggatgccctgtctgcctactggattgcctcccacaccactgaggagaggggtctcaatgtgactctcagctccacaggccggaatgggttcaagtcccacgcgctgcagct

SEQ ID NO: 636164 - DNA, 348 bp, Homo sapiens
  misc_feature (5)..(5): n is a, c, g, or t
  misc_feature (31)..(32): n is a, c, g, or t
  misc_feature (78)..(78): n is a, c, g, or t
  misc_feature (93)..(93): n is a, c, g, or t
  misc_feature (179)..(179): n is a, c, g, or t
  misc_feature (197)..(197): n is a, c, g, or t
  misc_feature (232)..(232): n is a, c, g, or t
  misc_feature (241)..(241): n is a, c, g, or t
  misc_feature (305)..(305): n is a, c, g, or t
  misc_feature (348)..(348): n is a, c, g, or t
cgacncccagctaatattttgtatatttagnngagatcacgtctccctgtgttgcccacactgtgctcgaactcctgngctcaagcaatcctnctgccttggcctctgaacatgcagtgattacaggcgtgagaaccaccgtgcctgacctgaggtgtgcactttagacattgagagangccaagttcacattttgntggtgaacagaaatctaagctggcctccttttggntcaggagtntttatgaattttacttttttgggttctttttggcttcttttatttttacccccactggccctgnattctctcctgtgctcggtcgagaggatcttaacttgcagtgn

SEQ ID NO: 636165 - DNA, 131 bp, Homo sapiens
agtcgattcatacaggatcccgttgggccacgcaccgtgcccagctaagttatttgtgttatcagtagaaacgtgtttcgccatgttgaccaggccggtctcgaactcctgacctcaggtgatccgcgcca

SEQ ID NO: 636166 - DNA, 764 bp, Homo sapiens
  misc_feature (121)..(121): n is a, c, g, or t
  misc_feature (405)..(405): n is a, c, g, or t
ttgttcctcatccgcctccttgctcgccgcagccgcctccgccgcgcgcctcctccgccgccgcggactccggcagctttatcgccagatgtccctgaagctctcggctttctttttaatnccccgtgcatctggatcaccggacgtgccccacacatgtcatgacgccagccgtagaacaccatgctccgaagatcaccacacaaggaacttaacaggacgaagaacggaagttgtggacagcggcagacaaatgggaacgagaacgcccctgcataacggggaagtgctacatgagcgaacaactggggagcaggaggctgacaactgaaggtagaacgaaagaacgaggacacgaacggtggggcaggacagacggagcgacggacagaacacaggtgaatnggtgaggaacgacggatggacgatgaagcactgacggaacgctgagatcagctacggtgcaagccgggcagctgaacgatgactgacggactgctgactgtcgataccaagaagcagaagaccgacgaggatgactagacagcaaaaaaggaacaagttaaactaagaaaaaaaaaagcgccgccgtagacctattcaccctcacacttcccgtactcagaatctaaacggtttggtcaccttccgagtagagaggcctgcctgccaatcggtggcgcagtgccacccggagatgacaccgcgctctcagcacccaaaccaaaaccatgaggaattggcacacgggggcggaacaacag

SEQ ID NO: 636167 - DNA, 512 bp, Homo sapiens
actgcactccagcctgggggacagagcgagactccgtctgaaaaaaaaaaaaaaaattcattaacagtacatttaaaatttctgttactggagattgtatttctcattccatccattaatgtgcagcttcaatgttttcccccagatatgcaatttcacttacaggatcttgttcttcagtgacatgtcataagagttaataattccacaagccaccctgcactgctgtgatcctaacaatattgaaaggttggtgtgtatcctttcctacctttcctcattctaaaatgtttcctcgttctaaatgccaagctggttttgaacaactgacctcaggtgatccacctaccttggcccctcaaggtgctgggattataggcatgagctaacatgcccagccctaatctgctcttcttagatggatacttgtcagattgggttaagacccactctcatggcctcattttaacttaattttctctttaataaaagtccaaatgcagtccaaaaaa

SEQ ID NO: 636168 - DNA, 121 bp, Homo sapiens
gggagagctagactaggttggtcatgatgcagaggctactcaaatgcagtcggcttgatcctggctctgtccctcattcctggttctggaattcctcgagttcaaggttatcctacgcgag

SEQ ID NO: 636169 - DNA, 359 bp, Homo sapiens
  misc_feature (99)..(99): n is a, c, g, or t
  misc_feature (121)..(121): n is a, c, g, or t
  misc_feature (133)..(133): n is a, c, g, or t
  misc_feature (138)..(138): n is a, c, g, or t
  misc_feature (168)..(168): n is a, c, g, or t
  misc_feature (187)..(187): n is a, c, g, or t
  misc_feature (217)..(218): n is a, c, g, or t
  misc_feature (259)..(259): n is a, c, g, or t
  misc_feature (271)..(271): n is a, c, g, or t
  misc_feature (281)..(281): n is a, c, g, or t
  misc_feature (285)..(285): n is a, c, g, or t
  misc_feature (287)..(287): n is a, c, g, or t
  misc_feature (321)..(321): n is a, c, g, or t
  misc_feature (324)..(324): n is a, c, g, or t
  misc_feature (335)..(335): n is a, c, g, or t
ccctgagggcccttttgcctaaaattaacttaatttgtagaaaacaatggattccgttaatatcctttccatttatggaaaaaattgttaggggtgccnagggctttttattaaaagtttntctttaaaggtntaaanaattgtgaatcagttgaatgttgggccccnaggggaaacagtttgtaanaaatgatttaaatttttcagttcagttccnncagtcccttggagctttgcaatttccagaccagttttttcntttttaagttcnttacaagccnggananattttgaaattaacttgaacctgaggatttggcncangatgggttaanaaattttaactttcaataatttga

SEQ ID NO: 636170 - DNA, 634 bp, Homo sapiens
cgcatcaggaggaatagctaatggatgctgcacttattattgaggtggtgggttgatctgtgcagcaaaccaccgtggcacacgtgtacttatgtaacaaacctacacatcctgcacatgtattccagaacttaaaataaaagttgatgggaaaaaaaagaaattgaggtttaatagagacttaaaattcagaaataaaaaaagttttggttctggctgtaatagagtggtaagaatcacattcatctttccactgtaaatacctataaaacaaactatatgaaaaagctgttctttggcatcgtacaatagacaacataagactttgattctcaagagaagggctgcagttgttatcgtgagtcatgcctgtaataccagaattttgggaggccaaggcaggaggatcgcttcaggccaggagttcaagacaagcctggggaacatagtgagatcccatctctgtaaaaattttttttttttaattagctagatttggtagtgtgcgcctgtagtccagctgctcaggaagctgaggtgagagaatcgcttgagcccaggagtttaagactgcagtaagctataaatgtgccactacactccagcctgggcaacagagtgagactgtatctca

SEQ ID NO: 636171 - DNA, 161 bp, Homo sapiens
gggtggaagttctccaaaacaatatccacaacaaagtctgacctcactctgagggagatgggaagttggaggaagaaggacttaaccagcttccttgagttaggaggattttgctttccgtgtttcccaccagggctatatgtccacattcaggtgggcca

SEQ ID NO: 636172 - DNA, 771 bp, Homo sapiens
  misc_feature (1)..(1): n is a, c, g, or t
  misc_feature (493)..(493): n is a, c, g, or t
  misc_feature (500)..(500): n is a, c, g, or t
  misc_feature (507)..(507): n is a, c, g, or t
  misc_feature (512)..(513): n is a, c, g, or t
  misc_feature (520)..(520): n is a, c, g, or t
  misc_feature (524)..(524): n is a, c, g, or t
  misc_feature (529)..(529): n is a, c, g, or t
  misc_feature (534)..(535): n is a, c, g, or t
  misc_feature (540)..(540): n is a, c, g, or t
  misc_feature (544)..(544): n is a, c, g, or t
  misc_feature (548)..(548): n is a, c, g, or t
  misc_feature (553)..(553): n is a, c, g, or t
  misc_feature (557)..(557): n is a, c, g, or t
  misc_feature (564)..(564): n is a, c, g, or t
  misc_feature (572)..(572): n is a, c, g, or t
  misc_feature (581)..(581): n is a, c, g, or t
  misc_feature (606)..(606): n is a, c, g, or t
  misc_feature (609)..(609): n is a, c, g, or t
  misc_feature (616)..(616): n is a, c, g, or t
  misc_feature (619)..(619): n is a, c, g, or t
  misc_feature (623)..(623): n is a, c, g, or t
  misc_feature (627)..(627): n is a, c, g, or t
  misc_feature (631)..(631): n is a, c, g, or t
  misc_feature (635)..(636): n is a, c, g, or t
  misc_feature (642)..(642): n is a, c, g, or t
  misc_feature (645)..(646): n is a, c, g, or t
  misc_feature (651)..(651): n is a, c, g, or t
  misc_feature (660)..(660): n is a, c, g, or t
  misc_feature (675)..(675): n is a, c, g, or t
  misc_feature (696)..(696): n is a, c, g, or t
  misc_feature (701)..(701): n is a, c, g, or t
  misc_feature (711)..(711): n is a, c, g, or t
nggaacaacaaagttattgagttccgtgaaccagaactcagaacaactttgttgactctcccccctctccggagaggacataactgcctttggaaacggtacggttctgtcgagtcccgaggcggatctcctgaaacctcctaaatgccaagttcaaagcacaagaaacatgtgtttttaacagccctaccctggacggtcgccaatgaggcctcatgttcgggcattccttttctttctgtgaaccagaatcttcctcggctttttagggagcaggaaaaatgcgtctaaagcaactctttttaaaaacctgccctgttgtatataactgtgtctgtttcaccgtgtgacctcccaagggggtgggaacttgaaattaacgtttaaaggggccacgatttgcccgagggttaatcctttgctctcaccttgtatggattaggagatgaagccatttcttatcctgtagatgtgaagcactttcagttttcancgatgtnggaatgnagcannagaagcncgtnccttnacacnnagtgncgtntgtncttgnccanatgcgcngggcgtcngggaccttnaatgcctgccctggttgtgtggacnccntaatgcnaancatntctncacntctnngggacnccnngggcncctgttganaagtgtggagaaacncctaatttaaatgtcacaganaatgncctagtgttnactactacaatgttgatgctacactgttgtaattattaaactgattatttttcttatgtc

SEQ ID NO: 636173 - DNA, 450 bp, Homo sapiens
  misc_feature (35)..(35): n is a, c, g, or t
  misc_feature (82)..(82): n is a, c, g, or t
  misc_feature (85)..(85): n is a, c, g, or t
  misc_feature (236)..(236): n is a, c, g, or t
  misc_feature (238)..(239): n is a, c, g, or t
atccataaagaaaagagctttaattaactcacagnttcacgtggttggggacacctcgggaaacttacaatcatggcagaangtnaagtgaaagcaaggcatgtcttacatggcaccaggagagaaagagtgtgtaaatgccacacttttaaaccatcagatctcatgagaatgaacttactatcatgagaacagcttgggggaaccacccccatgatccaagcagctcccacccngnnccttcctccacatgtgaggattacaatttgagatgagattcgggtggggacacagagccaagccatataatttcaaccctggcccctcccaaatcttttgtccttctcacattttcaaacacaatcatgccttcccaatagaaccccaaagtcttaacttatttcagcattaacccacaagtccaagtccaaagggttatctgagacaagc

SEQ ID NO: 636174 - DNA, 127 bp, Homo sapiens
ctatggcagcctcccaagtagctgggactacttgcgcatgccactatgcctgactaatttttttggtttttaatagagagggggagggggtctcacttggtggcccaggcgggtctcgaactcctga

SEQ ID NO: 636175 - DNA, 762 bp, Homo sapiens
  misc_feature (291)..(291): n is a, c, g, or t
agtacatattggtagcgcaaccagtcgacagccgcagcaacaccaggagaggccgggggcagccgccatacggcagcgccagggacagagcacaggaaagggacccccacagtcacctagtagtttgaaggcgtcctacaacaattccagaatagctagcatttcctatacagctagtatgtagggctccacttgtagatagtaaaggtagaaacacataggtaaccactatatagagggtaatctatacaaggacgctaaagctacaaagttatgaactaagccgtaggnatagctagtagcacccggaaagcatactaagagcgcagcaggtaggccctacgtacgggacggacatatgtaggacaccataggtagtattaaagccaagtagattgtcatagctatgtatcactataccgaaatagttgactatcaactaatagctaactaaaagacaagtatcaccgattcagccattagccatgaactcgaaagtgaatggggaacacaaagagaagtccaatggatggggaccccaatgaacatgttccaagttcaatgaggagaactacggttgtgaagactacctataataagcagtctatcttcttatacggggccccttagaaaaggacaactcagaagagttcgtccagcgagagcctgcgtgcggcccgttaggctcgagagattgatcaaggccccagtaacgcctaggatcccctgtgaccgaccatgcgccctaaaagagaccctgcc

SEQ ID NO: 636176 - DNA, 240 bp, Homo sapiens
agatcttacaggtaagccgggtatggctgagagtacgggtgggagagcatccgggcagccgaggggctgagtgccccaaagcccacaggtgcacccttccctgaagcagaggtgaggtttggggggctgagtccccgcagagagttgtctcattgggtacccagcactggggcagcaccttactcctgtgtcatgtgtgtggagacctgaatcacgaccatgtactgcgcttgctgtaca

SEQ ID NO: 636177 - DNA, 149 bp, Homo sapiens
  misc_feature (131)..(131): n is a, c, g, or t
tctagaggatccctaagcggatgagggggcgttgaagttattaacactttgatatctgctccggggacagacgaggtgagcctggatgccattgggtgtagtacgtggttctctgaagagcaggacctgtnatgcctgtacaagtgaga

SEQ ID NO: 636178 - DNA, 117 bp, Homo sapiens
atcccagagtgatgttctctcttcctcttgtgctcttgctggtgtggtggtccatggtgtcttactccttggaggccatgtgggccatgaggtccacgaccacgacgaattcctggt

SEQ ID NO: 636179 - DNA, 451 bp, Homo sapiens
  misc_feature (406)..(406): n is a, c, g, or t
tttcattcgatcgttctttcttctttcgatctttctctctctttccttccttccttctctctttctctttctctctctctctttcttttcttttctttctttttttgtcttttttctgatggagtctcgctctgtttgttgcccaggctggagtgcagtggtgcgatctcggctcactgcagcctctacccccgggcccaggtgattctcctctctcagcctctggagtagctgggactacaggcatgcaccaccatgcccggccgatttttgcatttttagtagagacagagtttcaccacgccggccaggctggtctcgaactcccgacctcaggtgatccgcccacctcggcctcccagagtgctgggattacagacatgagccattgcacctggcctatagnttgttttcttttttttttagacagagtctcgctctgtctcccagg

SEQ ID NO: 636180 - DNA, 717 bp, Homo sapiens
gactgcaggtgctatcagtgaggacaggctggatgaccaagcttcctgccatggccctaagcctggagctcccttccctaatggacacgtgggtgctggaggcagtggcctgctcccacctccacccgcgctctgcggggcctctgcctgttgatgtctccgtacgtgtggtggtgggtgagcccaccgaggtccaggtggttccgggccggggcatctgctctggatcctcgccatcctgtgatagtgccttcctgctgtccccaggtggccccgatccctgtttatgggctccaatgtaccagctcagccagtactgtcactgcctatatggtgtctgccgcgatgcctgggtctggtcggcaatattaactttgctacacaggtagtatttcgacaatgagcgacttggccaaataactcagcgtagaaaaacttccagctacattgggcgtgcggtagggcctgtctctcacttggaggttcccagctccgccgtcgtccctgttagcccacactggggtctgaccgtgtgctggtcgcgcagatttctagttgctgccaaagtaattgtggctctcttgctgagcaccctttggtgcttgcttgcagtgtgtcgtagctcgacacatgcttggggggctggaggaggcgtccctactccttcttctcccccaagtgtcataggggctggcctgacttggaagtgccttccaa

SEQ ID NO: 636181 - DNA, 204 bp, Homo sapiens
acgtaagaggatccgacagcatcctaaccaggagtctctccagaatgccctgtcattcccatcatgttctaattgagtctttgtctgattatgtcatttacttttttatgtaggtcgagatggggggatggatctccctatttggttcatgtgggtctcaaattccggggcccacgcaatcttcccacttcagcctccaaaagc

SEQ ID NO: 636182 - DNA, 1068 bp, Homo sapiens
cagtaagtgagggtggagcccagtgagactgtgggtgtgtgcaggccggggagtattaaaggtggtgatttttcaaaaaaaaaaaaaaaaaaaaaaaaaaaaatttttgggccgccttgggcccccctcaaaaaaggcctttctcataaaccattctcgttgtgggccccgccggccccgagttaggttaagttgaaacgggtgtctcattagcctgtgtttcccttaggaagaattcctgggtctcaggacactatagtggccttgggatttccctcaccatataaaaaagccccgggggggaaaccgaaggcgtttcgtgaaaaaatctccagaagtggagtttctgagaggctcattaccgctggacttcttatctcaccagggaagtctccaggcgagaagcctcggattttcaatatttcagcccccgcgccgggaggatcagcttcgaggtacggtgtggtgtcatagtcaattaaaagaacattgatggacgagcactgtggaaagcccatcaagaaaggggatgtaggagtgaacacatgaaaattccgcgagggggaaattacaaaccacgttggatcaccattaggaattataaacaattgggccccaggtggttaaaccagggggggtcgaaaacaaagtgggccacaatcattggaccagcggattacacattcaaaccaggtgggcgtgaaacccctcaccagagggaaattggtgctcgagaagaaaaacagacattttccgctaaatgaaccccccttttaagggtacaatgagccacggggtttccacccggaaaacccacccaactcttgggcgaactatttgatgtgacacacgggacggaaataggggagggtaattcaaatccaaaacggagagcagaagtttatgtattggcccatgagaaagcgggttaacacagggggtgaacatatcaccatatacagaggtcaccgctatcatgtcacgtgacgaaacctgagtgcaactcataggcggagaaatgtaacaggcgcgtaccaatgacgtattgttaggctacaaagcagacaa

SEQ ID NO: 636183 - DNA, 334 bp, Homo sapiens
  misc_feature (80)..(80): n is a, c, g, or t
  misc_feature (95)..(95): n is a, c, g, or t
  misc_feature (259)..(259): n is a, c, g, or t
tagacgggtccctcctagccagggaggggaagaatagtatgagatgaggtgggcgatgaataggagccatgtgatgcagngggtttttaacaggngaggcacataggctcatttttaaaaagatgattttgacttttgaatgaatggattttaggaggccaaaaaatgaaaacaatgtgccacttggaggctatggtagtcccagtgagagatgatggtggcctagactagactgatagcagtaaagacggagataaanggatggattaatgagatgtttagtaatagaacttggagatggaacttggaaatatggttgcgtggggtaggaggt

SEQ ID NO: 636184 - DNA, 521 bp, Homo sapiens
agcggaagaaaaactatcaaggacacatctaaatacatgttagaatgagccaatatgggacaacttcccattatcaactattaagacaaaggttctagacatggcttaaaagtattagctttatctgatgctctgacagtgcagagtgatattggacccaaatgtaggatctagaggatgacagcttgaatgttagtatcttggctgaatcaggctcagggtggagagagtgatgttagaaccaggactcttgcagagagccaggaactaggtccaagcagccaattcatgaaactaaagaaactagaaagattctgtccccatggaggcaaagtgtcaaggaaacttgccttcaggatgggaaaatagaaagttgtcttaaagcaatttagcaacccatgtttgccctacatgtggatgtagaatcaaatttacacttccttcatggggcagaaattttaagccaagaaactagcataagaaaactggtctggaactgatgaaacatctatggaactgat

SEQ ID NO: 636185 - DNA, 161 bp, Homo sapiens
gatgtaagtacctatgtattgtatggtcaccagattaaaaagtatatttatgtggattgccgccatctggggggaaaggcgaggtcctttattaagtattcactgtttaatattactcatttgataatatcctgtcctttggttttaattatagcccgttt

SEQ ID NO: 636186 - DNA, 315 bp, Homo sapiens
ccgcaaaaaatataaagggaagttaaactcatagcattagcatacaacttcctcttagattatacgtgccacattctttacatgcttttgaatccattcgtatccatacaattaatatttaggtaagcatctcattatgtagacaagccctagttttagcacgcatggagatacacttggtgtacaaacaagcacaccagagcattctgcgcttcatcagcactttccatgcaagccaggaaagcagagagatgatagacaataagcataatgcattagatcactataccagaagatgaaatggctgtcggaatc

SEQ ID NO: 636187 - DNA, 206 bp, Homo sapiens
  misc_feature (77)..(77): n is a, c, g, or t
  misc_feature (81)..(81): n is a, c, g, or t
agggttttgtttttttttttccttttgggggggggaaacaaaggttcccccccggcccccccagtgggggggggggnggtntttttttaaaacccccccccttccccccggggggcccccccttcccctgggggcccttttttccccccaagggggcctggggggggtttttttttttttggggtttattgggtgttgggggggga

SEQ ID NO: 636188 - DNA, 247 bp, Homo sapiens
  misc_feature (16)..(16): n is a, c, g, or t
  misc_feature (29)..(29): n is a, c, g, or t
  misc_feature (41)..(41): n is a, c, g, or t
tctgccccttttgtcnggggcaaaagganccaaggaggaanttccagccgcaccacatttgcaaacgacacactgtcgggctttttttgcaataactgcatttcctaaataattcagtctttggattgagaacgtgtctgtcactttcctttatagaaataaccttttgtaaattaatgtactgttactttataaagccagacaactgtctctagatagacagcaataaaagctaccaactgtgaaa

SEQ ID NO: 636189 - DNA, 365 bp, Homo sapiens
caccttccacaggtgaatgggaccgattcgaagtgagcaaagggattcacaaattatgtatttatttgttttcatagttaagtagctgaagctcagagtctgtcaggagcgtacaggaaagtgtgtcgggttgaggtgggtgaatgtaggatcagaggggtgggtcgtggtggagaagggttgcaaagctgtgaagcgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggattaacaccaaataaaaattgt

SEQ ID NO: 636190 - DNA, 218 bp, Homo sapiens
tccgatacctaattacggtgtggaaaacgcatgagatatatcgttctcttgagccaataatacccctaacgtgaacccacccccaacaaatttctatgtggcttcaatagctgttcaatatcaaaccaaaatgtgtagtgcttacaacagatgctaaagctccctcagcagagtaaccagaaggcttgccctggtgttctcctaccttttatgacttg

SEQ ID NO: 636191 - DNA, 477 bp, Homo sapiens
agcggagtggaaggagcgcggtggcgcgggagcggcccggggaccccgcgctgctgaccggcggcgaccgcggccggaggcgggcgcgggtctcggaggcggtcgcctcagcagcgcccccacgggcgggccccaggccgcgagaggcagcatgtggctgatcgccaggcagtatgcctcgaggccatggacgttcggagctgagcaatcgtacgagaggcacggtcattgatcggcatggatcagggaccttgcgaagcacaggacccggcgcgctcgttgaccagggtcgactagcagcacaggggaagaacgccaagagaagtcgataaccaacgatagcacatagactctgggacaatatcacggcgtgtgacaacctagagtactttgtaatcaagaacgtgcactggactcagcaacagaagagcaggaaatcgccagcggccgatgactggcgcagtacctaggaacccc

SEQ ID NO: 636192 - DNA, 183 bp, Homo sapiens
tgtagagacaggagtctcactatgttgcccaggctggacttgaactcctgggctcaagcgatcctcccgcctcggcctcccaaagtgttcagattacaggtgtgagccatggcacctggcctcaggtttctgtgaaaatctttggggtatgagcctctggtggctcataaatgagctttggga

SEQ ID NO: 636193 - DNA, 924 bp, Homo sapiens
cataagtgttcaacttcattccaggagtgcatatacgactcgaagttgtgaccacctccattgggagtggcaggactctagattgtgtattggataatggacttatcggcacaggtggctgtatagtcagtcatcaacgatgtcttgccctcttccccacaagcaacatataaggtcattcctgtccttcaagttcgtggcccaatgtaagatatcagaatctagagcgcgtgaatgttctattacccaggaatgatagactacgttaggtgctgggggttttgtggggagcgggggggatacctcgttaagctttcgtaggatgatagtgtgtgtgaggagggaggatggtgattcgaatcggcttcttgacctttgtagagtcgtgatgggatagagagtgtaacatgacatcttccagggtgaagagagggatttgtcatggtctaccttctcgtgtgtgatgtgcatgaactatgaatgcatgaaacccttgcagtgtgtgtttctatgatgtacctataattgcagtcatgacatcatgggtattgaagaaaggctaaagctcggtgaatgcattacgtatgtcctgaggaataatattctgagagggaccagacagttggttgaaacattgatacttacaaatgcttgacaccagtttaaatcagaaacaatcgtaccaggggggtactggaccttagactgtctcgcgtacaagcgaccaccactgcctttgttgttcatagaggtactgcaaataggcgtacctctctattgctttgtcggggaagcccctccatttctatataaacattgatggccccgcgccgataagctggattttgacttgttgttacacgctggtgaaccaccccacgggtcccactctatggctaacaacacctgtttacggttggaaac

SEQ ID NO: 636194 - DNA, 531 bp, Homo sapiens
caggagcagctggacaaccaattggatgcatatatgtcgaaaacaaaaaacacatcaaaggacaaaagggttcatacaagcacagtatcaaaaagtaaaggaacacactaaatgcacaagctggtggcagtaatgtccagcaacctacttgtcgataggtccatccatgcatcaactcgaaactatctttcgtcatctgttatctcaaggtctattaacatgatgtcgtctgactaagcaagatgtctcatcatggcggaggatggagcaaggcttcaatcacatggtttcgcggatctagtctgcgccatgataggcactccgaactcagaaatacaggtgatccaattttgattcctcgaacttatatatggcaatctcaacttgcaatgctacaagccgtgccataccttgggataaactacgaggtgcgatgcaagggtcaacatcatagatcagtccaagttgccaacgacacgcaaaagatgggaaaacggccgccatcaatacccagaatgtagaatacaggca

SEQ ID NO: 636195 - DNA, 174 bp, Homo sapiens
atcaactaaaacagctggcagtctctcttttgtctccttccacactctctaacgttatctttattactctagtggttactagctagagaaggtagccaatacacatacttgtgctaaacaagataaagtttcaaggtcatgcacaaacagcagcaacagagggcattatcattt

SEQ ID NO: 636196 - DNA, 119 bp, Homo sapiens
ccgcatatgttcgtcggcgaagcgcccggccgcgacgaggacctcgaggggcggccgttcgtcggcggctccggcaagctgctcgacctgatgatgggagcgatcgggctcgaccgccg

SEQ ID NO: 636197 - DNA, 386 bp, Homo sapiens
gtggttcccgggtataattgctgctcccctccccccacttccagggccccagtggttgtgtagagagtctggaggtgacctgcagacgggcagatgctggagagaagccaaaggcctttattcactgggtgtcacagcctttgatgtgtgaggttcgcctctatgagcgactattccagcacaagaaccctgaagatcctactgaggtgcctggtggatttttaagtgacctgaacctgcttgtctttaaccgaactgtcacactgaaggaagacccaggaaaggtgtgagctggaagcactgaacctacctcatcctcctggagggtgtggcttgccttgcctccccaaattccatgtcaataaagagcagtttaattctcgtag

SEQ ID NO: 636198 - DNA, 392 bp, Homo sapiens
  misc_feature (135)..(135): n is a, c, g, or t
  misc_feature (306)..(306): n is a, c, g, or t
  misc_feature (308)..(308): n is a, c, g, or t
  misc_feature (310)..(310): n is a, c, g, or t
  misc_feature (317)..(317): n is a, c, g, or t
ttgctggctccctgctcacttatcctaaaacagtcctgtcagtgaacctctccccctcaactacatggggtttccagtcagacttcccactaaaggaatgagaaagtatatcaggaaatagacctactaatatanaagtaaacccatcccaactactcagtcatttgttgtaaatgcaaagagaaaacctaggatcactaagcagaatttaccagcatgtgtaagaaaatattcaagacaagtaaatagcaaaaactgatcccagaggtaatggagataattcagggagaagaagagaagctaaanancnacatcangaattttaaaaatccacttagaattttcagagatatcaaccgatattgcatccaccacaaactatacctatatac

SEQ ID NO: 636199 - DNA, 885 bp, Homo sapiens
tgtgggttggagcacagggtacttaatggatgggtacatgacaagggggggcttccctaggcccctcccctcttcaaggggtctactgggcaacggtgaggaggggaaattcaggggggggggggactgattgtggcagggactccccagagtgagggtctctctcttcctctggtgctctggcgggggcggggggtccaggggtctaactcctgggaggccaggtgggccaggaggtccaccacccggtggctgtagccaaattcgtggtcataccaggaaatgagcttgacaaaggggtcgttgagggcaatgccagccccagcgtcaaaggtggaggagtgggtgtcgctgtgaagtcagaggagaccacctgggtgctcagtgtagcccaggatgccctgggagggggccctccgacgccggtcttcaccaccttctggatgtcatcactaattgggacaggttttctctaaagggcgggtcaggtccaccatggacacgtgggcacggggggacccggaaggccatgccagtgagcttccgtaagctcaaggatgacctggccaaagcttggagcgcagaagaaggcagggatgatagtctggaaagccccggggccatcacgccaacgagtttccgggaggggccacccaaagtctttgggtggacgtgacggcatggactggggcaagagtcttccagaaacccaagctgtcttggcagccttggcggggtggtcaccttggtgtgcaggaaggctggcacaaaccgagaggggggaaaatcagggtacccatgacaatcgcgccgacagggaaagactctggccccaagacaccccagtggaacaggcacaaaatgatatgttaccacagaaatgat

SEQ ID NO: 636200 - DNA, 453 bp, Homo sapiens
aagggaaaaaaaaaaaaaagagacaaaaagaaaaaaaagagagagagaaaaaaaagtcaagaagaaaagagaaaaaaaaaaaaaaggaagaacgagaaggaaaaagagaagaaaaaaagaaaaaaaaaaaaaaaagaaaaaaaaaagaaaggatgaaagaagaaaaagaaaaaaaaaaaaaacaaaaggagaagaaaagagaagaaaatgaaaaaaaaaaaaggaaaaaaaaaaaacaagaataggaaaagaaaagaattatttaaattgaaaaatattgaaaagatgggtaagagaatataaaatgaaatggaagtgaaagatataaactaagaaaactaaaatactaactcacaatagcggtgtggctctctctatctctctactctatctctctctctctctctctctctctctctctcactctctaataatctcgcgtgcaaaattcct

SEQ ID NO: 636201 - DNA, 216 bp, Homo sapiens
tttttatcccctttccccccccgttttaaaaaagggtttagtatagtgttttagtccccccctttgcccataaccattcagcaaatgctgtgaaatttaattgacccctttcccttttaaaaaaaaaaatttttatgaacgggggcccccccttttttccctcctttgccccttcaaaaatagtttttttaataataaacctggtttggtttggga

SEQ ID NO: 636202 - DNA, 300 bp, Homo sapiens
cggcacgaggcaagaccgggtatgttgactcacacccgtaatcccaacacttagggaggttgaagcctgttctcaagaccagtctgggcagcatggcgagactctgtctctacaaaaaataaattagccaggcgtggtgtcgtgtgcctgtagtcctagttactaaggagcctaaggcagcaagattgcctgacccaggagtttgaggttattgtgagccatgatcaatgccactgcactccaccctgggtggagtgagaccctgtctcaaaaaagagacagaatcagaccctgtctcta

SEQ ID NO: 636203 - DNA, 736 bp, Homo sapiens
ggttctgtctctctggagaaccttgactaaaatagatttgatattaaggaagccaaatgtcattcctccttactttattacttgcagcataatgggagagatctgtgaaactgttccctcacaaaaggctatgatggtctaagcatatgaggcctcttaacagtgaaagataaaactttaaaagctaattactattggcattttgaaagcagaaaatcacttaattgcaatggttgagcaataaccagtctttcgaatggactgcacatacttacaaaattgtagaccacagtcactcttcaagtacaaattcagtgagtgtttcaaaaatcatagaagtgaaaatgcaaacgaaaaatacagaaatctcccctgccaaattattcaatcatataagacttctgccctttcacatatagtgccaatttcctatgctacatatctcatctttgcttcatttccaatactggaggtataaagttgtgtaaagacttctgtagagttctaagtgttttatgcattttttgcaaatttgactctatgaaagtgtgtcatcggaacgttgacttgtgtgtagcactgtgtgtgtgtctgcaactatcaaacttccttataaagatgtcctttctgtcatctgacattgtgacagattcattctcaagaggtccgtactgggcaccggctatgttggggggacccccgggggttgagggccccttggacctgcgggtggcca

SEQ ID NO: 636204 - DNA, 420 bp, Homo sapiens
gaagataagaggcaaggcttgctctgatctttcccagttctcagagtccagcaggccgctgtgctggacacatacatggatccaccaacatacatcagtccttctgtgttctctcctgcatggaaaatgctcagaagatgctacaaaacctcatgcctactgtctgccactgctggagaaggaatcatggttttgtagcatcttctgagcattttccagtacatcatctgcttttgtgctgctggaagtgaggaccatcagcaggagttttctgtgcctcctgcaagttgctgatttctcacagttgctactggctttctccaatgttcacttctctatccctttcagtggtttataaatacttcattcctatagtagatccttcctgcttatattaataatacctggagggacatggtt

SEQ ID NO: 636205 - DNA, 461 bp, Homo sapiens
  misc_feature (360)..(360): n is a, c, g, or t
  misc_feature (417)..(417): n is a, c, g, or t
  misc_feature (444)..(444): n is a, c, g, or t
attcggcacaggaaagatgctgccagtctctttgctaaaacacagcaagagtcacctttactccagttcccaaaaagtttttcatctccatctgagaccacctcagcctgaattttattgtcaatattgctatcagcattttgggcaaagcatttcagcaagtatctaggaagttccaaactttcccacattttcctgtcttcttctgagcccttcaaactgttccaacctctgcctgttacccagttccaaacttgctttcatatttttggctatcttttcagcaatgccccactctactgttaggcagtttactgtattagtctgttttcacactgctgataaagacattcctcaagnattgtgaagaaaaagaggtttaattgggacttacagttccacatgggccgggggagnttccaggaattcatgggcgggagggtngaaaaggcactttcgta

SEQ ID NO: 636206 - DNA, 400 bp, Homo sapiens
  misc_feature (356)..(356): n is a, c, g, or t
  misc_feature (358)..(358): n is a, c, g, or t
aacctgattaattatattttaaaaatagcacattcaacactgttttacttgaatacagctaaatgtgtgtatatatggacccacatatacaaatatggtcccttaagattataatggggcccaggcgcagtggctcaggcctgtaatccccagccctttgggagaccaaggtgggcagatcatgaggtcaagtaatcaagaccatcctggccagcatggtgaaatcccgtctctactaaaaatacaaaaattagctgggcgttgtggcacgtgcctgtagtcccagctacttgggaggcaggagaatcgcttgaacccaagaggtggaggttgcagtaggctgagatcgcaccacntntttccagcctggcgacagagtgagacaccgtcccctagttcg

SEQ ID NO: 636207 - DNA, 130 bp, Homo sapiens
ggtggagtggatggacttatgacagatagagagatgggcagatggatggacaaatggatggacagatatggatcgttggatggatggttaaatagatggtgggtggatgatggagggatggatggatagg

SEQ ID NO: 636208 - DNA, 169 bp, Homo sapiens
gggccgggtcgttaatcgatttaagccttgatatgggtacagcagatgttacatgagagcatggggttgggggtacggtcatagatcaagaggatcccaaggtcagaagaatggtgcttagttacagaacaaaaggaaaagtctcccatggtctactgtctttcgtaca

SEQ ID NO: 636209 - DNA, 217 bp, Homo sapiens
aagcggccgccctatttttagttaataatttcaaaggagagaaacattctgatataatacagataaaaataatagctaggctagggcgcggtggctacatgccgtagcgatacccaggcactttagggaagccgaggtaggacagtatacacgaggtacaggagtatcgaagaccatacctaggccagacacggtagaaagcccgcgtataccacta

SEQ ID NO: 636210 - DNA, 339 bp, Homo sapiens
  misc_feature (23)..(23): n is a, c, g, or t
  misc_feature (36)..(36): n is a, c, g, or t
  misc_feature (52)..(52): n is a, c, g, or t
  misc_feature (185)..(185): n is a, c, g, or t
agcccaggatgcccccggaaaanagctccctggtcnggaatcataccttccngcaaccttctaaacttccacttcttatatggcccctgggggagagtgtaggctcagtgttcatgcccggattctttggctcagattggttgtctggtgccatctgtgttccttcctgcctgtatgtttgtcantccctccctccctccctcccttcttcttctcttcttttttctttctttctttccatttcttttctttctttctttctttctttctttctttctttctttctttctttctttctttccttccttccttccttcctttccttccttccctccctcc

SEQ ID NO: 636211 - DNA, 395 bp, Homo sapiens
tcgaaaaggcgatactagcgtaaatcataaaatgggtatgttactacccacattattctataaatggacaccgatgggtaactgaagcaataggtcatgctgtaccaacttcagaggctgctagtggcgggggtctagttctgcatctgctcaaagaaacttgtaggtatggattatccgtagccgttctgctgcatcttggacaggtggcgctcctctggggtgacagcggcgtcaacctccaacacaccatgatgaatggctgtgtactgtttcttcttcagcatcaccaaggtgatgacgatcactgtcgctatgacaacaccgaccagcatgagtccaatgattgcaacctttgaatgaacccaaatcttctgcacagaacaccaattttt

SEQ ID NO: 636212 - DNA, 134 bp, Homo sapiens
ggtgctgtgaggaccacatacactgctgtcccgcggggtttacgtgtgacacgcagaagggtacctgttgaaccaggggccccacccaggtgcccttggatgggggaaggccccagcttaaccttagcctgcca

SEQ ID NO: 636213 - DNA, 343 bp, Homo sapiens
agcctgagctgtgtctctgcctcactcgtgactatagctttttcacggtggaacatgtcctaggggtgcagagacatgcttgttaccaccgctctgacaatgggcagggaaatttcggtgctcgaggactgtgcccaggagcagatgcggctctgagcccaagcgcgcctgcttgagacaccgggtccagcaacaggtcaagagcaagcaccttttgcaggagaatgaagtccaggtgcttgatacaggagatgccaatactgccattgatcttggacagcgcgaggcagcttgccaattgctcacagagtttcaatgagaggtgtgctcagtggattttacg

SEQ ID NO: 636214 - DNA, 313 bp, Homo sapiens
cgtccgagttctctctgtgggggtagacagatactagcttgctgaatataacttgtaaagggtggggcttgtgagtctcagccatgttgagtgataccgtgctgcccgagagttctgtgctgtagatcctggtctcttggactgttttccccataatttcccatccctacctttcctaccctgcaagattgtgttggatataacttgctcactaaggcttcaaaaagcgggtcattttcccccctggtttataaattgggctcttattccaggggcccccctcttttcccctaggtgccacaagagagagcgt

SEQ ID NO: 636215 - DNA, 352 bp, Homo sapiens
aaacaggaaagcgcctgatgaaacactgaagaaagccttacaggtcacttgaggaggttgttttagctctgataaaacttcagggcaattttggttgctgattgaacttcgtgctgccatgaagggccttggaacttgatgaagatactctaaattgagatttttggcatcaaagaactaagcaaagaaatcagagacataaacagggtctacagagaggaactgaagagagatctgggccaagacataaacctcagaccacatctggagattttcggaacgctttgctttctcttgctaagggtgaccgatctgaggactttggtgtgaatgaagacttggaatagctgtg

SEQ ID NO: 636216 - DNA, 825 bp, Homo sapiens
ggagctccaccgcggtgccggcggaaatgggaacaataataaccggaataacgaccatcgtggtggcaacaacaataaccatcgtaatggcaatagcaatggtcgccggaacaataataatcataatagcaacaataataatcatagtactaacaacaatcggcggtcatcaactgatcgtcggcgttaatttttaagtaaggggatgtgcggcaatggccaaacaacacggtaagcacccagataccgccctcgctcaaaatcggaaagcacgccatgactacgctgttgaggaaacctatgaagctggcattgcgctgacggggacggaaatcaaatccgtttcgcgatcggcgggtcaactttaaaggatggtttcgtttcaagtttcgcaacggttgaagcctggatgcaaaacgttcacattagtcccgtttaaagagggtaaaccgttataacgttgacccgttgcggtcccggaaacttttgttgcacaagaaagaaatcagtaagctaggtgcagcaacgatgactaagggtgtgacgattattccacttaagatgtatctcaagcatggatttgcgaaagtcttaattggagtcgctcacgggaaacgggaatacgacaaacggcaagatatcaagaaacgcgaacaacagcgtcaaatcgaccgggttatgaaacattactaggcatcgattacgttagcgttgcatcgctgcaccatacaacgagtatggcagcgtcataaaaaggtcttccaagaattaattcgattcttggaagaccttttttagtatgtgttgttggtggttctgtgccgt

SEQ ID NO: 636217 - DNA, 836 bp, Homo sapiens
gctcaagcaagaatcacctcagagtggcggcggagtgatcgtcaataacaccgatagcatcctaatgtcctatgatcacgtgtgatactcactattcaatgatccatgaacgaacgtgccacgaagaccttctaaagggaccaatataatgggcactgtctaccttaccccttaccgggtcatctttcttgtccaagggcaacgtgattgccatgcagtccttccatcgattgccattttatctcattggaaaggactgtgagatcaacgcaagccctgtattttggttgctacaactactatctaatgcgtgccaacagtgaaggcggaagcagcggaggtgtgctgagtgataggctctgcttcctaccccgttgactttcacgagtaggtcggcgccattgagttccggagcagcgcgtctgctccaggtggcctctcctgcctccagaggtgaagttccccgaatggtggtagcgctattgtgggtactcttacatgcccagcggaggcctatgtcttatcccccgtccagtcgccaactggaatgtgcccctgccctccgtggtagccctatccatcgatcccactggatactctcccagggcagcacagcagtatatgagcagggattgttaagggatagtctgacagcttccaatcagcaaacttaggcttaggaaccccctgaaaccctccggattagtgccctattgttgctcgcaatgtctggcaacctgctggaaggcagtgcaacatgcgtcggtgcctgtatgcccagtcccgtcaggaggctaatgcgaaacagcgcgcagctccgatgtcctgcacaatag

SEQ ID NO: 636218 - DNA, 1776 bp, Homo sapiens
tatccatgcacctatcagaaaagagagatgctgaataggaacagtctattaggatgtgctactacgcactgcgtgcattttgagacggtgggctgtagaatctacattgatcgcaatgctgtttaccagttatcaatcataatgttaagcctaatgtgaatgacctgaacttattataaatcataggattcacaagggaccacggtcggtgctactagttatcaccacgagtcgataaattccgctcatagggtcaggagatctccgatcgttgtctcgattcgtcttcatctggcgatctagcttgccagtacaaatcactttaggcaaacatctatgagtatcgttggcgcaattatcattgttatagaaagcccacgtagtaacaggatttggtacggtagtcatagtattgatttcccctcagattaaacgtttgacaatgcttctcttcaagttcgtttagtgcccttttcactcttatcatgttatagccagcgtacgattggtttcaattgctcctaggatagatcacttaacagagcattatattttaccttgggctagctagtagctcagttataatcccattgggaacctctatcacttggaaaagcatattcgtatcacaaaattaggaagttgaaagtcacctataacatcgttttgattcatcaacagcccaccattgcgaaattcagtgaagttttctaggccccaactatgcgcaattccgccgcgaatttgtgtttgtgatttgcacccacggccagacgaatttaaggccctttttttattattacacgcgattgaaaatagttatcagcaaattgccgcacggacttaaacagacgggtcactccggaaattgggagatcctaaaccataatatttttccaggaaaaagctagttggaccttagtcaagaatatttaaagagacggatcttcagagaacgcaggacatggcgacacaccgcgccactgattatacaacggcattccacttacgcatcgttcctggggcacctgctgcaacaggctcaaggaactgtcaatggggtcgcctttatgggtccggttccgcagagacaccaacccattttgggtgcaatatcggcgaactaccaaaaacaagggctaccccaagttttcccaaaaaaattttccccacaaatttttaacacagagcgacagtaccagagatacattcccaatggggactatcccatgttggggcacgacctgtaaggccctttgcgtaggtccacaatgtggcggtgcatacgaacgcgcacacagcctcgcggtttaaacaggcgcgctaaagacaaccgagcattacgcgtatagagttaacctgtggggcgacacacctgggtgggagcaacacgctcactactggccgacaacatgataaccttatatgaaaaatcaccgtccgcttttggaaagacacactatgcggtcttcacctcttatcaccaagagacctgttcagtcatggctttatatggcgcccacgtgataattaacacaagggggacaacaacaccctttagcataagaagccgaccaatttggtgccacacaactatacatgtggctgcactcaaaactagaccacgcatagcaagacgaaataagaggatggcagacctaactacatcctcataaacgccaaacataatcatacaatcaagcatacatgaatagcgtcgacggcagccgcgccaaccacatcaagaggatgacaactaccaccacagggcgcgca

SEQ ID NO: 636219 - DNA, 176 bp, Homo sapiens
ttaattgatccttgatgtgatgttcttctgcatagttcgttcattctagagatgttcccgggccgggaccgttggctttctcctgtaatccctactctttgggaggccagcacagatcgctttaggtcaggagttcgggtccagcccagccatcatggtgttaccatgtctaaact

SEQ ID NO: 636220 - DNA, 315 bp, Homo sapiens
gttcatactcggaacaactattgttctgaaataacttaaaatcagctatatactgcttgatgcgaaatctctgtctatctgcattcaactgatcacagtctctattacacaaagatatacctcctgaactcactgctctttattagagctttctagtcaagcatactacaaagctgtaaatatactcactcttacaaaaaattctaataaaaaaccacaagtaaatagcctgggctcaagtgatcctcctgcctcaacctcccaggtagctggaactataggcctgcacctccttactgctaaccggaggatcct

SEQ ID NO: 636221 - DNA, 353 bp, Homo sapiens
  misc_feature (130)..(130): n is a, c, g, or t
cacgagggcaatctcagctcactgaaacctccgcctcccaggttcaagcaattctcctgcctcagcctcccaagtagctgggattacaggcatgtgccaccacgcctggccaagtttgtattttcagtanaaatggggtttctccatgttgatcaggctggtcttgaactcccaacctcaggtgaaccgcccgccttggcctcccaaagtgctgagattacaggcatgtgccaccgtgcctggcctccctgatctcatttttatccttcctaccttggaccattttaccgagccatgtttccagcaaccaaccaaattgtccttaaaatctctgatcctccaatgctggggga

SEQ ID NO: 636222 - DNA, 1011 bp, Homo sapiens
  misc_feature (16)..(16): n is a, c, g, or t
  misc_feature (349)..(349): n is a, c, g, or t
  misc_feature (662)..(662): n is a, c, g, or t
tgtctgtccggtgttnacccagacacaagagcggacacagcgcacagaacagttaccatgtgttcgtcgacttgtgtgtgtgttggaccacatctgcgttcttactaagtgtcccgtagctggccggcgaaggagattgctgtcccccggttctcatcacggcacagaggttccacatgtcgggggatcccgccgccattctgggggaccgcgtgatgtgctgacgcactaccttgtgcagaacagtagggttgcgtcgtgtcagcgcagcccctctcatgcgtggcctgtgtggtacacactctctcgcgctggttttttcagggcacccgcccaagggtgggtcttnccagcatcagcggtcacgcacctcctttgggcgggtatctcagatagcccgcgccccgcgtggttctcaacccttaatcccggggataccgtgggtcggccccccctgtttcctcgggggcatttcccgggccccccccctgtttgttggtcacccgcttgtgggaccacacatcttttgccgaggacatgcgctttgctggaacagggtccctcctgtcctgtcacccgcggggccggtcggcgaccgtgatcttggccacctcccgcccatgctcgcttgtggggaacacaagcgtattctctgtcaacancccgtggggaagactgcccgatgttgcctcttttcagcgggcaaatgctgtcttgtgtgccctatcctcgatggtagggctcccgcccccccacacagggggcagattctttcatggagcaccctgtatattggcccccttgagtgcgcgggcgacgacggcttcgcctctcactatctgcgaggcacctccttgttctggcgccaacgccgctcgcagaatgccgtctgagatcagcactggcctgggcggtccgatcgacggtgtgcgactgctctccgagccgcgccccccaccatttggcgtggctttcgcggggccccccaaaaccccccctgcttcaacaaac

SEQ ID NO: 636223 - DNA, 1365 bp, Homo sapiens
  misc_feature (316)..(316): n is a, c, g, or t
  misc_feature (1001)..(1001): n is a, c, g, or t
tcatcgagctgcggcaggtctgcgtggcgcagtcgcggcttgactaggttgttcttcttctgccgtgggtgtttctatttgactgtactactgtgtttctggtgttttttcttccactgctggctttgttggtcggtctcctcttctgtttctcctccttgtgttcgtccaccagcccctgtgttttggtctgcacacccgcgtccctaggcggggtctccccatcgcgctcgtcgtcatctacttaggactcccttttttgttcccccagacaccacccccggtggttgtttcgcacgactaatgattgtgtctnacctcagtcaaccctccccctctggcggtaccccggtgtacacttgtgccccaatggcgttttctcgtcgccttatttttcccctcggtttttaatttcccccccacccccgcgggtcgccacttctcttcttctacccgggttacccccgcctttctaatcgcggccccttccattgccccagctttgagggaagaccccccggtcctgggatggtcaatgaagcccggctgtccttcccagcgcccaggaacgttgattgggtgtcccacacgggctcggaggttctcctccctgccccaacccactgggtaacatctgcccatcgctcaacaatcatccacgggaagaaggtgggaccccccccccacaggtcccccccagagcttgcacagaaggatcccgggaaccgtgaaagttggcgccaacgttcatccccttggggcccccgcccagcaatcccaggtggccccctgttcgaggaagtcttccccctacacgtgcccctctggccccacccgggtccaaccgggcctccatgatggcccaacaccaccacccagccatcttctcctctgcatcctttctgagaggacacccctttctcgcccacgtattgacccaagcctgcgcgtatacaccgggaggcccttctcctggacaccaagttctccgcccaaggagngaccaatgttccaaggacccacactttgaatgagaatggaacaccactccacgggagattgtgcacacacgctcacttcgaatgagtatcccatgcggccaccaccggccacgaataacacttctcctggggcaccccacggaagcacctgaagtcccccacggacacccgggagccctcatctgccttactggttggccccagccctgcctgactgaccacccccctcacgagcccacgatcacgggacctcacgcatctctttttcaataataacctggagctctctgttggcctgccaacaccatttacttttcctcttatgagactatttatctttaataaagccctggatataaatcca

SEQ ID NO: 636224 - DNA, 1518 bp, Homo sapiens
gtgcggtggtgggtgtcttgatttggttctcgcattatttgggtgccgtgttggttggtggctgggtggggtggcgtgtgtgtgttgtgtgtcggttgctgtgtcgggtggcattgctggtgggtggtgtgggtgggcgatggtgggtggtggtgttgttgttggcgggggggggagtggtgggcggcggtgtgtgttgtgtgtggtttgttgggttgcggctggtgttgcggtggtgggcggctgggtggggtgggtggctggggtgtgtgtgggttgggtttctgtgtggttctgtctttgggtgtgcgctcggacggggtcagcgggttgccctgtggagtggtgtggttgcgctgtgggtgggggtgctgggtttggtgcgtggttgctgtgtgtgtctgcaggttgggcggggtgggggtggtcggtgttggtgccgtggtttgttgtgttgtgtggttggggcggtggggtggtcatgtggggggtggtgctggtggcgctgtggttgttgttgtgcgcgttggtgggtgagggtggggggtgggcggcgccggtgtggtgtgggggggtgttgggtggtgtggtggtgggttgggggggtgtgtggtggcgtgggggcgtggtaggtggtgggccgcgtggtgctggtgttggtcctcgattgtgtggtgtgtgtggatggtgcggcgttggttgtcgcgtcgtgttgtgctgggtctcgtagtgttgtgtggtggctgttgtgtcgtggctctgtgtggtgcgcggagcgcctgctgggctctcgtttcgtcgtctcggctgtgtggcttgttgttgtattgcgtcagcttatcgtgttgcggtgcgggtgaggttcgtttcgcgtgtcgcgtggtggacttttgctctgcgcgcgggtattgttgtttgtggtggtgcggtggagtattgtggtggtgtgagagagtgggagtggtcgtgtgtgggggtggtgtgagggggttgacacgatgaggtggtaagggtaaagggggttgtgttgacgaagaggggtggagaaggttgcacggttgtatatatgtggtcttgttgtgtgggtggagagggcctggggtgtggagtgtgtgagtatgtggcgcagatgtgggtgggcgtcggtgttgtgctcttcgcgcgcgtatggtgtggtctcgcgggggtgtggttctaggagcgccgcttgttttgcgtcgggtcgcggtcgtctcctctctcgccctgagttctctccctcactcgggcggggacgtattgtctctgtgcgcgtggtcgggaatagtgggagaagggtgtgccagagggttctgacttgttttgtgtggccctgttgagggggtagggcgccggtctgttgcccggtcgccgcgtttgtggagggtgggccgccttccgcctcttgtgttgccgcgcggacgcgggagaatgaggggacggggagagaagaggtcccgcaaagagagagaaaaaaaaggagggcacatgcaaggaaga

SEQ ID NO: 636225 - DNA, 81 bp, Homo sapiens
agccccaaccagacctctctgtacttctgtgccagcagccctggccgtgggaggcccttatctggaaacaccatatatttt

SEQ ID NO: 636226 - DNA, 167 bp, Homo sapiens
tgcatactctggtcctggaggatcctctcaagtcgaccaggctccagcttaacgatattaggaggtcagcacggagctcacgatgtcgacggaacttgtccagggaggcatgcaccgacaatggtgaatacacatcgaacaggctccatgtttacgttctgtggaag

SEQ ID NO: 636227 - DNA, 1355 bp, Homo sapiens
  misc_feature (1148)..(1148): n is a, c, g, or t
  misc_feature (1164)..(1164): n is a, c, g, or t
ggcctgcgtcgccggtttaagcgcagtgcaggcctgtggcctgggggcggcggtagtgagcccagctgctgcgctccagcccccttttccctccatgtgtttctctcctgctccctgtgagtaacttgtgctcctgtggggctcctgctctgcctgccctgcactgcctgtcctgccacccatgtgacctgctgcctgacctggccatacctgacctgcataagcaaagcacacttaccagactgtgacccttcagctttgcggcaatgctcgtgagacctgcccttcttacccacaccttcctggcaccacacgcaccagctgtgacaaccgtctaccacgtttagaatgaaagcgggtgtgggacactcgacgtcgtgtgatagcaatttgtggatcattgacacggaacgtgcacgtggacttcgcagatcactgtgtgaattgcctatggcatctgacaactcctgtgaaaccccccacagagtcagatgccttgggttctcctagagcgaaaccttttttgatcatctgcgacccacacattagggccaaaagagtatcaaaaacatgttggaagttgcctcagaacacacaagacttatagaactagggagccaatcatacaacagatcgtcctttggaaaagcttcatatagataaggaccaacctttatcaagggagacgactatcccccattcccacagcatttcttaaaaagttaacagagcattggcataccgtagcgcatttttgcaattcctatccaaaggatatatcacaatacaagtatacagtaccccccccagaaagccgttggctccgccgtaaaccacgtttggacactcacacagtgcctttatgcaacaccgtttccaaggcgttggcagaaaccaagttaccgggacaactcccttcatgtggcagacagggaatcccttaggagcaccaagttgatctaatgacattgcaaacagcagaaccagttttctcgaaagcaattccttcccagctcaagcagaatttcacttcaaaaaccgctctataacacgtctttgtcgcacactcactcaacaccaacgcgtggggacgcacacacggcaacatttactttccacagtgcaaacaccccggttagtgtgatgcnaaaacgccacatttanctcgggcacataacccacacaagcgcctaatacgaccaacacaagtaggcatcacgttaggtagacaaaacgatgtgtcgcttattgagtgagaccaccacgatacctgtattagtcaaacgacactgggtatctgcacggtgggtcttaacccctaggaaccctatgtgaacgatctagaacttaccgcg

SEQ ID NO: 636228 - DNA, 1412 bp, Homo sapiens
agatgtgtgggaagggggggggggggggtggttgggaggtgggtgttggtggtgggtgggggtgtggtgggggtgatgagggggggaagggtgtgaatgggtgtatgtagttaagtgtgtgagaatagttagtgaaagagaatgtggaggtagatttgagtgtgttgttgtgtgttggaagtgttatgtgggtggggggggggtcggggatgtggagggtgcgtctgtttgtggtgttgttgttggcttgctgcgtgttatccctggtggtgggtgcgcgcgtgcccctctgggtgggttgtgcggcgcgtgccggggttagggttagttctcctgcggcgccgtgggcggcgtggtcccgtgctcgtgtggtgtgtggtgctggctatgtgcgttcggtgtgtgggtgggtgggagggggtggggttgtggttaagatgggtgggggcgggcggcgggggggggggtggggcggtggtgtgggggggtgttgggtgtgctttgctgtttgctggtggggggtctgttgtggttcgctgcagtggtggagttcgcttttgtggtgttgtgttcctgcggagagggggtgggtggggtgagggttgtggtagttgtaaatatatatgggtgtgagttgtggtggaggggcggctgtttgtgtttttatgttgtgggtgtatgtttgttttgtgtatttttgtgtgtgtagtggttgtttgtttgtgttgttttgttttttgtttttgttttgttttgtgttttgtttttgttttttgttttgttttgggtgtgtgtgggcaggccagggggggcagcgtctcaggccgtgcgagatattgtcaggagatcgagactgcccggcggaggttctggtggagcctgttgaacgggtccgcgggagaatatgcttccggcgtaggcgaattctgcgaatcatatcggtgtccacaaggagccaccgcgattctcattctcacagatgtgtagaacgtggccgagagtgtttaaaagggtcaccacggcacggtttaagtggccacgtttaaaaacttattgctaatttgcggggccacattcgtagggagatgggtgaggtcacagagtgagttccacttttccgaattggccaaggccgaatggcatcgtttcaaagaacttttgactggagagaatcacagatgtggaatatttgtcataaataaataatgaaaacctaaaaaaaaaaaaaaaaaaaaaaaaaaaaaaaaaaaaaaaaaaaaaaaaaaaaaaaaaaaaaaaaaaaaaaacctcaaggggggccccgttcccaaattcaccttatagggagtcaattaaaaattaactgcccgtcatttaaaaacttcataactggaaaaaccttgcctttaccaaattaaatcaccttgaaaaaa

SEQ ID NO: 636229 - DNA, 115 bp, Homo sapiens
ccagcgtaattttccaatccatcctgctccaacctcaaacaagccaccattctcctcacaactctcgtgacaaagccaaaggacaagaggtgccacatactctggcggggatcct

SEQ ID NO: 636230 - DNA, 502 bp, Homo sapiens
cagaggtccgctgaggcagtctgtccttgggactaacaaagtcatctgctgtttggggaaatctctggtgttgggaacaggcccccaaatctggccataaactggccccaaaactggccataaacaaaatctctgcagcactgtgacatgtttgtgatggccatgacccccaccctgaaggttgtgggtttactggaacgagggcgaggaacacctggcccacccagggcggaaaaccgcttaaaggggttcctgaaccacaaaccatagcataagtgatctgtgccttaacgacatgttcctgctgcagataactagccagacccatccctttatttcagcccatccctttatttcctgtaagaaatgtttttagttaatctataatctatagaaataatgcttatcactggcttgctgtcaataaatatgtgggtaaatctctgttcaaggctctcagctcccaaggccgtgagacccctgatttcccactacacaccct

SEQ ID NO: 636231 - DNA, 103 bp, Homo sapiens
gcggccgcctactactactactactgctcgaattcaagcttctaacgatgtacggggacatgttccaaacctcattgaataaaagcaatgaaaaccctaaaaa

SEQ ID NO: 636232 - DNA, 197 bp, Homo sapiens
ctcaacgctttatacttcttaaacagatcttctttaatttggaggtgagggactatagcgtttttgaaagcatttgtctttttttttttatgggcttcatcatattttaatgaaaagtctgatgctattgcctaaacaattattaatgcgtgtcaagttttctatctatacttggtttagaaaagtctccgaaacta

SEQ ID NO: 636233 - DNA, 230 bp, Homo sapiens
cagtccccttggggggggaaacggccccatttagctttaggtttgaaaggaaaacaaaatagggggaaaaaagggggtttccagttgcaaacatggactttttgggtcagctcttgatgaggaccaaaaatcagtaggttttttggggctgcagccaacaagttggcagttgaggaaaaagacctgctccctggccttggcactgcgggagatttttcagcttgatgaaa

SEQ ID NO: 636234 - DNA, 868 bp, Homo sapiens
caagcgtcggtgtgtcacatatggtcaggctggtttcgaactcctgactctggtgatctgccgcctcggctcccaaagtgctgggattacagacaggagccaccgctcatggcctgcgcctcccctttttctgtagaagacatcacgcatctaatagacctggtgaagccagttactcactatgaccctctctcacatatttgtttgttgatacaagggcctctctgtcgcccaggctgaagatgcacgtggctgctgatcatagctcactgcagactcggttcctatactcatgatcctccagcctcagcctcctatatagcaaggcactgcagggcgcacgacaccatgccatgcctcaaacattttctctgtagagatcgggagtcacactatgttgcccaacgtctggtcgcgacctcctagcactcacgtgtatcactccaacgcacgtacaaggccgtcccgaacgctgcatgggattaactactagattgtgatacccccacatgactaggccactcaataattctactctatggggaccaatatactcgagttcctgctccctggaccagcctgggtccctacttatcctctatcacaaaacactagacgtgatctgaattctagcaaccagctctgtactaataaagcacatgcatgagatgtgccacgagcacaatcaactacagctcactgttacacctctgaattcccgggccgtggcgcatacacccggctcagcctccccgttgctggactacgtgtgcgtgacacatacctggtgcgtatgataaccaaaggaacgcactggctcgtgacaggggctgcatactctgacaaaacgatgcctaccacatggttg

SEQ ID NO: 636235 - DNA, 462 bp, Homo sapiens
caattccattccagcgtatggattagcaatcaggagtacgacgagtcgggcccctccatcgtccagcagttgatgactatccattgcggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtattagcgtgttaccctttaattttctgtgatttctctctatagctgcgtgtggcctggtcacttggcgggcggggcaggaacgtgcgtgtggtccacgcctctgtggcctggtgcgtctgtgtggccctgtctctctgctctgtgccggtattgacgtgtcctg

SEQ ID NO: 636236 - DNA, 803 bp, Homo sapiens
gactgggcagacgccaagcttctcccagtcatcggtagcgatacggctcactggcacggactccattgtggctgttgacaggcaagacgaggcctaagtcagcccttcaggcatcgacgtctttgatcgattacatctataggtgtgctcctatcatatatatcgtgtcttcacatccgtaatttggcccgccccttgttcaacctgacagggggcctgaccagcctctgacgtggtcctttaccaatcagcacaagcagcccgaagtgaccaacccatgtgaccgcacagaacatgcgagtggctctgcctgctgagccccaggtgggcctgtcctgcacctgttccccatggggaagccggcctggacccacggccccattcgttccttttcgcctcttccaagcgcccccccagattgtgtctcccgcgcgcttgtgcggcactctgtacctcgtcgacagtcgctctcagccggttggcacgcgtgttccctcagtgcacggacgccagccccaagtgcctgctgccaacccccgctaacacgggtgaccaaggtgtgaaccttggaccagctgcttgggagcactgtccgcaatggcagggcacctgtgactgctaccccctttcttggcatgccccacgtgcgggtgccccacggcgcttcaacgggcccaaatgcaccccagcaggtgtgtgcgggctactggtgccaacaacaagcacctagcactgttcaaccagggcaaccagccccagtgccgattgcctacccgggctttcttgggcgacgatgccagtac

SEQ ID NO: 636237 - DNA, 821 bp, Homo sapiens
gctttctccctgtgtcccccactgtcagcaactctgctgtgtggtgagtggaccgcttaccccactaggtgaagatgtgcagcccaggagagctgactcaggcctcatcaagtacttcctcttcgttttcaagcctcttacttcttcgtcctcggcagcctgatcttctgcttcggaatctggatcctcatcgacaagaccagcttcgctgtcctttgtgggcttggccttcgtgtctctgcagatctggtccaagagtcctggccatctcaggacatcttcaccatggtcatcgccctcctgggttgtgtcgtggggccctcaaggagctccgttgcctcctgtggcctgtatttagggatgctgctgctcctgtttgccacacagagtcaccctgtggaatcctcatctccactcaatgcgggcccagtctggagcgaagcttgcggggacgtcgtatagaaaaccatccgaaagtacggcaccaaccccgatgagaccgcggccgaggagagctgggacgtatgtgcagttccatgctgcgctgctgcggcgtggcacttaccctgcagtgacttggtctccaacgtcctccatcctggaggaggtagccggtgtccggatggctgcaccgcgttgcccgtgctcctgtcttacgaacttggtcggcgaccgaagcgagctcccggcagatccctcagataaggtgatctttgccccaagctcggcaggcttgggcccctgggggcggtccacgccccccagtcgcagactttgggccgtgccttggagagcccttttccggagggctgcggcgggcc

SEQ ID NO: 636238 - DNA, 141 bp, Homo sapiens
  misc_feature (119)..(119): n is a, c, g, or t
aggcccagctaaccgatatacggcaggtccgcacggtgctctacgtgtccgacgcgaacttgtacagggcggcatgcaccgcaatgatgaatacacgtacgaccaggctccatccttancgttatttggtcggtcagcacg

SEQ ID NO: 636239 - DNA, 500 bp, Homo sapiens
  misc_feature (251)..(251): n is a, c, g, or t
  misc_feature (306)..(306): n is a, c, g, or t
gcttaatatactatgttcttagattctgtgctaggaaaccacagaattcaggacactaccttcctgcaaggaccctgggtacttagtcaccatcacagacatttgtagagcacaatctatgtccaagagaccatgcttggtgccacagctcaaagaaaatgtctgtagattggttcgaacctaaggagggactcaccggagcctttcctgggtatgacagcatgcttactctctcccaagtcacaatctangccaaaatgggagatgactacggttattgaaagtttagatcttggttaaacagcntccttgaataagataaaatgaatctgttgataatgccactttcttttccaagtttttttgggaaacggggctaaataactcattcattcataaattcaacacttttcttagcatcaaactccatttcaggcttttgggaatggggctggaaaaacaaagggaaaacaaaaagggccgggtcttaaccttttggg

SEQ ID NO: 636240 - DNA, 194 bp, Homo sapiens
  misc_feature (21)..(21): n is a, c, g, or t
  misc_feature (28)..(28): n is a, c, g, or t
ccaccatgcccagctaatttntattttnagttgagacagggtttcactacgttggccaggctggtcttgaactcctgatctcaggcaatccacccacctcagcctcccaaagtgctgggatgacaggcgtgagcaaccgcacccagcttaaggtttttttgttttgttttgtgacaagagcaagactccgtctc

SEQ ID NO: 636241 - DNA, 229 bp, Homo sapiens
  misc_feature (54)..(54): n is a, c, g, or t
tttttgggaaaaggaaaccaaaggatttaaaactggggtttgggggaaggtttnagcctttccccccactcccctgccccacaccctttattccccagcccaaagagacgctgcttttaccaggaaagactattgaaaaatgttttattttatttttttttgccctttccatccttgaaaaaatggggaaaaaagaagaaaaaagacaaaatggcccataaaagcccca

SEQ ID NO: 636242 - DNA, 895 bp, Homo sapiens
gacagtctccatccaggatcaatccctagatctcgatggtgcccctcatcaggtggatcgtgagcctagcgtgactgtgcctctgaagtaagtatgtctagagtccagaccaggactttggcaaaggaggctgattcggattccatcaaacgcgtctacacctccatcgaactagctgcgcggcacccctaggggccgcctaatcagtctccccagacctgccgccgcctacagtggggtccatgactccggcgtctgacacggccgtggagcatgctcgggcggttggttgaccttgtttgcctggcggctcgccacatggggccacgcggtgctgggtggtggttgtctccatgcgttcgtgtgcctgcgatttgagcgtggccctctcgtgtgttggtctcagtggtaaaatgtacgtaatcgcctttgttccactagtgggggcatggaacgtgaagacctcatcgttgggtagcgtgatatctcggtcaattcttgagtcgaccgaaatcagggagggtcctgggactaccctagagtttcgcactagggtgctgtgttgatagtcccatgcgtcggcagccatgtgccccattcatgcgacctgaagtccctcgtaatgttctaacggtacgcttgttacagctggaagcggcattcaatcgatcgtgggtgggaaacacctagtagtcaccagtgtaagcgctgctactgggagcggtataggaccgggcctttggacgatcggggcccagcagggctcaaagcccaccatgcctcttgcctaagaaccatggcaacttccatggggaactctatgggagttggtttgaaagacactttagatgagccagaggcctttataccttgctctcgggaaatgtggttagcg

SEQ ID NO: 636243 - DNA, 538 bp, Homo sapiens
aaggctgtcacagttgatttaacaagtatgatataagaaatgagtcggtattttaccagttctatacagtgatggaatcttctcgagttgcgtatttataggaattagaggcgctgcatgatttacactagaatgcttttcctcatttcaagttgcacatagaagaaagaaaagaaggcttcttctctagtaagcattagcatggtctaagagtgatcatccctattttttgtctaaaaccagttttatcagagaaacaaagcaacaatttctacatctgcaagacaagtttggcttcagccattatgtatagatagatgtgtgtgggtgtgtacgtgtgtgcacgccggagtcaattcctatcatccagggtaatactgggagacgcccacagagttcactatagaaaaaaatcttcccgaaacatcacaaagttatcgggatacattataagcttgcattatttcaggaatcagttctgaatattattttgcttcttactgttaaacataaatgtataaagtcttgaaaatacaaa

SEQ ID NO: 636244 - DNA, 216 bp, Homo sapiens
gtaaccgcggtgacgaacgacgcgacaccctcctggggacacgtgacggccgggcgcccagacacgacggggctgtctcctcgccaactttctactaacacactggacacgcgacgacgttttgactcccacacatttacaacacctccgcacccaactttcaacacttaccctacttgttcctacctgacacgtgacgcttgacgaccttgcacc

SEQ ID NO: 636245 - DNA, 428 bp, Homo sapiens
agtgggctggcccaggcaacatcctttcatcgggattcgtgtgtttgcttcacgtgacatgttacgcgcacttgccggctatgcactgtgtggccggctatgggtcagctggctgctcgtggtgtacaggtccccggagcgcatcctgcctgggtggcaagtttctggcggtcacgccctgtccgctttcgctccaggtcacactgagtgagctcctgggggaagaagccctggaccaggcaggcgatgaccacgttcccatctggctgggtgctgcagaggctcagcgggaagaccttggggctggtcggggatgctggaacacagaatgcactgtgaggacgcggccctctcctctatactgcctctcctctatactggaggaacccagcacagagaggcctggtgactgccccatggtcacacag

SEQ ID NO: 636246 - DNA, 116 bp, Homo sapiens
acgcgtcaagtactctataggtcggcattcttgaatgacagggaaaggcaaacatctctacagaggtgtgatcgaaagcattggatattaggtacacggaaactttaaatgactgg

SEQ ID NO: 636247 - DNA, 368 bp, Homo sapiens
ttatccaggagaatgggtttcttgttgaaatccgaaattttttgggtgaaaaatacctccgcaggggtcggatgagacccggtgttgcttgttcagtatttccagcccagaaaaatgaatttatccctgaagggaatggccttgagcttggttcaaattcagcgggtttggttcagccagccccccccgtttaaaacaaggatatccgggaatttttgggtgggatttatgtctttgaaaaaggaactgttcagccgggtgatgaattagatttaagagtttcctgggtacagaaagaagatgcccgatggccctttagacccccttgtgatattttaatggtgccataaaaggccttttggtttgga

SEQ ID NO: 636248 - DNA, 950 bp, Homo sapiens
cgacttctccgtgtccttaaagcgtcagggaagaacaaacacttcaaggtgcagctcgtggacaatgtctactgcattgggcagcggcgcttcccacaccatggacgatggctggatggaacactacaaaaaggctgcccatcttcaccagcgagcacggggagaagctctacctcgtctaggggccctgcgatgtgacgtgcgccccggctcccatcatctcgcctcccgtcgctcgccacggtgcgtacgctgtcccgcccggcccttggtgggcagaggtctcctcccgcgtggaacggccccgagggcttctctgcgagtctctctttatggttcaggtcgctgtggtcggttcgtctcccatttgccatccaggcctcacactccacactcgagcccaacccggctgccagactttagaggagggtgagtgagccgtgcgacgttcaccattagttccttgtccatcggagaagtggcggctcggtgcattcatagctcgttccctgttcgattggcacccctctttaagcagaggacgctggtggcaccgtgtgagcgctggatgcgagcctaaggccacccagcggtagtcgcccgtgtccctgggcgctcatgcgtgctgggcagagcaggtgcgatggccccagtcctagcagccctcgcccatgtctgtgcccttacatggctcccggactgtgcagggtaggccgaatacgtttgctgatacgcaatactggaaccaccgggtgcgatggcagtgaggagacttgccagtgcctttggggctgtgtttgccctacgaacgattctggagggcgtgtctgcgaagaggcccggtgactcgaacgacgatgtttggtatttccccaattgcctcccctgtgctttcctctgccccggttgttgatccccacttgtttttctcccgatgttttgccttgtgc

SEQ ID NO: 636249 - DNA, 267 bp, Homo sapiens
ggagaacaaggcgtgaatatactgatactctaaattcataaaaaccgtgttcgaaaggtttagctgttagaatcgtgggaaaagtgatgcatggatccttgcaagtttatgtctttgggttttattttctattttagattttggtttagtggttttctgctgttcttccacgtctgaatccctttctagtgttcggatggcacaagtcaccacctctgggaacaaaaacttcaacctcctgtgtatctgaggcagctcgcccctgag

SEQ ID NO: 636250 - DNA, 137 bp, Homo sapiens
tctagaggatccttaatatgctgtctcacatcttactaatcgttggactctgggactcatgcagtctgccagttcaacttccaaaagtgctgggattcagacgtgagacactgtgcctggcggataatattctttga

SEQ ID NO: 636251 - DNA, 737 bp, Homo sapiens
accagctacttactgcttatcttcttcattggaactcatagttcacgcaagctcctagtagactaacagacagacctgactggacacccagcaacagcctgcagcgtacgcttctgcactactgaaactcctcctgcatgcgacacagcttgctgacaaacacagctgcccaagggccactggctgacccatgtcatgttccatgcaaacacgagcttcggatccatccatggacaccgagctagcacacgagcgtgcatctcagcagctggcagctctagcgatgatccgaccgaggccgagcgatctccccgcacctcagcgcacattctctcgacgtctctcccgcctggagcgcgtctcactgcctcctgctctacccgtccttggctcgccatacccctccctcctccccgcacagctggctccgcgctctccgccgacacaccgctggccaacgctccctgcctacggactcgcccttctgccacgcactccctccctgcactgcctgcgctctactgcgcccctccccatgctgcaacccgactgctcccccacacagcccacgagccctggcgctccctcggcgcgcgcacgctaccacacgcacgcacctgcccacatgcactgctgcccgcctcacgcccactacctgcgctgcgcaacagctgctcggcgcctggctggcacctccccctccacagctaccactggcacggccctctttctccacc

SEQ ID NO: 636252 - DNA, 381 bp, Homo sapiens
agaggatcctcttgtgccccagaacctaacgttgtggcacatgatttacactgagtgggaccaagcctgcagtgagatctggctgtctctgtgaatcaaatgcctaaagtatacgtaggagctcctgatctaagcttggaggcatcgaagggaggattaaactttccaaaatgaagcttgccccaatttgggatctctactccgggggtcgacttgcacgtcaattgcacgggggcacaggtttctggcgaactgaagggggcaggttgtggatgtgaacctggaaggggctcgggatttcagcaccgacatgtttgactttaactttggaaggaccaaaaagttgaaagggagccttggggccactgggtgagatcaaag

SEQ ID NO: 636253 - DNA, 212 bp, Homo sapiens
atgcatatgctgtgctgatgaaagattcatgttgtctgactttatttgaggctgtcaacatcacctaacagttctttttttgtaattatacgcaagtagtgggatacatgtgcagaacgtgcaggttagtgacatagggatacatgtgccatggtggtttgctgcacccgtcaacccgtcatctacatcacgtatttctcctaatgctatcc

SEQ ID NO: 636254 - DNA, 131 bp, Homo sapiens
catggctacagtttacggaagatgtcgacgagaagcacaagatgctgaggacataagacacgatctggagcaagagatcgccagctaccgcagactgcatcgagggccagagacgccaagaatgattggtt

SEQ ID NO: 636255 - DNA, 492 bp, Homo sapiens
  misc_feature (37)..(37): n is a, c, g, or t
  misc_feature (63)..(63): n is a, c, g, or t
  misc_feature (80)..(80): n is a, c, g, or t
  misc_feature (132)..(132): n is a, c, g, or t
  misc_feature (154)..(154): n is a, c, g, or t
  misc_feature (189)..(189): n is a, c, g, or t
  misc_feature (259)..(259): n is a, c, g, or t
  misc_feature (268)..(268): n is a, c, g, or t
  misc_feature (332)..(332): n is a, c, g, or t
  misc_feature (475)..(475): n is a, c, g, or t
taccaagtatatcaaattcaccatcaagctttcaagnaatttcagaccctaacctctgggganctagtaatttcagaagnaacaaagattattacattatatctacatcaaatgggtctttggagggccggnataaccaggagggaggggtgtnccagacaagagccatgaagatcctcatgaaagttngacaagatgacaagttctgctggatcaaccaggaataaagatccaacaagacgtccagaactagaagctngtacaaatngaagaagttcgacaacaagtccctttgtaaaaccaaatccaggttctagcacagacggcaacancgccggacattcggggaacaacatgctcggttccgaagtggccttatttgcagggattgcttcaggatgcatcatcttcatcgtcatcatcatcacgctggtggtcctcttgctgaagtaccggagagacacaggaagcactngccgcagcacacgacca

SEQ ID NO: 636256 - DNA, 794 bp, Homo sapiens
attttggctgctgtagcctggtctgagtcgaggggtggcacgcgccgcgcgccccaggaatctcgggacagaagggtcccgaagagtcgcgcttgtgtgagagaaatcccagatcctgtgatgggggacaccagtgaggattgcgctcgatccatcgatttggaaggcacgtgatcttggacttgtcaggtctgggtggtcttatctttgcgagtccaaatagtgcggtcatgcgacgcagcatgtcttcagaggctcctgcttccccgctccttctattatctcggagcgtggacttggtggctttcccgtgaaaacggagagagcgagacggagaaggacgatggggaggacgaagaagacattccaaagtctcctcctacaaggactgggaagagagcaaggatgaccagaaggatgctgaggaatgcagggctggtgaccaggctggtcaaaatatccggtacatacgacagacattatcggtctgctcgggtagagactccatcccatccgggtggtgtgagcgaacgagttggggaacgcagtcggcagagagagcgggagcggcgggaacatggtgtctattgcctcgtccagagaatgaaatggttggcagaagagaactcgcgggatcgagactattgaccgcgagagggacagagatgagggggatagaacgtttgcacagcagcgatcagagcgagaatggggggccgagcggagcccgggaagaaatgagccgagagccatgaattaccaagatgggcagccttaggttcggaagagagatg

SEQ ID NO: 636257 - DNA, 814 bp, Homo sapiens
  misc_feature (14)..(14): n is a, c, g, or t
  misc_feature (19)..(19): n is a, c, g, or t
  misc_feature (22)..(22): n is a, c, g, or t
  misc_feature (32)..(32): n is a, c, g, or t
  misc_feature (311)..(311): n is a, c, g, or t
  misc_feature (461)..(461): n is a, c, g, or t
  misc_feature (468)..(468): n is a, c, g, or t
  misc_feature (475)..(475): n is a, c, g, or t
  misc_feature (478)..(478): n is a, c, g, or t
  misc_feature (485)..(485): n is a, c, g, or t
  misc_feature (538)..(538): n is a, c, g, or t
  misc_feature (567)..(567): n is a, c, g, or t
ctaagtgccaattntattnggntatcaccaanattgaaaccacggcgttggtttataaaacaaaagcagtgtacgcgattccggatgtgatatgcaggacagcggaattcgagcggctggatgagcatgcgaacgctcatgtcagctgcagatggcagcacacggcgctcgcacgggcatgagggtatgggctgcacgccaggtctacgacccagtactgtctgactcccgagtcccagagctgggtgagcccgccacaacaccagcacacaatactacaattccgcctagggccacaaggcttccctgtnttccccccaaggaggctgtgctgtcttggctggacccagccaggcccagcgacccctctccctgcatggcatcctccagcccctgtagaactcaacctctacagggttagagtttggagagagcagactggcggggggcccattgggggnaaggggnccctccnctntgtagtnctacagggtccaacatagagccgggtgtccccaacagcgcccaaaggacgcantgagcaacgctattccagctgtccccccnctccctcacaagtgggtacccccaggaccagaagctcccccagaaagcccccagagcccagggtcggcctgccccccccccatttccccagtgggagcaaactgcatgcccaaagacccagcggccccccccggtttggtttgcaacgcctggcatactatgtggatgtgccagtggggtttgtaatgagagccctttcttttttttttatttccctggagcccaataaatggctgtaaaattccca

SEQ ID NO: 636258 - DNA, 967 bp, Homo sapiens
  misc_feature (967)..(967): n is a, c, g, or t
ggaggtcggggctgcgggcgctcgctggtggctggacccggaggctgctgcgtgcgccggggctccgtggcctggattgaatccgatcgggagccatgagcgtggacaaagctgagctatgcgggtctctgctcacctggttacagacgttccacgttccgtcatccactgtgccagcacatcaggacctgagcagcggccttgccgatagcctatgtgctgaaccagaatagaccccatccttggttcaacagcgggcatggcatccaagggcatcatcggcaagatccatggtccacaactggacagctgacaggtccagcacatctgaagcatggtcttacgagagccatagtagcagtactcccaggcatgtccatggacgcatccatgtgtcagcaagagcatctcccagcatgtgagccatcattggagagttctcagacccggcagagctcggaaagctgcttcagctggtgctgggctgtgccatcagttgcgagacaaagcaggaccacatccagagaatcatgacgctggaagaatcggttcagcatgtggtgatggcaagccatccaagagctcatgaccagagacaatcatgactacccatggtcaccagacagacgtatggcaactagacaggcagaaccgaaggatacaatacctaagtgaggaggctgcggaggggacgaaataagaagagcggaccggaccagaggagagaacagaaacaacaggaaagaagaacaagcaacactggagatagcaaacaagacacacacaagaatacgcaaaaaaggagcgagaaccaagaaccaagagcacacgagcgcgaagagaaaccagaagaacaataggacagaacgacaggcagaacagaacgcagacacgagcgaagcgccgcagaacacacagagaacaaaacacaaaaaaaaaacaagagacagacgcaaccaagcaaacn

SEQ ID NO: 636259 - DNA, 978 bp, Homo sapiens
  misc_feature (737)..(737): n is a, c, g, or t
  misc_feature (978)..(978): n is a, c, g, or t
gtggacgcaaagactgggcatgctccgtggcggtacgaggtttggtcacaagtaggaagaagccagtgcaccagaccggcaagggagaagcgggagcggccgggcaggcggcggtggggtcccgctgaccggcgggaatcggtagctggcgaggaagagcgcgaggtgacagcagtggagatgggcgccggtcccgagaagtcgtcccagatctgcgtcggcggcgtctttctgccttcgccctcggaggcgggtagcagttctggaaacccccagggggtctggtacaactcttggggcagccaagggtccccgccgggtcggtgttaccggaatcgggcataggaccctcccctccgatctgaagtggctgggggcagaaggagccgccccccggcgagtgttggcagcgacaagtcggcaatactggcggcgccgaccaggaggtgtccgggcatcagagcccacggaaagtgcgggaagaacgaggccgacaacccccgggagggaagggacgctagccaagagcaaggaggtgggccggcccaatgggggctcggctgccccagggctcttccgcgggtggtagcacgttggggaagcgacacaacccaaggcgcccatagggccgaacccaagcgagacgggggggcacgcgggagtactcacattccaagtgttcctgacagcaattctaacgacgggcccgtcaggggcctctgccagaggggacgttnccttcaataggttgcggccgcgtgtcggtgcacacaacctgtggttgggaaacctggcgcctcagatcaaaattaaaacagttccgggtgggtccatgttcgtgggcagcgaacacgttcctgaactcttgcccagaaatggggtgaatagccacacacgcagagcccgtcgtatccccttggggggaccacagcatagtgtggggtgtcacatgatgtgtgcgaggcgcccacaggtaan

SEQ ID NO: 636260 - DNA, 290 bp, Homo sapiens
atctccgattaggtgggccacggggtaatgaagagctcacggtaggcgccatctccagaaaggatcctactgtcaggtggttggtgagtccagagtggctcccccagattacaccgctgggtggcaacctaattatttttcattaaacttttagttatggtacatttcaaacgtgtgcacaattaaagagagtcgtacaatgaacctcgtgtgtccgaaactcaacttcgacaacgatcaactaaatgcccaatcttgttttatctgtatctccacacacttccccctct

SEQ ID NO: 636261 - DNA, 373 bp, Homo sapiens
  misc_feature (322)..(322): n is a, c, g, or t
gacccccagccatgccccgccgcccccaggttcaccgacgcccggtagcgcatcctgcccggccggcctggcgcccgctccgctgcccgcgctccgggtcccgggctcggcggcggtggcggcggcgtcagcgagggagggcccgccccccgcaccgcccccacccgggcccctgaagcgcggggcttccccggcctcccccgcctcccgcgcggccgggctggggtcccctccaggtggggttggtggaggtgggggtgtcggggcggggggtccgcgggccgggggcgggggcgggctccgcctgagtcaggttttccanggagggacgccgttggcacccagggtggagcccgagaacctcgcgcggccg

SEQ ID NO: 636262 - DNA, 170 bp, Homo sapiens
gaattttcaggtatttataagcggctacgaccaattttaatgaccccgtttcccaagaccttatcaaaaacaaatgaccgtcaaagggggatttgaaggcttttattgggttgatactagcaacacacattccaaaacaacaggtatgacgcgttcatcaaaagatcaga

SEQ ID NO: 636263 - DNA, 105 bp, Homo sapiens
cagtgagatgaaccaagtgattggatggggttttgagttgctggaataatggagttccagtgtccaatgcataagccccataataaattatatatttggtgacca

SEQ ID NO: 636264 - DNA, 181 bp, Homo sapiens
gttatggaaagagataagataagccctgtatggagcacttgtgcatggggcgcagtgttctcgtatacacccggggctgcccggctgccaggctctgcggcctcaccttgtgaactacatgggcaagcagcttcttccagtgggctgaggttgtcgtgtgcagaccaccatccctgcggta

SEQ ID NO: 636265 - DNA, 334 bp, Homo sapiens
cacgaggcggaggccgggccatgcggggctgtttggctggggcaggcggtgggctgcccggagggacagctgcggcaaccggcggggggcgtcctgatttggaggtctaaggtgctgccatctcccgaggggccgctcgggccccttccggcccgggtctggttgggccgcaggaacaaggcggactgcagttcccgggtctggacctggcctacggtttcagcgcccgggcccgggggcgcggatccggcagccatgtgtggatcttgaaacgccacgtggtcttctgaagcgctttgagagttctaaagggatttatattgcaaactgatta

SEQ ID NO: 636266 - DNA, 158 bp, Homo sapiens
gggctgtggcaggagaatcgcttgaacccgggaggtggaggttgcggtgaattgcactccagcctggaaatgagggcgaaactctctctccaacaaaatttagctgggcttgatagcatgcacctgtagtcccagctactcaggaggctgaggtggga

SEQ ID NO: 636267 - DNA, 703 bp, Homo sapiens
  misc_feature (438)..(438): n is a, c, g, or t
  misc_feature (493)..(493): n is a, c, g, or t
  misc_feature (510)..(510): n is a, c, g, or t
aggatattgaaatggataacagtagttaatctaccgaacttagtctaaaagtgtatgagaaacttttgcatcatgacaatgaatttttaaccatgtatctccaaataacctccatataaggctatatcacattaatagcatatattgataataagtgattttccccatgagataccctgtcacaggggaagcactctgctaatttggaagatgtatggatatgcattcgatgcttatcaggaagtatatttatcagagaatttgccgcatgtccatggcacaggtctattgtagtattccataaattatcttttggctataaattctgctgttctttaacagccttttctatgactatgtactccttgatagagagatagacccttgtgtagtctgagatctttactacaagttgtcttctctgactctgtttagtangaccacgtaggcagatcacctgtgatcaggagttcagaccagcttgtcacatggnacaccctgctctataangatcaggattcactggagaggcgaggcacgtgtattacagattgttcgatgctgaagcttgagaatagttagacccttgagcacagctgcaggagcatgaatgtgcactgactcagccttggaatacagttgactgtataacggaaacattgcaggaaggactatcgaccgttgggcagtaggtttgttgggc

SEQ ID NO: 636268 - DNA, 140 bp, Homo sapiens
tgtctgtacttataatttcttaaccatgacattgctccatagattatctcatcttgctagccttacggtattctaatgggaagctcatgagaaccaggaacaaaccagcacatcttttgaaatttactcctttgggacta

SEQ ID NO: 636269 - DNA, 353 bp, Homo sapiens
ctacggacgcaggctgcctttcttcggttggtctcgggtgtcgaggcggtcggcgaattccagcggatgtttgaccaggtcaagtccggccagcggtctctcgactccctgacagcgtggatcagcagcaacacacaggtatcagctgtttaccgtgacgaactggtcaagcttgctgcgtcgtactcaagcagcagccaaaaggccgctgacttccaggccctgcttggaaaaagcaaggagccgcttgataaggcggcggcgggtgcgcgagctctagctgattctcagtctgcatcctctgccgccgtatcgggcggggctcaggcttgggataagtgcgtccgtagcgg

SEQ ID NO: 636270 - DNA, 145 bp, Homo sapiens
aagacgacagaaggggttctgggcctagttgtccctcccctctggagcccccgtcctgtggtctgccacagtttcccctcctaatacatatggctgttttccaccctcgataatataacacgagtttgggcccaaaaaaaaaaaa

SEQ ID NO: 636271 - DNA, 298 bp, Homo sapiens
  misc_feature (134)..(134): n is a, c, g, or t
  misc_feature (136)..(136): n is a, c, g, or t
  misc_feature (160)..(160): n is a, c, g, or t
  misc_feature (174)..(174): n is a, c, g, or t
  misc_feature (235)..(235): n is a, c, g, or t
  misc_feature (265)..(265): n is a, c, g, or t
caagataggttgggtcgggcaaggagggatgtttttatcctctttctttccaggcttctgaattcccttctgagttaatgtcaaatgacagcaaagcactgtgtggctgaataagcggtgagtgtttgcttgtncnacccgtggtaaactgcccctgggntgtgtgcgcgcggntggttgtttttgcttgtgtatctataaaatgtctgatttggtaaatgcatgcttacttcgnggtgttacccgtactcattgtctcactggncatgaggggcttgtagctttgggtgctcgggtc

SEQ ID NO: 636272 - DNA, 190 bp, Homo sapiens
  misc_feature (120)..(120): n is a, c, g, or t
  misc_feature (132)..(132): n is a, c, g, or t
  misc_feature (155)..(155): n is a, c, g, or t
  misc_feature (176)..(176): n is a, c, g, or t
aaggcaaacattttgggcaacaggcttttactcggattacagttggattcatatccctaacattttagataagaatggaaagccaaagcaccagagaggggttagtcctgttcaaaatcntgttctttttgnggactgccgtggccaatataaanagaggttcagggctagttggntggtgttggcgtgg

SEQ ID NO: 636273 - DNA, 838 bp, Homo sapiens
ggacgcgtgggtcgccagccgttcacgcgttcggtcctcctatggattgaatcaccgtcctcgcccgtcgaaccatggacgcccccaggcaggtggtcaactttgggcctggtcccgccaagctgcgccagatcagtgtaggttagagatacaaaaaggaattattagactaacaaaggagttggcatcagtgttctttgaaatgagtcacgaggtcgatcagatttttgcccaagattattaacaataccagagaatcttgtgcggggaatttgggtagctgttccagaaaaacgtataaggtgatatttactaggcaaggaggtgggtgcggcagttcagtgctgtccccttaaacctcatagtgcttgaaagcaggaaggtgtgcggactatgtggtgacaggagcttggtcagctaaggccgcagaataagccaagaagtatgggactataactatcgttcaccctaaagcttgggagttatacaaacattccagatacaaggcactggaacctcagccagatgcctcctaccgctgtatttatagcgcaaatgagacggtgccatggatgttgtacgttttgacttaataccccgatagtcaaggggagcagtactggtaggtgaccatggtcctcaaaaactacacggtatcaagcccaatgggatgttccaaagttggagcacataaaagcaggtggcccacgaagcatgtgactcagcagggggtcaccgggaacaagacgagaaaacggagaggaaagccacgaaagatgcctcgactgacaaaaggagcagagaaaagctacattaaaaacgagccgtagaatacgaa

SEQ ID NO: 636274 - DNA, 742 bp, Homo sapiens
  misc_feature (30)..(30): n is a, c, g, or t
  misc_feature (118)..(121): n is a, c, g, or t
  misc_feature (123)..(124): n is a, c, g, or t
  misc_feature (202)..(202): n is a, c, g, or t
  misc_feature (209)..(209): n is a, c, g, or t
  misc_feature (221)..(221): n is a, c, g, or t
  misc_feature (223)..(223): n is a, c, g, or t
  misc_feature (232)..(232): n is a, c, g, or t
  misc_feature (235)..(236): n is a, c, g, or t
  misc_feature (239)..(239): n is a, c, g, or t
  misc_feature (242)..(242): n is a, c, g, or t
  misc_feature (260)..(260): n is a, c, g, or t
  misc_feature (262)..(263): n is a, c, g, or t
  misc_feature (281)..(281): n is a, c, g, or t
  misc_feature (299)..(299): n is a, c, g, or t
  misc_feature (310)..(310): n is a, c, g, or t
  misc_feature (313)..(313): n is a, c, g, or t
  misc_feature (389)..(389): n is a, c, g, or t
  misc_feature (427)..(427): n is a, c, g, or t
  misc_feature (538)..(538): n is a, c, g, or t
  misc_feature (576)..(576): n is a, c, g, or t
  misc_feature (630)..(630): n is a, c, g, or t
  misc_feature (637)..(637): n is a, c, g, or t
  misc_feature (660)..(660): n is a, c, g, or t
  misc_feature (664)..(664): n is a, c, g, or t
  misc_feature (675)..(675): n is a, c, g, or t
  misc_feature (697)..(697): n is a, c, g, or t
  misc_feature (700)..(700): n is a, c, g, or t
  misc_feature (710)..(710): n is a, c, g, or t
  misc_feature (723)..(723): n is a, c, g, or t
gatccagtgcacattatagcgccgcccgangccctcaccttccccctcccaacctggcccctagagtacacccaaaacagaaaaaaaaaaggaaacccagatccctgctcctcctctnnnngnngggggcttggccagggagccccttccataggtcccagcaggcaggagagtggacccctctgtgcccagagagcaaggntccaggntccaacaacagntngaacatgcnggnnggngcnggagcagaggcctgtggntnnggggggggaaaggggggngggaagggcactgcctgnggggtgcgggngtntggtcatcccggggatgcacgcagcagcttccgggcatcaggggcctgcccctggctggttagcgctttgacagcncgtgggacagccagttcagaccatcgtacagacctgtnccttgggtggcacaggtggcctggacataccacgtgcggctgcgtaagttctgttgccccagcttgttagttagctcgctcacgggcatggcgttgggcatgtcctgcttnttggcaaataccagcagcactgcatcccgcagctcgtnctcctgcagcatcttctggagttcatcagcagattcttggacccgctcccggtnattactnttcaccacaaagatgaggccctnagtnttctggaagtngttccgccacagaggccgaatnttnttctggcctnccacgttccagantgttaaacagatgttctta

SEQ ID NO: 636275 - DNA, 677 bp, Homo sapiens
  misc_feature (108)..(108): n is a, c, g, or t
  misc_feature (228)..(228): n is a, c, g, or t
  misc_feature (242)..(242): n is a, c, g, or t
  misc_feature (257)..(257): n is a, c, g, or t
  misc_feature (354)..(354): n is a, c, g, or t
  misc_feature (479)..(479): n is a, c, g, or t
  misc_feature (613)..(613): n is a, c, g, or t
tggccggatcggcgttttattctataatttttaattagtgacgttgacatctttcctatcgggcttttacatattttgggcttggaggtggccttcacttatcttcancaaaattatctattgagatatcttttttttcctgtgatttgggagtgctcttgatatgctgaaatgtgtgcactgccacattttgccctatttgttcttcagtttggggtttgcttgcanttgtggggggggcnttcactggatggaantgttgataattcatcaaaagcaaatctattgagtcttttttcttcatggctcctggcttcggtcataaactcttacaggtactacaatgaacactcngcactgtgggtaccatggtgcagatgtcttttgtatccttccagaaaaccatttgaggagtgacttttgcaaaatgtaccagtctggcaaagtatgcagtcaggcagagtacttctgctattganggggccaaaaaaggcaggggaagcaactcagactcttcaaacagggcaagagcgaggtctacacaaataaagaagtatgcggcaacctgcgtttgtctagtgggtataaaaatatgaactgctgatggcctgangtgagtttcaaagggacatttctgggggactgggcatccaaacataggcacgtgcaggagaagg

SEQ ID NO: 636276 - DNA, 112 bp, Homo sapiens
  misc_feature (13)..(13): n is a, c, g, or t
  misc_feature (32)..(32): n is a, c, g, or t
ctaccccttcccnagtctctggggtcaggaanaatcccttattttaggttgtgttttgtttttgtatagggaccccagggcagggctagtaacagtttttaaataaaaggca

SEQ ID NO: 636277 - DNA, 359 bp, Homo sapiens
tcgaccgggcgacagagtgagactccgtcgcccggcatggagtccagcgacgcaatctcggttcggttcactgcaacctccgcctcccggattcaagccattctcctgcctcagcctcccgagtagctgggaatacaggcgcccgccattacgcccggctaatatttgtatctttagtagacacggggtttcactatgttggccaggctggtctggaactcctgacctcgtgattcgcccccttcggcctcccaaactgctgggattacaggcgtgacaccgtgccgggccctctctcttctatttaaaaggataggcacagcttttggaactgaatgtctttcctgtcgacgcggccg

SEQ ID NO: 636278 - DNA, 462 bp, Homo sapiens
ctcagcagttttaggaaatagagggggagaaggaaggtatgtaccttccttccaccagggaggcacgcccagccctaaccagccagcgaggcagtaggtcctcctagctaatcttcacaacctgggctggtgtcgggaagactttcgttccaatgttagttttggtatcctgtccgccatccgttaaaaactttgtcatctaaggtaagtcacatcacagtattgcaaagcccccgtttcctcacagaatggttgtttgagagttatcaatgtaaattacttggcacatgtaggcatgtgacagactgtagccaatgttactcaaggtcattttccactgattcatactttgacccatttcctattgtcgattctaacacacattttcaaggcagcttcctgataatacggctgtaggatttttctgcgaaataaatccaaaatgtccattcaaacccgata

SEQ ID NO: 636279 - DNA, 985 bp, Homo sapiens
  misc_feature (198)..(198): n is a, c, g, or t
  misc_feature (219)..(219): n is a, c, g, or t
  misc_feature (222)..(222): n is a, c, g, or t
  misc_feature (246)..(246): n is a, c, g, or t
  misc_feature (634)..(634): n is a, c, g, or t
cagaggttggctctggcctcagtaccctgagtcgcctctgcccacattgtgtcctgtgggggtggggtcaaccgctgctgtgtacagaagcacaggaacggatgtgtatgtaactgtttaatgtgggatatgttcccctattcctgtatttcccttaattgcgcctcgcgacgtgtgttacgcccccagttgcagtanttaactgggctgggtagggtngcncagtctttgggggaggttaggganttatcctgtgcttgtaaataaataaggtcatgactctacgctttttcagttgttaacttgtgtgcattgaaaatattgaggaagcagaatggtggtagccccacgcacaggggtaagacacgcaagaccagcaaggcgtggaaactcatgtgctctcttatattatcattgtgggattaattctaaaccaacagtcgattcagataggtcttatggttccaatatattttatttcaacaaacaccaacaaaaaccgtccaaagtaaacaaatccttggggcgttcaaacaaacaacaaacaaaaccaaacaaactccgcagcgaggggtgccctgggttaccccaaattcagcccatcatacgtggagtacgctatatacaaagttcnacatgggcccgatcgctttttacaaacggtcgctggacgtggcgagagaacccctgtggcggttaaacccaaactataatacgcgctctggcaggcagcaatccccccctttcgcgcagactgtgcggtaaatagacgacagaaggtgccggtaacagggtacgcgccgtatccccaagcaggtttgcgacaggacgtgtacatgtggcgaaatggggcacattggtatagcggtttaactaatttatggttagaacattcggcggtctcaaatattttggtgtgaaatcagagtcaatatttattaacacaaatatgggcgagacatgggtaaatatcgcctttctcttc

SEQ ID NO: 636280 - DNA, 248 bp, Homo sapiens
gctttatctactggatgagttccgctgggagatggaacatagcacgtttctctctggcctggtactggctacccttctctcgcaagtgagccccttcaagatacctatagagggacttgaggacagagtgtttgttgaattgcaataccagcatcacatgggtagggggaaccgttgggacaaatttttagacaatacaagacttggacctgggaaaacgcaatcctggacccacagggattatatag

SEQ ID NO: 636281 - DNA, 294 bp, Homo sapiens
tttttttccctaaacccccccccccccctttttaccggggggggggggggggtttcaaaactgttttttttcattgccccttttagtttggtgggaaaagggggggttttgaaaccccggcttggtcacccccttcgaagggaagggaaaattttttgggccccccctggtttttttttttggggggggggggtttttggtttttggttttttaaacccggcttttttttggggacccccttgccccaaattttgtccccggtttttgggccccctttaaaaggttttttggga

SEQ ID NO: 636282 - DNA, 559 bp, Homo sapiens
  misc_feature (334)..(334): n is a, c, g, or t
  misc_feature (356)..(356): n is a, c, g, or t
  misc_feature (360)..(360): n is a, c, g, or t
  misc_feature (372)..(372): n is a, c, g, or t
  misc_feature (390)..(390): n is a, c, g, or t
  misc_feature (435)..(435): n is a, c, g, or t
  misc_feature (469)..(469): n is a, c, g, or t
  misc_feature (490)..(490): n is a, c, g, or t
  misc_feature (506)..(506): n is a, c, g, or t
  misc_feature (514)..(514): n is a, c, g, or t
  misc_feature (520)..(520): n is a, c, g, or t
  misc_feature (537)..(537): n is a, c, g, or t
  misc_feature (551)..(551): n is a, c, g, or t
caaaaaggcttggtatgccaaaatggcgccactccaaacagttccccagcgaccctataaggggagggcttcccaccatttattcgcccccagtggggacaaaaaaaacccagttaaatttaagggtggagacaaagttctggagcctttgagcaagtttatagaagaacatgccccaaaattgagcaggcccaaggaaaagcttttaaggccttaggttttcgaaaggtgggagaaggcaaaccccctgggtggcccatggttggggggtcccccccgaggccggcaacaaaagacagtatttcggattccttttttttttttttaatttttnaaacttgggggtttcccttcangctntgaaaactgaanaaccatgaatggctgaanagtttagtccagatttttacaaaggaaacatctatttttatcatnatttggggtttgaaaaatttttttttaccccttntaatttttttatttttcaaancaaaaaatttttttgngggaaaangttttntttttttaatttaaggnttaaaattcctttnccaaatca

SEQ ID NO: 636283 - DNA, 573 bp, Homo sapiens
  misc_feature (455)..(455): n is a, c, g, or t
actatgaatgacactttattcagtcattttctttacaactgaaactctgggaattcaaaattaacatccttgcctgtgagcttcttgtacacaccagaaaaagtttcaaccttgtgttccacgttgttctgctgtgctttgtctaagtgaacttttatgagccggctgccatccagtttcacacggatcctcttacccacaatttcacttgggaagactaagtcctcaaggatggcgtcgtgcactgctgtcagggtacggcttctggggcgcttctgcttatttttcgtacggcttttccgggttggcttgggcagaatcctcctctgagcaatgaagaccacgtgccttgcactgaactttttctccaattcacgaactagcaggacttggattttctgggaaagattaagctgaggaactggtacaaaaaattatgatagcttttcggacancgacaacttcggatttccttggctgccgtgatgttgagttcacgcagctgcgccttaaaatcgaggttcactccagtcgagcacgcctagagatgcagatcgactcgtcggttctcgc

SEQ ID NO: 636284 - DNA, 412 bp, Homo sapiens
gatcgaccactctgtcaggccatcttgaactcctgggctcaagtcatcctcccacctcagcctcttaagtagctgagactacgggcgcacaccattgcgccagctaattttgtatttttataaggacggtgtgtcactgtgttgcccagcctggtcttgaactcctgcactcaaaacgattcacccacttccggcctcccgaagtgttgggattataggtgagccactgcacctgggccaggacatctctaatatgaaataggacacggcacggtggcttacatctgtaatcccggcactttgggaggctgaggtgggtggatcacctaaggtcaggagttcgagaccagcctggccaacatggtgaaactctgtctctactaaaaatacaaaattagccaggtgtggtggt

SEQ ID NO: 636285 - DNA, 250 bp, Homo sapiens
gctgctgttaattatgttctgaggacacgccctcttttttgtgtttaaaggagaaaaatattcacgtcacgtgctccgcggaaggtataatttcctcgctggggtctgcaccacctccctcgtctcgggtaggtggaatgttcgggtttgagaaagtaaggagaacccagggtggtatccgctcgtgggctcttaaccccttaagtgattttggaccaccgtgccttcccttcaagattctttttatcca

SEQ ID NO: 636286 - DNA, 195 bp, Homo sapiens
aaagtgttgggattaaaggggtgagccactgcgcctggccaacactatcctgttttaagaaccaggtttgtggtcagacctcggatctggttgctaattattttgggctcttgttcaaaatcctggtttataaaatttgatggatgtgtgtttaataaactagcactaagtgttgaagtggaaatctctttttta

SEQ ID NO: 636287 - DNA, 887 bp, Homo sapiens
gactccccatcttcaatcgcatctctgtttctgagtgacaaagtgactgcccggtcagatcagctggatctcagcggggagccacgtctcttgcactgtggtctctgcatggaccccagggctgtggggacttggggggacagtaaatcaaagtaatcccccttttttccagaaattgcatttaaaccccaattccccttgaacctcacgcttggggccaggtccccaaagtgtgcaagctcagtattcatgatggtgggggaaaacacaaatggtagcatatttcaagggaggcaatgaaccctctcccccaactcttccctgcccaaatctggtctcctagaatcttatgtgctgtgaactaataggccttcactgcccctccagtttttatagacctgaggttccagtgtctcctgggtaacttggaacctctcctgaggggggaatcctgggtgctcaaattaccctcacaaaagcaagtagccaaagtcgttgccaagagcccagccataaattcagtggggcccctttcatttcatgacgactttacttattctaatactgacttttcatacgtatttcatactatattgaggtcgtcctgggcttcacctggtaatttaactttcctttttcgataatacttgacacaccgaccgattattacataactgattaaaggcaggacctaattaatataatttaggtaaatcgttcttactcattaagcctttaacaaacgtcgtattgaacggtggtatgggggcaagtttttgtaaagtaaagcaatcttggagttgccgaataaaagaaaataacagaaaaggaaaagaaaaggtgtgttgtggcgacgctgtggatacggaaagaaaatgttgatgtgc

SEQ ID NO: 636288 - DNA, 728 bp, Homo sapiens
  misc_feature (33)..(33): n is a, c, g, or t
  misc_feature (64)..(64): n is a, c, g, or t
  misc_feature (102)..(102): n is a, c, g, or t
  misc_feature (113)..(113): n is a, c, g, or t
  misc_feature (151)..(152): n is a, c, g, or t
  misc_feature (164)..(164): n is a, c, g, or t
  misc_feature (169)..(169): n is a, c, g, or t
  misc_feature (187)..(187): n is a, c, g, or t
  misc_feature (192)..(192): n is a, c, g, or t
  misc_feature (197)..(197): n is a, c, g, or t
  misc_feature (210)..(210): n is a, c, g, or t
  misc_feature (218)..(218): n is a, c, g, or t
  misc_feature (225)..(225): n is a, c, g, or t
  misc_feature (235)..(235): n is a, c, g, or t
  misc_feature (294)..(294): n is a, c, g, or t
  misc_feature (334)..(334): n is a, c, g, or t
  misc_feature (340)..(340): n is a, c, g, or t
  misc_feature (360)..(360): n is a, c, g, or t
  misc_feature (413)..(413): n is a, c, g, or t
  misc_feature (416)..(416): n is a, c, g, or t
  misc_feature (551)..(551): n is a, c, g, or t
  misc_feature (627)..(627): n is a, c, g, or t
  misc_feature (644)..(644): n is a, c, g, or t
  misc_feature (659)..(659): n is a, c, g, or t
  misc_feature (661)..(661): n is a, c, g, or t
  misc_feature (666)..(666): n is a, c, g, or t
  misc_feature (680)..(680): n is a, c, g, or t
ggccccctgggtgggcctgatccccaatttcanccttcccccgggcatagggcccaggccaggncgctcacccgaatgttgctgggactccttgtgccctangcccacggggnggaggcagccccaacattggggatggtcccccaagatnntatgaggaagcncagcntccggcaggtagtttttntatcnacgcncacctgctcaggnctgctgcntccaganctctagcganaggtctccagagccggccaccaccaggttgccctcagcacagaccctattgagcccatngtcatgcctccgggtgcaaatggtccttggtgggtctgtnggtttntgcacccggatggtcttgtnagtggatgtggtgtacaaggctcccacggagtactggatcccagtaaaggganttntgtggcccacatcaaaggaccggataagctggaagcagccgttgcggttggcgaagacgtgcagcaggccctggttgttaccagcccagagctggggttcctggtaggacatgcagagcaggtaggagttcagcngcagacgctgcaggacgctgttggctcggcggtccaccaccaccagggtgtggtcctcgctgcctgagaagatgtnccggtcatccgccagcngggtcagcacgggtntngagtntagttgccggtgcntcaacagggctgggccggctctggggtcgtagatggtcaccttcttgt

SEQ ID NO: 636289 - DNA, 615 bp, Homo sapiens
cccctcggacacatttttttttcgaactgaagcctcctgtttccggagaaatgtttgagacctccctgacctgttccaagaagaccccgggctaaccaataacctcttgaaatcccgctttcgagaaaagacatccactgctgccctccttttgagggttgccaaggccagcacggggtttcgcctgtctaaacacttcacgagatttgcccccaggagctttatacggcgatccgggggatacacacaagataccggggtaacagctacaggtccgtgacatgacgaactccggggggcctaccctgtgagtttcaccatttacagccctgttgggtgtgagccgctccatcagatgatggattcagggcgaaaaccaggctgattgggagtgctaatctagagcggtttggacattggccccattgacgacctgcctgatgccttgtaccaaaagaaaggggctttctttcagtgattttttgcttattggctgggttgcgggagcctggattctctaaaagaaggggctattcgaacccttttgactttacaacccactttttgaaaattttgtgcaaggccaaagtgggtgtcctttcctacaaacactct

SEQ ID NO: 636290 - DNA, 308 bp, Homo sapiens
gcgataagatgcgctggcgatggtgacggttcctaacgaacagaccaactggtccttgtagtcacgacttaacaccggttaccacctgtgtggagaacaatacagctcacgtggtgataatcgcagacgatgtgaatcccatctagctggttttcttcttgcctgccccttgttgaatttttatctccccaaaactgcattatcaagggaaaggcaagactgggacgtctagtccacaggaagacctgcaccactgtcgccttcacacaggtgaactcggaagacaaaggcatttggcccttatcgag

SEQ ID NO: 636291 - DNA, 159 bp, Homo sapiens
cggtacccagaatattctggggacaaaacggaaaaaccagtctccagcagctccccgattccctccatcagttttcggtgtccccggctccgagctcatccactgctcctgcgacgtcgccggccgccgctccggagcccccctccttgccgccggcac

SEQ ID NO: 636292 - DNA, 315 bp, Homo sapiens
  misc_feature (21)..(21): n is a, c, g, or t
  misc_feature (31)..(31): n is a, c, g, or t
  misc_feature (62)..(62): n is a, c, g, or t
  misc_feature (114)..(114): n is a, c, g, or t
  misc_feature (203)..(203): n is a, c, g, or t
  misc_feature (207)..(207): n is a, c, g, or t
  misc_feature (238)..(238): n is a, c, g, or t
atagatgtacatatagatcantgggattganctgagagttcagaaagaagtgcatatatttntgtttaaccgattcttgatgagggtgccaaaacaattcaatgggggaaagantagtctttaaaacaaatggtaccacacaaatggatatccacaatgcaatataatgaagctagatttctacttcacaccgtatacaaaantttnctcaaaatagattaaagactagatgtaaaangtaaaactattaacctcttagaataaacctaggtgtaaatcttcatgaccttgtatgagacaataatagttttttaa

SEQ ID NO: 636293 - DNA, 135 bp, Homo sapiens
  misc_feature (59)..(59): n is a, c, g, or t
  misc_feature (75)..(75): n is a, c, g, or t
gtatatgtatcgccaacacttgcgttatgaatgatagttgcttgagatgagaacactanttggcagtgtgaaccntttctgcactacttgtatccactggactcaggataagtccaagaagggactacactgttt

SEQ ID NO: 636294 - DNA, 404 bp, Homo sapiens
gtcagttcctttgtggaggccaccagtcttggccaactcaacattgggctccagtcccacaactgccactatgtggtcagtatctggggtcctttcgactttcaacttgatcacgcacttgccactgctgactccaacggattgcacaatatcattgggcatcaccttaaccccctctcgtctgactttttccatggtccatttgctgaggtattcaggaggatcttttccatatttcctttctcggggaagagtcgaaatacttctgtgcccaaagctcgagcctttctgccaagagcacaggccagttcgctaccaatgaagcccccaccgataattctttctgatttgacttcccgtgaaatcttcttcaagcttttaaaatctccaatctttctgaaaag

SEQ ID NO: 636295 - DNA, 244 bp, Homo sapiens
cgtgaggactagaatatgctgtcatcactacagcaggcagtatattgaactagggcggaaatgcgataaaatagtacagagtgtgcacacgggctatcattgatccaggtgactctgacatcatgagacgcatgccagaacagactggtgaaaagtcaaccttttcacctacaaaatttcacctgcaaaccttagacctgcaaaggtggtcctttaataaaatatgcttgttagcgcgtgctgt

SEQ ID NO: 636296 - DNA, 776 bp, Homo sapiens
ctcctcgtctcagtagcttgcttcgtgggtcggtccctcgcgacacacgagctccaagccgctcctctcttttcctgaagcccttcaaggcggtcttcggtttccttctttccagccgatcctcttcagccctgtgaagatggtggaccgcgagcaactggtgcagaaagcccggctggccgagcaggcggagcgctacgacgatatggccgcggccatgaagaacgtgaccgagctgaacgaaccactgtccaatgaggaacggaacctcctgtcggtggcctacaagaacgtggtgggggctcgccgctcctcctggagggtcatcagcagcatcgagcagaagacgtctgcggacggcaacgagaagaagatcgagatggtccgagcctaccgggagaagatcgagaaggagctggaggccgtgtgccaggacgtgctgagcctgctggacaactacctgatcaagaactgcagcgagacccagtacgagagcaaggtgttctacctgaagatgaaaggggactattaccgttacctggcagaagtggccaccggggagaagagggcgaccgtggtggagtcgtctgagaaggcctacagcgaagcccacgagatcagcaaggagcacatgcagccaaccaccccatccggctgagactggcgctcaaatactcggttttctactatgagatccagaaaagccccgggggcaagggtgccactgggcaaaaccgcttgaaaaagccatgcgagtcgacatctggagggaccaa

SEQ ID NO: 636297 - DNA, 246 bp, Homo sapiens
cttgcattgcttccgggcggatttagaggaacccccgtaggccgctagaggcccagttctccaacaggatgtacacgaacctgctgagagagatagagtacatgggcaaagagatccgtcctacctatgctgacagcaagagcgccatggagctcctgaagagaggtatcattcatgctcaggccctaggcagagagtgcctggcagagacagagcggaacgcccgcacgtaacaggaagcgcctc

SEQ ID NO: 636298 - DNA, 537 bp, Homo sapiens
cgcagtggctcacgcctgtaatcccagcactttgggaggccgaggcggtcggatcacgaggtcaggagatcgagaccatcccggctaacactgtgaaaccccgtctctactccaaaagaaaaaagaaaaaacaacaacaaagaaaaaacaacacgtgtggcgggcgcgcgcccgcgggccccgcgggaaaagctttccagaaacacacaacgcgcgggggcgcgcgcgcgcggggccccgaagaagggaaaggggaacaggggcgaaatacgggcggggcatccctataggagagaaccgcggggaaagagagaaacaaagggggcggggaggaatcctcaacccattataacaaaaccgcccgcggggggggaaaacagcgggagcgggttagcggaaaaaaaacaccaagagagagagagagagcatctctgagaggggatccaataaggggggaatatctattacaaaggcgggggcccaagagcgcggaaccgcggaacactcataaaattagcgacccgccgcgcgggggac

SEQ ID NO: 636299 - DNA, 212 bp, Homo sapiens
cttttttttttggccctttttaaggaaatttctttaacccgggggcgggcccggggttttttgcccggttttcctttttggccttttcccccggttttcccgttggttttgggggggcccccccacgggggggttttttttttcccccgtcctcccctttccccctgggttttggggggaaaaaaaagggtcttttcccttttttttgccca

SEQ ID NO: 636300 - DNA, 156 bp, Homo sapiens
ctatttctaccaaaaatacaaaaattagccagcatggtggtgcatgcctgtaatcccagctcctcgggaggccgaggcaggagaatcgcttgaacccaggaggcggagcttaaatacagagtagttattaaaggcaactgatttgtacactgaaca

SEQ ID NO: 636301 - DNA, 676 bp, Homo sapiens
tctggtgatataggcttctcatatgattcaattacaggtacttgcttgctactacgggaatttccatctcctccgataaggagaccatgaaaggctgctggaggtgactgtgtgtacataaaggggacgggctgcaccaccaccggctggatgacgggcaggatccccgggcctccgtattccagtgccgcgagagggcagcgtgccatcacgtgggtggcatggacagcggcacgccgaagggctgcacgccgtggagaaggggggtgagtattttttaatcgggtgggctggaaaaaggcatgctcaacccaggcgaggctctccgggtgtgaggacgggaactctcagagaggagggcagaattcccagcctgaagggggtgaactccgctggtcaccgtgaggtccacgggctccatctgtattccgtgcgacagaccttcgggggtctgaaagaacttctcaggcaagggtgtggagtaagatgaccccatactggtaaggcttcagggatcccatggtaataagaggggtaatgacactgaaacggggtccagggcctctggctggacaggaacggggtcaaacattgagcatttctttaagtaaaaccttcatagggggaccggggtgtagggcttggcaaggcgcggatgcagggcgccgcgacgaac

SEQ ID NO: 636302 - DNA, 530 bp, Homo sapiens
  misc_feature (20)..(20): n is a, c, g, or t
  misc_feature (57)..(57): n is a, c, g, or t
  misc_feature (138)..(138): n is a, c, g, or t
  misc_feature (148)..(148): n is a, c, g, or t
  misc_feature (180)..(180): n is a, c, g, or t
tgcaagtggcgtgattcttngctcactgcaatttcccacctccggggttcaaagcanttctcctgcctcggcctcccaggtggctggcattacaggtgcatgccaccacatccagctaatttttgtatttttggccancatggtgaancccagtctctactaaaactacaaaaaaatttngccgggtgtggtggcgaacacctgtaatcccagctactgggcagaggttgcagtgaaccgagatcacgcctctgcactccagcctgggcaacggagcaagactctgccttttaaaaagacacacacatgcacacacatttgtaaaacgaagacaataattagtacccacttcctagggttgttttgaggattaaaagagttaatatatacataataaatcttttaagacagttcctggtcatttaaagacttagcattagccattattattaatatttagaaatagagtccagcccaggtggcagaatgagaccctatctctctctctctctctccctttgaaaaaaaaa

SEQ ID NO: 636303 - DNA, 816 bp, Homo sapiens
tcgacagaagcgagactccgttcctaacataaataaactattagatctgaaatgtgttgatcggaacacaggccgatgtgaatcattctactacacagatattcatgtacaccactgcccattgagtagacataacacaaggagaccttaagcatattacctaacataacatcacgagggtagctagaacataagaggcagagttattccatcactcaaaataacatcaggctccacccgtggggacaactaaactttttttgttgtaaaaacactctacccatagagttaactacagtgggggccctttaccccgtgttaagaaaaaggcctccgtgacccctagttggagccaaaatacaaatattgtgggccaaacgttgagggaactaaaatcactgttcatctttttaggaagatggcttgggtgagtagtaactggtttatggttatggtttacagcttgccctaatttattagtaagaagaaaaaccaaggctattttggaagagctacaaatatgcttcatacaaaatataatgatctagaataatggctgattaataaataaacccgcattatatgtggttatactcactgatactactttctatgcatatcagtgaagtgtatgtgctcttttaaaaaccttccaagatacaatatttaaaggtcttccagaaaactcattcctgatacaatagtattttgcttgcagcaattaaaataatcctgtttctccaagaacagaaaaccggaacaatggagtgtctctctggtaaggtgggagtacaccaattgaaacccgtggccatg

SEQ ID NO: 636304 - DNA, 714 bp, Homo sapiens
gcagtgatgtagagctggcagtgcctgatggcgcgttgacgcggagttgggtggggtagagagtagtggggcggtagtcgtggtggtggtgggacgaaggagtgaggctggcgaatcacttgataaatggatgccgacagcaggcagccgcaagcctcaaattccacggagggtgagcgcagtgctgtgctcttcatgggcctacttctttcatgaagccacagtgtgctccaggttgccactaaaggcacacaacaagtgaacatcacttcatcacattacagtcggttggcaataaagcatctgggactgcattgggttcctggacgatgccgcagtacgtccatatacggtggaacacgcagatttcgcacgacacacagcggagacagttcaagcaaatgcccaatcaaagagcacgtatgcaagaggggacacatgatgcagcagtggcgctgcccccagtgacaagaagaccatcgtggtcatgcaaacagaaaaaatgttgaagctgacacaacgacaaagcgaaacaacacgagaaaaagaagcttgaggaacatgtgaagaatgggtggacagagtagacaggtgaagcagccacataaggacttcacgtcgagaagaaaaagggaacacgggtgtagagtagtacatgtttgaaacatgagggaagaggattcatgaaacagaagatgaaaggtcagaagatac

SEQ ID NO: 636305 - DNA, 426 bp, Homo sapiens
  misc_feature (24)..(24): n is a, c, g, or t
  misc_feature (80)..(80): n is a, c, g, or t
  misc_feature (111)..(111): n is a, c, g, or t
  misc_feature (203)..(203): n is a, c, g, or t
  misc_feature (298)..(298): n is a, c, g, or t
aagggccaaaaaaacaccaagganaccacacaatggaaaaaagagaaacaaagagagaaggtgaaaaacaaaagcaaccnccgggcaaagagaaggagaattgaacagcanaattttgaagatcgtggtaaaggcaggcagtcatagagatatgtgttagtcacaggagtcaaaacttatgaaagaggtttaacatgaatggnacattagagattgggggcagaaatttaaaaccaaaggactgctttttgaaacctcaaattatagaatgcatcctaggaaagagctttagagtgtnagttgtggaaacattaaaataattctgaattaattaatctgatatgttggaatctggatcttgaaaaatttgtttccttgaaacaggcatgcatttaaaaataaagcttaaacaactgtatgcaaacc

SEQ ID NO: 636306 - DNA, 366 bp, Homo sapiens
acatgtgtgacttcacttgcagtgctgcctaccccgcagtctcgaccccgctaacgccaccctctcaaaatccggcaaacacattccggcccgaggtccacctgctgccgccgccgtcggatgagctggccctgaccgagctgttgacgctcacgtgccttgcacgcggcttcagccccaaggacgtgctggttcgctggctgtcggggtcccaggagctgccccttgagatgtaccttacttgcggatcccgtctggtgcccagccagggtcatcaccaccttcgctgtgaaccggcatgctgcgcgtgctcatctgaggaccatcgtcggggtatcctctacagtatacctgtggcatgtaagc

SEQ ID NO: 636307 - DNA, 442 bp, Homo sapiens
  misc_feature (410)..(410): n is a, c, g, or t
  misc_feature (426)..(426): n is a, c, g, or t
caggtacaacagctatacgatgctgcgcaggctcgcgagctggacagctccgctctcaacgcctaggagatcactcagttgcgccctaagccccgccattgcggggctgtgtcagtagaggcacgcgggatcggccttagtgcatggggagtaaaaccagtatgggaagtaatgaaaacttggaatctcgcgagagccgtatcgagaagcttgaaagtgtgcaccgaatttcgctactcggaattgtggtttttgtggctcttacagtggtcggcattgtatttgccggggatctttcagtcagtcgaatagccgttggaatcatcggtgtcacgtttgtaatggcattcgcagttcaacggcagagagttggatcgctattaaaggcggtacaccatgagccatctgancgcagatagaccgganaagagcatgaaaattt

SEQ ID NO: 636308 - DNA, 698 bp, Homo sapiens
tgagcggggcccttcgggagcgtctgaggaggcgcggtgccgctgcgggctcgggcgccgctagcgcgccggcccgagcccctggacgaggcccacggagctcgctcgccccgaaccagccggccgatgtgctcaaccatggagcgcagctcgggggcggcggctgtgaagcatacgcggcgctgtgggcgcggcgagtaggggcccgggcggcacgcggtggcgggaatggggctgactgctcatgatcctggcgtcgcgccgcgcctgggttcctttcctcacgctcctcgccccagttctttcctgcctgtaccgcaacaacagcccgagccgcacgtcggacgaggcccgtcccggcgcgacgccgacgggcgcttcccgacttaccatcaaccgccagtcgccccgcgcccctgactccctacagcgcgaactcacgctcttacttgcgctcggacgcgccagccgaattgcaccgacgccccctacccgtgaaacctggggcaccgacccttgaacggcggcgggacacgtcatgtactccccctcacatccccgtcggcgtcccacaccccacagaactactacactttccccccctgtccaccactgtgccggtcatctgcacactttgtccttactgtacacccacacacctccctcccggagacacagcatactgcgctctgcaaccc

SEQ ID NO: 636309 - DNA, 1036 bp, Homo sapiens
cttcaaagctccacatcagtccttccaatatgactaaccagaacacgaaatgagtacctggagcaagatcaaacagcgactgtattgagaacctataggaatgcgtgccgcaacgacacctggcgagtccaacactgcacgcgcgatatacctgagagacgctcataccactggagtgaggagtagagcgatcgacggacgaacgacgatctcctagacaaggcgcattctacgatactgcgtccatctgtaccacaagcgacactttgccatgatgagcgacagacgattctaccggacttcctgactacgacggaagcggacgacgcggcgtgcagccagccaataggacaccttccgtttttcccaaaagcttatcaccacacacaacaggcccagagaaagaaggtccacacagagcaagcagcgaactgtattcaacacggaggcaaaaacggaccccccaggcaaggcggtaacggacaatgcaaactacggaacaaggtttccaacaccggcacaatctccaaggcgcaaggctccaccgaccgccccgaaatagcggcacgcggacaacgcacaaacgtaccccaagcgccaccagggccaccgcacaagaaggcgcgacgatcaccccaacaagacgagacaagccgccaaaccgggattaccaacacaacgcgcatccaaggcggagctcacctctagagacacaactttgacgtacaaaactaccgatttaccattaagacccaaaagagcgctctcaccttaggacggcctattaataatcgccctataggcacctatggacaaggacgtttcagcaccacataatctcaaacaccgccattctaacaaaccactaatataccaccacaccacaaaatactcccccacaacccaatttccatactacacaacctagctcaccataccccttacacctttctgtatctacccataaacgtacactacacccctattcatctatgcacaacccataaacttatccccacaactatacctatcaccc

SEQ ID NO: 636310 - DNA, 465 bp, Homo sapiens
tatacccaattaaatctcatggacttgtctatattgccagagtgaattgtttattataatttggtggaaacagtcctggtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctagacttactgcacag

SEQ ID NO: 636311 - DNA, 241 bp, Homo sapiens
taaagcgccagaagaaattataggcgaggctgagatttaaaaggagagctccaaaatggaggcttggaccaggggcagcccaggagcttatcaaaatccaattgaataatcaaaggggggagcctggccaaaatgtttacttgtctgtaggtagccttgtcagatgatatgcaaatgattccccccagtgtttgaagttcaaaccaaggaaaactatcagaaaaggcttttgcttttttta

SEQ ID NO: 636312 - DNA, 231 bp, Homo sapiens
  misc_feature (156)..(156): n is a, c, g, or t
gcatgtatggaacaagctggaggagcaggatctagcctccacagtccactccaggctcatgaaggggaacaagcgtgaggagcaggggctgggccgcgaactgtggcgccctaggagcccatggtggaggaggaggccctgatcgagttccagcgntcctacggagagctcttcggaggttcttcgtgcaagaaaaaccatcaatccagggcggccatccggcctgggtgt

SEQ ID NO: 636313 - DNA, 365 bp, Homo sapiens
  misc_feature (344)..(344): n is a, c, g, or t
accacgcgtccgcgggacgcgtggttttcttggcatcaaagaaagtgatccttccaagctgcagcacaatactaccatctgtcggagtgataccgtaatggagaaacggacatttagggtgcctctgggaaagggaagacgctgtgtcgtttgaggagatgtattctatgagtggcagcgatgtcagggaacaacacagagggagacatacttcatctattccccacaactcaagacagagaagtcaggtagcattggcgctgcagatagccctgagaactgggagaaagtctggcaacaactggaggctgctgacaatcgccttcttcttttgactgctgggngcccccagagggaggagatgt

SEQ ID NO: 636314 - DNA, 316 bp, Homo sapiens
tcggaccttcgttatacgttgtgagtcagactcctggctgtatcactggctcatacacgttgattgcacgtacacggaacttatattcgtaggtcaggcagcaggtccttggacgttgaaagaggtgctgcggatgtggtagtacccttccacgtcttgttggctgagtcccagatctcgatgctgtaggactgtacagcactgcccccatcatatgaggagccataccaggacagggtcagtgaggagctccgaatgtcagaggcacaaggtgtgccagctggggggtctggcttatccacgacagtgaggttga

SEQ ID NO: 636315 - DNA, 700 bp, Homo sapiens
  misc_feature (1)..(1): n is a, c, g, or t
  misc_feature (479)..(479): n is a, c, g, or t
  misc_feature (514)..(514): n is a, c, g, or t
ngattgtgcaccggtatctctcagacaccagacgtcagagagagagcaggttgtaaaatatgtcttagacctaaaagggtatgtggttcttagttgattgtctcctggatctgggaaggaaggaaagaaaacaaagaggaaatggggttctttatagaacgtggatttttcctacaagagactttgcagggcaatttcaaggtatggcaaggaaatatatttttgggtaaaacattttgattttcttcttgttatgccagagtctgattggaaagtaagtcttgatatacagggttaaataaaacccatctgatgagaatttatggtttgtagggcataactccctaagccccttagataggaatttcagcaagataaaaaattagagcttaggccaggcacagtggctcatgcctataatcccagccctttgggaggctgaggcaggtggatcatgaggtcaggagtttgagaccatnctggctaacatgatgaaacccctgtctctactaanaatttgaaaaattagccacgcattggaagtgcctgcctgatagccccagctactgggtgaaggcctcaacacgggaagaatgatttgaaacctggaagtccggaggtttgcaggggaggtccaagaatcaatcccatttgcactgaaaccctggggcaaacagggccaattccgcgtcttacgggg

SEQ ID NO: 636316 - DNA, 149 bp, Homo sapiens
tttttccttttctccctccgggtctctttttgactccctccccctttatgctcgcccagcctccccctgctgctgagaagtgggggagggtctcggctccaggttcccgccccaccggggccgggcgagcatggggggcaagcagagca

SEQ ID NO: 636317 - DNA, 1701 bp, Homo sapiens
gggaatctcgagaatggagttttaggaggaaatagtcgaactagtctaagctagtgagggaaatgtggcttaagtacaactgtagaattctccctgcagcgtctagtaggcttgtctccatgcttgagagagggagtaagtgaggtgatgggagtgagactgtcttactggggatctctctcattgagaatgagacgtgaacaggagacaactattctcacggatcaacgtcttcatcaatgggcctggacccatgtacctgggggaactctgcgggactgcatgacacacttgggaagcttacgtaaagcatacctttttctcatgccgatatgctatgcaaaacgcaacatagttgcacttcgtttctgatcaatgcacatacgccgaggcatgccgtcctttagaccaggaatcccgaggagatttgcatccagtgcaacctagttagcatccattgtgggattgccactggaagtggttccaccgattagcattggaactgacaggtttgaggacggccaattccaatgtacatgggacacaagccaaacaagggcactgaacaccttacgtcccccacggcgggtggctactctactaaataaggagtacattgcattgggcaatgccaagggttggccggtttacaattggaataggcggtccttcacacacaattacgtttctgtaacgggaatgtacttggcttccaagagggagagaatgaattatggagggggtggagcaaaacagttgagtatagagtgggaacattaaacctacttgatgggttatgtgacaatccgttttcacgcagagttgtactatggtgtgaattatgacaaccggatattgaggaggaccaatcattgtgtaaccaaataaaacgagggtatggtgtgtgtggatgatgaaacatgttgactcgactagccagtcgtgattttgcctgtggatgggaaaacctgggctcttgccgagactggatagacatagtgtggcttgccatgaataggatatccaatcgccgtgtcctggactcgcatgtcctacgcagcatgctagagcatagaagtgcgcagccacctgcttgccacaacacaaacccacggccatgagcactgtatacacatagctatacttattcaccatgtaacacagagtcgtacacataccagcgatacagcgcgccattcctaccacagatgtgatactagacacgacacgaggcggtgtagtacaagcagcacgaaaccaaacctacgaccgaggcacacgcgagcatcataacaaaatgactcaacaacagacaagacgcaggcagctagcacacaagcgaagcagcaaaaacaacatcacaaccactcgacacacgaacgactcaacacaaagggggcactatcatatagaacacacaagacaagcgagacacaccgaccgctacggcggagacgattaacccacgggaggacatcgacacagaagcagcacacagtagcaacgatagagacgacgaccaccagactagaccaagaatgacatcacacgtcgcgcatcacaagtccacagcatcgagatgaacagacgacaaccagagacagagaaagaaacaagacgaaagaagacaagcactgagcacgcacgtagcagcacactcagagcaccacgacacgaccaaggcagacacagaaagacgcc

SEQ ID NO: 636318 - DNA, 328 bp, Homo sapiens
tggaaacttcccggggcgggtcaggaccagggtagggccatggtaaggcctgaagaagggaagggccaggcagcggctggaccagagaagggtcagggccaggatgtagtaggactaggggcagagccagcactagggctgagccagggcagagcaggagagattacattaggctattatgtaaaatttttattttagatttttaagataactatagtagtagtaatgtctatactatgttgtttgtaatagtaataatatttgcagtaatcactaaattttaactaatactgtctttgtttccagtagtgttctatgagtataattt

SEQ ID NO: 636319 - DNA, 283 bp, Homo sapiens
cattgttgacttgcttggaccaatcattgatatgtcatcttcagtcttacagaaaaaccccacagcgatggacgggcacgctccgagatgtcatcaggcacgcggggtgctggcagtggaagctctcgtcctgggatgaagcagccatcagtgggctccacggctggctgcgtgttgtgagggtcaggtagataagctcctcaacaacgtagccgatgaagtagtgggcgctgttaggcttccctccgatgacgcccagggactgggggatcattgaagcagt

SEQ ID NO: 636320 - DNA, 561 bp, Homo sapiens
actacaagtcaaatggaggtcggctttggatgctgggaaagactggcttccactgggggggacattgcaatcagcgcacagttagtggaccacggatataacactcatcgtttcagaaagccaccggccagacaccaatatgggctgaaggttcggagaagggacgttggaagaccctggcacattttaagggcatctgaatttactacagtgaagtgatctaagacagcaaaggcagctgctaaggggtaaacacaggagaaaaggctcacgatagccaaacggcaggaataactccaagtaatcatcaagggtgcccaaatagagtcccatatattttgccaggatgactggtccatataaggtagcatcagggtcggcctgtaaagccggcaccgttcctcttcagcggcacaccaggcttccttgggagccaataaggaagaaaggattccataatggggttgaggatcggggaggtaattaggagaggggccaagctcgggcgcaaaagcttcatatctttcaagacaaagggcatatagaagagtgaggcaaagc

SEQ ID NO: 636321 - DNA, 114 bp, Homo sapiens
  misc_feature (1)..(1): n is a, c, g, or t
nagatccccttattcgatattccgatgtgggcggctatttattatcggtggcgtcttttatggttttaccgttgttgcctggagcatcctcaggaagacctaaatgtgaccatt

SEQ ID NO: 636322 - DNA, 380 bp, Homo sapiens
  misc_feature (120)..(120): n is a, c, g, or t
gtacttagaggatcctgtgtaggctggtcaggatgccacctgccttcccctgtcagctggaagatgctgtgtcgagcagctaccctttgctgtgatatctgcaggactgggcaccatggnccaaaaatttgtgtccaggaaagaggcgagaagtgcaacctgcatttcactttgtggtcaggccgcgtctttgtgctgtgactgcatcacctttatggagtgtagacattggcatttatgtacaatttaataggtgtcttattttattttaccttcaaaaacaaaaacgccatccaaaaccaaggaagtccttggtgtactccacaagtggttgacatttgactgcttgttccaattatgcatggaaagtcttcgggtcg

SEQ ID NO: 636323 - DNA, 158 bp, Homo sapiens
ctgtcgctctagaggatccgtgatacaccctacccaccctatacaccaaagacattgctgacttcaagaagcccttctttggtactacgcggcatgttacaacatagttatgtgtacctgctgtataatcaacgtgtactatttacgactattaattt

SEQ ID NO: 636324 - DNA, 634 bp, Homo sapiens
  misc_feature (223)..(223): n is a, c, g, or t
  misc_feature (420)..(420): n is a, c, g, or t
  misc_feature (634)..(634): n is a, c, g, or t
ccaggtggttgaagcttaaaaagactacatgacaaggacctgagggaaccaggattcctccctcctaccagatgacacagacaagagttcctggagaatgggagtgctaagactttcgacttctttgtaagttgtgtactgctttggagagtgaatgctgtcaagagttcctcagattacaaacagcagtggtgccatttgcttccccatcttcatgttacanacctggaaaggctagaacagacattaggcgtcagcatcttgacttttccccagcatcacatacagacatttgctcgggcaccaaagtaggttccctgtgttaggacaattacactggccatgccataatggtgaataaaactctcttcttatgaggttctctcttaacttctttggattagtaaaagctgacatgtngtctctagctattagaatcccatacatagtgtattagttttcgagcagcgtttcaagtatctctggcattaagacatgagtcatcttaatgtggggatgggtggcaaaactttgcccattgagatattggtttgctttaaaaacaagcctgcctaatattatcctttccgaagtgtgggctttggcggagaccttaatacggtaacaaaaatan

SEQ ID NO: 636325 - DNA, 359 bp, Homo sapiens
cacgcgtaataactgtaataataatatcagctataacaaagccatgggccgggcgcgaatggcttacgcctgtaacccgagcactttgggaggccaaggtgggaggatcacttaaagccactgcactccagcctgggtgacagcagcaagactccgtctcaaaaaaaaaagtactctttttggataaattcttagaattgacatttctggacgaacattgagtgactactcattctgctttgccaaggctgaggggttcctcaggacacaggtcttccagtgctaaaactggtgaaattccccggcaaaccaggacatcactctacacttatttcagcgtctgacgggcatcctctaga

SEQ ID NO: 636326 - DNA, 404 bp, Homo sapiens
tggagtgaggccacagcatgacaatcgtttaactgattcaaacccaccaggtgagcttggccaaaagggacatggtgggagagaaagaaacaaagaaaaccatgtaagcctgcaggcaattcccgccaattctactctaggagcaaaagccccgagtggagttctagtatttgggatgcttttctttcatactaggttggtgcagaagtaattgccacctttaatggcaaaaaccgtgattacttttgtaccaacctaaatataacatgagctctaaatggaagcaactacttcagtgaggctcagcccagccacagtaaccgcagggctcctcctcgtggccagaagctgaaatgacggcagtggtgccgcctggtgaatgaattggttctgtgacccggaaa

SEQ ID NO: 636327 - DNA, 310 bp, Homo sapiens
aactcctcctctgaggcatcaggcttgagggctggtccatggtacgaagtcctcctccagctgtctgctcggtctacggcacctcagccctctcctccgagcgctcccagtctccttccaggatcaccagctatcctgaccacctcttcatatttgcggtctgaatcctcagcgatgtgctatggctccttcagctgcatctcctgcaagttccatcttctcctcataccttcatgggccggttttcgatgaccttcattcctctctcgctctcatcagacgccttctcggcctcctccagcttctgcag

SEQ ID NO: 636328 - DNA, 295 bp, Homo sapiens
ccttcccagtagctgggactacaggcgcccgccaccatgcccggctaattttttgtatttttagtagagacggggtttcaccgtggtctcgatctcctgacctcgtgatccgtccgcctcggcctcccaaagtgctgggattacaggcatgagccactgcgcccagcacaatgtgggaagctaatggacaagcagtttagcaatgttacataaatattaaagagtagcagtacgtataggttataaactcaagacacaccttctaacatcaattatatttgtatgctgatagcat

SEQ ID NO: 636329 - DNA, 379 bp, Homo sapiens
cagctctcccttctagcgtcgctggacttccggtctgtgggctgtgtcttcatgtcttgactcaccttctgccgttacgacacgacctcctaccctttttacgcactgtccgttgcctttttcccctctcgacctttctgtttgctccttttacgttctttccctctttctgttccctttctctgctcacacttctgccttccttctccgtgtactcttgacactttctttgacggttccttcaaaccacgcactttttgaccttctctgtctgacacggtccactacctcttttcctctggacttggttcctggtgtcttacttcttcctttgttgcggtcttgttttcctggactggtcttggtgcttgtggctgtt

SEQ ID NO: 636330 - DNA, 677 bp, Homo sapiens
  misc_feature (20)..(20): n is a, c, g, or t
  misc_feature (66)..(66): n is a, c, g, or t
  misc_feature (91)..(91): n is a, c, g, or t
  misc_feature (113)..(113): n is a, c, g, or t
  misc_feature (119)..(119): n is a, c, g, or t
  misc_feature (125)..(126): n is a, c, g, or t
  misc_feature (141)..(141): n is a, c, g, or t
  misc_feature (148)..(149): n is a, c, g, or t
  misc_feature (152)..(152): n is a, c, g, or t
  misc_feature (169)..(169): n is a, c, g, or t
  misc_feature (171)..(171): n is a, c, g, or t
  misc_feature (180)..(180): n is a, c, g, or t
  misc_feature (189)..(189): n is a, c, g, or t
  misc_feature (206)..(206): n is a, c, g, or t
  misc_feature (210)..(210): n is a, c, g, or t
  misc_feature (212)..(212): n is a, c, g, or t
  misc_feature (216)..(216): n is a, c, g, or t
  misc_feature (218)..(218): n is a, c, g, or t
  misc_feature (236)..(236): n is a, c, g, or t
  misc_feature (243)..(244): n is a, c, g, or t
  misc_feature (248)..(249): n is a, c, g, or t
  misc_feature (251)..(254): n is a, c, g, or t
  misc_feature (263)..(263): n is a, c, g, or t
  misc_feature (290)..(290): n is a, c, g, or t
  misc_feature (301)..(301): n is a, c, g, or t
  misc_feature (376)..(376): n is a, c, g, or t
  misc_feature (384)..(384): n is a, c, g, or t
  misc_feature (417)..(417): n is a, c, g, or t
  misc_feature (427)..(427): n is a, c, g, or t
  misc_feature (458)..(458): n is a, c, g, or t
  misc_feature (470)..(470): n is a, c, g, or t
  misc_feature (496)..(496): n is a, c, g, or t
  misc_feature (539)..(540): n is a, c, g, or t
  misc_feature (552)..(552): n is a, c, g, or t
  misc_feature (672)..(672): n is a, c, g, or t
attatatatttacagaaganaagcatgcatatcattaaacaaataaaatattttttatcacaacanagtacatatttgttatttttaaaangctacataatagatacaagttntcaagntatttnnttattttgttgtttnctgttanntanctaaacattcatcattngnggtgcaatngtcataganataagtgcctgagacantagngngggngngtgagggattggcaccanagagatnngggnntnnnngcggcagcncctgcattcatatgtatgggtcctggngtgggcaatcnccattattccacaaagattgcaaacatgaacctgaaatggatctgatgcctcaaacaatctttcccttaaaaacngggctgcnccatgggcaatctgacaatctcgtcccattccnccaaaacccnggccaccatcacgagacccaccctccatggnctgtctatcgangatctgaataggtcccctagcacganactcaattttatcatccaccaaatgcttcaaacgctggtaacnngccgggccaatnaatatttgtcaggtgatttttcgaccagtaaacccattgtacaggacctcatttcctctgagatgatagccataatcagaaaaaagattagaaatcttctgcacgttaacagcatcattnaatgg

SEQ ID NO: 636331 - DNA, 140 bp, Homo sapiens
ctcatttttgtgtttttagtagagacttggtttcaccatgtttgccaagctgtctttgacttcttgccttaagcaattccattccgcagcttccaaagttttgggttcaggcgttcactttcacccgcaaattttttctt

SEQ ID NO: 636332 - DNA, 1457 bp, Homo sapiens
  misc_feature (1138)..(1138): n is a, c, g, or t
aattccgaagtgtgctgcacaggatgtggctactgtgtcatgcgtacaggtcgattaagagtatcttcccatgccagtgaggtggagattacacggggaaggcattcaagtgtgcctgaccgaggtacaagaaggctagtgctgtagcaacgacaccgtatgtgtacatcgtcgtagagacgaaggaccctatgataatgcttcgtaagcttgagttattggaataaaacccatgtgccgtttttcagagtggcactaatcaagttccatgataatcgtattgacatgggcccaagtcgaatggctgtcgtctcaatggcacttgatgggatcacctgatttcggctgtgatgagcgttcacttgtgcccaggagagtgagacatctcctgtagaggcagaaagagaggattccgtcgaagcaaatgccatggggggtaattccactgagttggtatccaacttacaccggcacgttatcaccctttgaccacaattaccaaagggaaccaatatgaaggacgcttgggacactaggcgtttggtgctgggggacatggcggttagctacagattccccaatgacctcacaatcccaaagggaacgccttgttgtggattttggccatttcccggagccaggccaagggacttcttttacctggaacttcgcaaaggagagggaaagattaggcgccagggcatggcattattccaaggcgttagacacaccagagggataccattttaaacggcctgaggttgggtggcacttcttcatcccgtcataaggcaatgacagcacagaatgtgcctttgaacttagcgcttaacttttctgttaacatatgtactcccctcattgtacgtagaggaaaaggtgttgaacatttcacaccggagaatcaatcttcggctttgtgaagggcggttttcactagggacctccgggtttaccaacgcgatgcacatttatcaaagactgaaagtggtaaaatctgcaaaatgtttggtccgacatgcggacagacatttttgtgaccaggactcttctccagaacgaaaacacgtttccatggccactgataggagttgaggggcgttacaacacacgaaattgccccaccggcgtattcatnaaagtttgagcaccgaagcaaatttgcccccccaagaatttgtgttgtagcaccgcaaattgcaagatggggtaaacaactcctcacttttacacagggcggttacaacatccactgggtgtggttcagcaattccatagtgggagcaatggtcgagagtcgccggacaaaggttagtatcggacctaggtagtgggcgaccccccttgggtatagcacattcaaccgctgggattgtgccagagattgagccctaggcgagtcctcttggctcttctgactatgggcagaacctttacgtactaagcaggacatccgt

SEQ ID NO: 636333 - DNA, 134 bp, Homo sapiens
tcgataagggcccacgtggtacaacctgtttctactaaaatcacataaattagccaggtgtggatggtgggtgccatgtatgtcccagcctactcgaggagcgctgagagcagtgataatcactctgagactcg

SEQ ID NO: 636334 - DNA, 174 bp, Homo sapiens
gcgtacacccctccttaggcacctggtggtcccccgctcgcgggaggtcacctgattgatgccgaaattagtgcggacacccgatcggcatgcgcactacagcccagaactcctgggctcaagcgatcctcccacctcagcctcccgagtagctggaaggcagaggcagggcgt

SEQ ID NO: 636335 - DNA, 570 bp, Homo sapiens
tgagcggcagctgtgctgctcagagatctccgactgtcccagacgggctggtgtgggcttgggatcctcctggtgacctctcccgctaaggtccctcagcgcactctgacccgaagaatgggccgtggtgtgctggccgtgatgtacttcaccatgaccgccaccacgagtcagagaatggtgggcgtgcaagaagaaacagaaggcagaaggcactggatgagctgaccgaccgaggtggcaaatggagtgaccacaagctgtccttggatgagctgggccgtaaattcccaagatggacctgtccaaagagccttcatacaacacaggcgtggctcagcgacatttctgggctcgaagcatgggcccaaacagccctcaacaccaactcgccacaaacccacttgacatgggtcacaagttctagcctgtccaaggtgtctacaggggaggttctcccctccattgctccgtggaatcagccgagatataccatcatgatttcccagagccctacagagaatccaaaggcctgccaatgggaaggattgacaccgtcgcagcgcacac

SEQ ID NO: 636336 - DNA, 231 bp, Homo sapiens
tggtagcttctctttgtagatagctaataaaatcacttaattcagggccaccttcatatttcttgggattaagcttctatgtgggctgggagagaagtatatggtaggaaaacctctgacttcatatggagaaggcacatcattggctgggggattcaatttgggtattacaaaattttgggtcctaaggcaggagattctcgccaatgttcttaatactaggggctccag

SEQ ID NO: 636337 - DNA, 1117 bp, Homo sapiens
gtttttcacatataaccatcccgcatattagagttccttgatttcgtgaaagttctcgctccttccattggccctggcaaccatgtatggacactcacggtaccgttttgtgaaaatgttgggtcccccaggtgcatatatcggttcagacataaacatgtggctaaaaggtggaagcgtgtaaaatagaagtgtgattaataagagggggtcgaaggcccatttcaaggagggtgtgttatgccataactaaatgggtgtaaattcgtcttcagtgaacacgcaccagagatttccgcctttttctaagattccaggaaatgttccacaatctcgttagtcatgcgaacccaggaatgctccgatggattcttagaaagatgaacctaaagtgggcacaggtcgggacttggtagtacaagcaagttcttcaaactctggcgggccaaatattctggcccctcactagaggaacattctggggcaatgtttcggagacatttctttggtccatttatacctttgtgcggggttttgagggttaacgttgaggatagtgtgtgctacttggcaatcccagtaaattagaagccacgcgggtagcctgctaaacatcctattaatgcacagggcagtaccccagcaacgacaaataatcgggcccaatatgtcagattgtactgagtttgagaaaccccagcgataatggaaccctaggtgtctgggctctggaactgggactttgtcccttcgtaatgatgtatctctttccagcctcattcagctattcttactgacataccagtctttagctggtgctatggtctgttctattagtgtacgtagttctcgtatgcgcccgtcaaaagcgcatctatggttcgaaagtcgctaactcgcccaaggtgatggcatataagaagtgggcctttgggaagtgattagatccaggagtgcagagccctcatgattaggattagtgcctttattgaaaaaggcccacagagagtctaactcacccgttccatccatatgaggacgtggtaagaagatgacatgtatgagaaccgttaaacagctgtcgccaaacaccgatattactcctggctgatctgac

SEQ ID NO: 636338 - DNA, 206 bp, Homo sapiens
aacgaagggaggataccggatcaggagagaaagggtaggtgagccgaacgggggagtatactctacaaacgaacaagagagatggaaacgagtataccgtataataacggcgcatgagctggaagtcctaggcacagctcaaagcctccttatcacgaaccgagctggggccagccatggcaacctctctaggtaacgaccacatc

SEQ ID NO: 636339 - DNA, 108 bp, Homo sapiens
agaggattcttcacacgccgagggacatactgcacacgccgaaacccactccccaccccaaatcttagtggacgaagttgttgccggtctctattgacgaagttgttg

SEQ ID NO: 636340 - DNA, 466 bp, Homo sapiens
gccacactcctctcagccatgtcgatgcttcagttatgtcagcgaatggagagacagtaaggaaagacaagaatatgctgaattattaggaacagttcagccactaaagccgagcgaaaagggatgagtgaggtccccacaaacctggcggaatactgcatcaaaactaaaaggttgccttcccaatgacaacagctcagatttgctttacgacggacttgtatgatgacgacattgatgatgaagatgagggaggaggaagatgccggactgttatgatgatgatgattctgggaaatgagggagtcgtgacgtgctccttcagtgcccctgtactggccttccatctcagggcaaaaggaggggagcaaggtggggacctggccattggcccctcagcaaaaaagctatttcacaagcgtgattggggattacagtacggggtaccggaggctcgaaatatcgt

SEQ ID NO: 636341 - DNA, 296 bp, Homo sapiens
tatctcactggtgatgagtgaatcatggttagcatggcgaatttgagacatcattgatgaactacagagctagggaacaatcgtagagaacctcacaggcaggctaaacaagtgtggggtagatcagacccagatttgacgtgcaactcaacgatctggcacactggcagactaatctgcttccatcccgtctattatggctctcatcgtactgacaaactcagctggcatcatggaccatgaagaagcaagacgaaaacacacaggagggaacatcctgggattctttttccagc

SEQ ID NO: 636342 - DNA, 159 bp, Homo sapiens
ccaaccacgtcataatcctttttcctagctatcaccaccaaagtcgttagcgcgtccttccttcttcctagcttcctctcaccaaatgcgcagtggtctccgtggactctctttacctatctctcaccgacgatacgtgctgcgttgcgtcggcattgc

SEQ ID NO: 636343 - DNA, 513 bp, Homo sapiens
tagctatgggatgaacaggataacccgtgaccaattccagaagtatggcccaagcggttgatccggccttcatgatgggccgacttcccatccatgttctgaccttactccaaccaatgttctgtttggatgtccttgttttttaaaaaaccaaacttttttttgaaccggcccttacttttgtcaaccccttgtggtgcaccgacagttgcattaagccgttttttaagggtttaaaaggacttctgcacttaaaccgcttttttagaccaaaaaacggtttttttttgaaatcttaattggaccttaaaaagggaaggaattaaaaaaatccggggcccaagggaattggaaacactttttaaaaatccggtaaacattttggggttggcgggggttggcaagtacttaaaataaaatcctccaaaaaaaagattgtgttagaaagaattcacaaaccggttttggggaaaaacccaatttaccaaattaattgggggtggcaaattggcg

SEQ ID NO: 636344 - DNA, 383 bp, Homo sapiens
  misc_feature (126)..(126): n is a, c, g, or t
  misc_feature (156)..(156): n is a, c, g, or t
  misc_feature (251)..(251): n is a, c, g, or t
ttgagatggagtctcgctctgtcacccaggctggagtgcagtggctgatcccagctcactgtaacctccacctcctgggttcaagccattctcctgcctcagcctcctgagtaggaatagttgganttacaggcgaccgcagccatgcccggtttntacttttagtagagacagggttttgtcgtgttgatcaggctggtctcgaactcctgacctcaggtgatcccccactgccttggcctcccaaagtnctgggattacaggcgtgacacgcgcgccccgcctaaagagcctgcatttttaacaaaaggaacatgtgattttggaccccatactggaaaaagacatttggaagggacaagtaatttgtttttaaaaattac

SEQ ID NO: 636345 - DNA, 396 bp, Homo sapiens
tgccttcaactgagatcataccccttccttccagcctggggggcagagccagactctgtctccaaaaaaaaaaaaaggaaaactctgtgatgggcctttgtttagtaaatcccttcaggatttatccctcctttccccccagcagctttctttcctgtcaactagaaaggagcaggatgtaataaataccttttggggtggctaggcccccccaacttttaatcatctccccttttccttagacatttaaatttcaaggcagggaccctctggggactcagaaatttgaagaagttatttggttttcccaaatgccccctgcggggtattgatttgttctttacaactattgttttcatatttctccccctaaataaatctctatgagagcttcca

SEQ ID NO: 636346 - DNA, 112 bp, Homo sapiens
agttcgacggagactctctaaaatgatatgctttccactggagagtgcacccatatcattttagagagggctgagggagaagctctactattgttcttacgtgaaacatcac

SEQ ID NO: 636347 - DNA, 365 bp, Homo sapiens
aggaggcctcctggggtttccccagggcagtaggtcaaaagacctcatcacagttttccttcctcttcaagcgtttcatgttgaacacagctctctccactcccttgtgatttttgaggggtcacccctgccagcctcaggcaacataaaaagcctcctgttctttttatgcttggtttgactgagcctaaagttgaaaaaatgggtggccaaggccagtgccagtgttttggggcccctttggctttccctcactttttgaggctccagctggtcctgggacatgcagccaggactgtgagtttgggcacgtccaaggcctgccccttcaaaaagtggaataaatgtggcctttgcttttgtta

SEQ ID NO: 636348 - DNA, 359 bp, Homo sapiens
tccccaaagctcaggcacccagtgtgtttcgtcataccgctgatgcccagctatgtaaccaccagacctgccaatgactgcagccagcatcctcaactatcagaacaattcttttagaagaagaacccacctaactgttgcggctgcaagaaagaacataccatgtgccgctgtgtcaccaaacagctccaaatgtgcgagaaacacagtggcagatgttgatgagaaagcaagtgctgcactttatgacttttctgtgccttcctcagagacggtcatctgcaggtctcagccagcccctgtgtcacccacaacagaagtcagtgtaggtctctcaacctgaagtatctgcagggagg

SEQ ID NO: 636349 - DNA, 114 bp, Homo sapiens
tgcctcatgtaacgggagagcagcacacacgtctggggcctctgcgcaaggggatgagcagccacacttcgggtccccagtgtaaggggagctcagcagcacaccctctggggc

SEQ ID NO: 636350 - DNA, 110 bp, Homo sapiens
tcgacattgctctgctagtacattcgtgtgggctctgagcagagctgtgacagctaccagacacaggcctccctgtgggtctgtcccaatgctgaagctggtctctccgc

SEQ ID NO: 636351 - DNA, 172 bp, Homo sapiens
  misc_feature (140)..(140): n is a, c, g, or t
gataacacatacgagtccataggacactaaacatgtctcagctgtgtgagatagactttacagcagcggtgcagtgtgcaggctgtatccagcacttggcagcagagcaggcgatcctttgagctcaggcacatagcaanaccccctcctagcccaccccacccgtcgtgtg

SEQ ID NO: 636352 - DNA, 421 bp, Homo sapiens
agtcactgtacagagcagttgtgactacaggtgcgatccaccacacctgtgtaagtctttgtatgatacgttgagacagggtttcactgtgttagacaggacgtccattctctcctgagctcacacctggagagtgagagatttgtgaggctacaggcatgacaactggttgcgtgcgagagctcaagaccagcctgggtaacacagagggaacctgtcattgaagaaatcgctgcttgagtaaataaatgctgcttgaggggcacctgtgactgctgaaatggccacttagttgttgaacgactggatgacttgcaaagaatcgtaggcgagtttcattacacctctgagcgtatctgaccaccatgagttgggttattttatcaagatctagactcaccgacagacacacctgttcacc

SEQ ID NO: 636353 - DNA, 91 bp, Homo sapiens
gcagtgactccggggcgagcgccgcgagtccgcagtagttcgggccatggacggctgggagcctgcgctctacccgatggcggggtgctgc

SEQ ID NO: 636354 - DNA, 1043 bp, Homo sapiens
tgcttccctgatatttgatggacgtccctgaactgttgacctgatcatgaattccagaccaacctggtgctctatccccgcatccacttccctctggccatatatgcccctgctgatctctgctgatgaaagcctatcatgaacagcttactgtagcagagatcactcattgcttgctttgagccagcaagcagatggtgaaatgtgatcctcggcatgctaaatacatggattgctgcctgtatataccgagttgaccgtgcgattcccaaagatgtcaatgcatgccatatgacaccatcaaaaccaaagcagtaccactccaagtgacgtaggactttgagtcgtccccatatgtgacttctacggtatgtgcaattaatataccacgaccatcccactgtgcgtgcctgtccgtgggatctgggcacaaagggtacaagagagctgtgtgacttgctgagcattaataccatcgagctagttccgcctgtaagtgcactcggggctccgcctggtacctacgaggcgtttcgaccttgattgttttagccaatggcgtctccttctcgttcacttgagtcacatgggtagaggggatggccgaatggcccgttatctcaggaattcccctgaggcactttggctgaccttgtacaaagcgattaattcctgagcgtttggcagccatatacgggttgcctgtgaactaggatgacgctaattcaattctcctcccttgtggtgcgcgtccttctagcctccatagtcatggaactgtcctataagtgtatcgtcttactgtctatttgccgtactggtattctacatcgttgctgcgttttaatcaagcctacgatatgggggctcgtagtaaagtttcctgggggccaccttccggttccacggggttgccagggccccgggggccataaaacgaacccggcgctaaaagccgaggggaacagtggagcgtgggacccttcgggacacgggcccagacacggaaataactagtacgccatttattgtcaatgcgccga

SEQ ID NO: 636355 - DNA, 760 bp, Homo sapiens
  misc_feature (15)..(15): n is a, c, g, or t
  misc_feature (176)..(176): n is a, c, g, or t
  misc_feature (189)..(189): n is a, c, g, or t
  misc_feature (210)..(210): n is a, c, g, or t
  misc_feature (214)..(214): n is a, c, g, or t
  misc_feature (227)..(227): n is a, c, g, or t
  misc_feature (231)..(231): n is a, c, g, or t
  misc_feature (254)..(255): n is a, c, g, or t
  misc_feature (278)..(278): n is a, c, g, or t
  misc_feature (291)..(291): n is a, c, g, or t
  misc_feature (304)..(304): n is a, c, g, or t
  misc_feature (308)..(308): n is a, c, g, or t
  misc_feature (317)..(317): n is a, c, g, or t
  misc_feature (320)..(320): n is a, c, g, or t
  misc_feature (322)..(322): n is a, c, g, or t
  misc_feature (386)..(386): n is a, c, g, or t
  misc_feature (479)..(479): n is a, c, g, or t
  misc_feature (525)..(525): n is a, c, g, or t
  misc_feature (531)..(531): n is a, c, g, or t
  misc_feature (538)..(538): n is a, c, g, or t
  misc_feature (591)..(591): n is a, c, g, or t
  misc_feature (638)..(638): n is a, c, g, or t
cgcccagttcctgtnccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgctgnggagcggtactcnggcctccaagccactgaatgnggcngccctgcatcgcnggcngcctgcacatgaccgtggagacnngccgtcctcattgagacccccgncaccctgggtgcngaggtgcagtggnccanctgcaacanctncnccacccaggaccatgcggcggctgccattgccaaggctggcattccggtgtatgcctggaaggncgaaacggacgaggagtacctgtggtgcattgagcagaccctgtacttcaaggacgggccccctcaacatgattctggacgacgggggcgacntcaccaacctcatccacaccaagtacccccacccccccccaggcancccacncaccccngaggagaccacgactggggcccacaacccctacaacatgatggccaacgggancctcaacgtccctcccatcaatgccaatgactccctcaccaacaccnaccctgacaacctctacccctcccgggagtccctcatagatggcatcaagcgggccacagatgtgatgattgccggcaaggtagcggtggtagcaggctatggtgatgtgggcaagggctgt

SEQ ID NO: 636356 - DNA, 107 bp, Homo sapiens
gctgtagtaccagcaactcgggaggcagaggcgggacaatggacagaacccgggagaagagcagcagtgagccgagatagcgtcagcgcactccagccagggcgaca

SEQ ID NO: 636357 - DNA, 822 bp, Homo sapiens
  misc_feature (15)..(15): n is a, c, g, or t
  misc_feature (176)..(176): n is a, c, g, or t
  misc_feature (189)..(189): n is a, c, g, or t
  misc_feature (210)..(210): n is a, c, g, or t
  misc_feature (214)..(214): n is a, c, g, or t
  misc_feature (353)..(353): n is a, c, g, or t
  misc_feature (366)..(366): n is a, c, g, or t
  misc_feature (370)..(370): n is a, c, g, or t
  misc_feature (379)..(379): n is a, c, g, or t
  misc_feature (382)..(382): n is a, c, g, or t
  misc_feature (384)..(384): n is a, c, g, or t
  misc_feature (448)..(448): n is a, c, g, or t
  misc_feature (541)..(541): n is a, c, g, or t
  misc_feature (587)..(587): n is a, c, g, or t
  misc_feature (593)..(593): n is a, c, g, or t
  misc_feature (600)..(600): n is a, c, g, or t
  misc_feature (653)..(653): n is a, c, g, or t
  misc_feature (700)..(700): n is a, c, g, or t
cgcccagttcctgtnccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgctgnggagcggtactcnggcctccaagccactgaatgnggcngccctgcaattcagcctagcggctgccccatgcaaacaaattgaacccgggcttgggaacgaaaccgggggccaggtccccattccaaattcttgaacgggaacccccccctttccgggttcaaccccccctgggtgcngaggtgcagtggnccanctgcaacanctncnccacccaggaccatgcggcggctgccattgccaaggctggcattccggtgtatgcctggaaggncgaaacggacgaggagtacctgtggtgcattgagcagaccctgtacttcaaggacgggccccctcaacatgattctggacgacgggggcgacntcaccaacctcatccacaccaagtacccccacccccccccaggcancccacncaccccngaggagaccacgactggggcccacaacccctacaacatgatggccaacgggancctcaacgtccctcccatcaatgccaatgactccctcaccaacaccnaccctgacaacctctacccctcccgggagtccctcatagatggcatcaagcgggccacagatgtgatgattgccggcaaggtagcggtggtagcaggctatggtgatgtgggcaagggctgt

SEQ ID NO: 636358 - DNA, 184 bp, Homo sapiens
cacgaggctggtgggagcggagggagggagccgagagatccgtgtgcacgtgtggatacacggagggacaagcgcggcggcgggagacactcgcgcccccaccagactcaagtcctcactcgactctcacggtcttcgttgctcgcatagttccctgtccaggctatgaggtcggcttgcgggg

SEQ ID NO: 636359 - DNA, 519 bp, Homo sapiens
gactacatctgtgaattctgtgctcgatctttccgcactagcagcaaccttgtcatccacagacgaatccacacaggagagaaacccctgcagtgtgagatatgtggatttacttgccggcagaaggctccctaaactggcaccgacgcaagcatgcagagacagcagctgccctgcgattcccctgtgaattctgtggcaaacgctttgagaagccagacagtgtggtagctcactgtagcaaaagccacccagccctgctcccagcacaagaccacctggtctttggtgtctagtcccagcatttctgcccctgaatccctgcagtctcctgagggggctagcatctctaccacttctgactctaatcctgcctcctcaacatccatttcttcacctggggtgccagaccccaggaacagagagaaaagttaggtgagtgcagtggagggtagagcaccattgggctccagataccaggttttagccttcaaagaaataataaatggtattttatac

SEQ ID NO: 636360 - DNA, 1212 bp, Homo sapiens
  misc_feature (58)..(58): n is a, c, g, or t
  misc_feature (93)..(93): n is a, c, g, or t
  misc_feature (256)..(256): n is a, c, g, or t
  misc_feature (700)..(700): n is a, c, g, or t
  misc_feature (945)..(945): n is a, c, g, or t
ccaagttggtatgaattgggtggtattaggtgtgtgcaagtcccaccagggcaagggncggagctggtcgtgccaatcataattgtactatangtgtgggcccagactggcgtgtcgtagatgcgggcagagactaactgagcatctgatcttaccgatgtagggactcgcttcttgttgtctaaggaagtatgtatcgtccgtgcgtgctggccgacctagagtgaggttggtgcgagcgaagagaggagcgtanatgacgtcgtgtgttgcggtccagtagactaactgacaaactgaccgtgcgaccaccatcgaagtatgagggaccgcccactcacttccttcgtgttaggtgtatcatcaccaaccgccacaaccaatattgtgttgtcgtcaacagcgccacaaattagccactccccccttcttgtagtaagaccgttttttctacacaccaccggtggcgccaacaacacgtctcaaatttttttctacaatatatcgtcgtcggccctctcatcgacgggaagctactttgtatcaacagatcgtctcgtctccatatgttatcttctgattttctgtgcgctctatggcgcaacacactctctcttcacactactctctggacacacgctcacagctctcacacaggagtgtcgggacagtctcagttatagacactctctttgctctnccaaagagagacacttctcacacacattctgtgacactctctccactctaagtgagacagttgttgtgtgaaaggaccatgtgttgagcactagacacactctgcgctatacactctctgccgctgtacaccaccccagcagtagtgtacacacctctctctgtgggagagaacactcttctctgtgtgtggtatgagtagacacacagaggtgtgtgtctctgtgtgaatctcagcagagagantcgcacttcttcctattcttatacacggagacttccacacacatatctatgtgcaccacgccctattatacttccctttaacacaattttatccaccacacacacccactaggggcccacactcacccccccaccacttacccacacactttaaccctccacattcacccgcgggaaacaccctcaaggtctaaacccctatccccccttttcctcctatcctcctcacaccccgacatccattaccgggttttccttctttaaata

SEQ ID NO: 636361 - DNA, 438 bp, Homo sapiens
ttggtccagaccaggaaaaatagtagctccagaactttatattgctgtaggaatatctggagccattcaacatttagctgggatgaaggacagcaagacaatcgtggctattaacaaagatccagaagctccaattttccaggtggcagattatggaatagttgcagatttatttaaggtggttcctgaaatgacagaaatactgaagaaaaaataagtcaaaatcatatcttaaggaaactgttgaaagtattcagctgaaatcatagaaattcataatctgaagaaagaaattatgctaacagcagctagaatgccttttgatgaatcaattattatattcctttttaattttttgtggtttcaaacaattattttttgacattttctaattctgaaataaaaaacataataaagttttgtcatcctttaagatta

SEQ ID NO: 636362 - DNA, 81 bp, Homo sapiens
aggaaccgccgcaggagggaggcgcccaaggtggtggaggagcaggagtccagggtgcactacaccgtgtgcatctggcgg

SEQ ID NO: 636363 - DNA, 501 bp, Homo sapiens
tacgctgtgaggggtgataaaaaggcataaggctgggcgcaaaggctacacacactgaaaaccaaaaactttgggaaagactaaggagtgaggatcaactagaggtcaggagttggagaccagtctagccaacatggggaaaccctatctttactaaaagtacaaaaatgggccgggcttggtggtgcacgcctgtagacccagttactggggagtctgagacatgagaatcccttgaagctggaaggcagaggttgcagtgagcaaagattgtgccactgcactccaccctgggcaacatagtgagactctgtctcaaaaaataaaaatagcaaagttctctaggcccagtccaagcccagcgacagcctggggtattcttgaatctagtccctctcctccatgaattcattctgtacacgagggaaaaggaggagtcccttggaagactctgtccttgactctttggtttaggcctggcttttgcggctttctgaaatt

SEQ ID NO: 636364 - DNA, 594 bp, Homo sapiens
cctcagtggccagtgtgggcgtgggcggtttggggcgcttggctggtggtggccactgcatcccttaatttatttctctgctgtttctgttcttgagaaattgggggtgggagtcctacacagaggctgcccctaccctcacctgagtgtacattttttgtgatgggttttattttttattattttattttattttttttttttttgggatttatgatgacttccaccccttcgttcatcaccccggcttcccgaggccaggctcagcagatataacgccggagccctggcgtcctaggaagggggcctggcaacctcagccctcttggccccacactcctactggcgggctcagaccaggggctccccctccctcctttcccccctcttggccctagtggaacatgcccggggtgctctgagggggctgcggagggcatggctgggttcccaaggggggtagggcgcccggggcacccaggcaaggtgggcccctcccggtatagccccttcttcccaaagcctgcactatagttctcctcgtgatcaaacactgtaatacagagcatggtcggaatctgaaaaaacaaaaga

SEQ ID NO: 636365 - DNA, 486 bp, Homo sapiens
taacctgggccggcatcttggacttctaggttcagcaattctcgtgccttactcctgagtagctgggatttcaggcgtgcaccaccacgccctggctaattttttgtatttttagtagaggtagggtttcactatgttggctaggttggtctcgaactcctgacctcaagtgatccgcccgcctccgctacccaaagtgctgggattacaggcatgagccacgaccacgcccagcctgtcttttgaaaagtgtctgttcatgttttttgtctacttttcaatggggttgtttgatttttttttttttaacagtaaagtggaagcaagtttattacgaaagtaaaggaataaaagaatggctacaccacagaacagctaggtggtttgttttttacttgtaattttaagttccttatagattctggattttagacctttgttgggtgcgcagtttgctttttttttcttccatctgcaggatgtttg

SEQ ID NO: 636366 - DNA, 115 bp, Homo sapiens
aacctggccccaatttgtggacacagcgcaaaagccaatttaaatcagaatatgatatcaaagtgcataattacattcgggactgccagcaggttaaagtcttaagtctttaacc

SEQ ID NO: 636367 - DNA, 683 bp, Homo sapiens
  misc_feature (520)..(520): n is a, c, g, or t
  misc_feature (563)..(563): n is a, c, g, or t
  misc_feature (574)..(574): n is a, c, g, or t
  misc_feature (625)..(625): n is a, c, g, or t
  misc_feature (650)..(650): n is a, c, g, or t
ggcaatgcctcgccctgcttcagctcacgcacggtgcgctgcacccactgtcctgcacccactgtctggcactccccagtgagatgaacctggtacctcagttggaaatgcagaaatcacccgtcttctgccttgctcacgctgggagctgtagactggagctgttcttgttcggccatcttggctccacccaatcctacactttctacaaggctgaatggatgcactttctcttttagatcatgttccttcttaaaagtgtatttttgagtgtacatactttgatagcccagctttgccattcaggcacagactattccatctaataataagataaaattgatatttctgtgcagatactggatatttttgctgacttttgcaaattagcttttttcttttgccctgctaacttcacgtattacttctagtagttgttttttgtattttctataattgttatgtaagcaatcatataatctgaaaatagagacagttttacttctttctttcttatttntatgaacttacatattcttttttcaaggtagcccttgatattntacatctttgnaggcggatgtagagatgcactttcacctattacgttgtagaatcaggttgntgactttccaccccttaacagtatngcattttcaaatcatgaacacagtatctgactt

SEQ ID NO: 636368 - DNA, 430 bp, Homo sapiens
ataacccagcggccgctgtgattttcaatgtgaaacctatgtttcacacttgtgacaacttgttaggtctcataaaaggccacatcattgagcaggtctggtgagtgcctttacatgctgattgcgttcttattggtacacaaccaagacgatgtttgttgcaggatctaggtttccctaccaatctcggtagactgccctgccatgccccatctatatctgccacctgttgtgtatagccacccgaggtaaaaactacttggggatccgtgcacgttaacgattactaggaccatgcagaaaccagagagtttaagaataccgcattggaccctattctcgatagttcccctgctctagttctaggtcccagtacttgatctagatcatggttattttacagcctactttagttccattttctctcctt

SEQ ID NO: 636369 - DNA, 260 bp, Homo sapiens
ggaaatcgatagagtgttgtaaggattattgtgtcagttttctaaggctgctgtaacaaatcgccacaaacttggtgggttataaaaaaaaaaactcaaccttcacagttcttggagggcagcagtacccaatcaaggtgttggtaggggcacaacctctaggtcccccaccttttttgcaccagggacaatttttccattggaccgggaaggggggattgttttgggatgattttggcacattacatatactgtgcact

SEQ ID NO: 636370 - DNA, 152 bp, Homo sapiens
gccggtaccttgactatgtcctgggtcgtccaagagcaataattgttcacatgacaggtcaagtcacctccagagtgtataactaatgtaacccaagagtgggcgaatcgcatggcggttgttgcaagcatctgtctgagaaccaaggtaac

SEQ ID NO: 636371 - DNA, 514 bp, Homo sapiens
ccagaaactttaattctgttataatctcctgcgtgttccatgattaaaagatttatggtctcagttactgattgcagcaattaaaagacaggacatgaaagtgaaaacatttggttctgtggaagctgcttagagacctaatgacgcagagtaggagagagcttttcttttttttttttttttttttttttgagagtgtctcactctgttgcctaggctggagtgcagtggcacgatcttggctcactgcagccccgcctcctgagttcaagcgattcttctgcctcagcctcctgaggtgggagaattgcctaaggccaggagttcaggaccagtctaggccacgtagcaagaccctgactgtacaaaatttagctgcatgtggtggtgtgtgcctatcatcccagctacccaggaggctgaggcaggaggatcacttgagcccaggatatgaggctgcagtgagctatgatcatatgattgcattccagcccagttgataaaaccctgtctt

SEQ ID NO: 636372 - DNA, 404 bp, Homo sapiens
cctcgtgcagcaatcagtaacacgaggcattctcataaaacactagggcaccctgtgcaatcactaacacgaggcattcgtcataaaacactagagcaccctgcgcaatcactaacacgaggcattctcataaaacactagagcaccctgcgcaatcactaacacgaggcattctcataacacactagagcaccctgcgcaatcactaacacgaggcattctcataacacactagagcaccctgcgcaatcactaacacgaggcattctcataaaacactagagcaccctgcgcaatcactaacacaagtcgttctcataaaacactagagcaccctgcgcaatcactaacacaaggccaagatcttataaaacactagagcaccctgcacaatcactaacaca

SEQ ID NO: 636373 - DNA, 195 bp, Homo sapiens
aaaatagaaaggagtatatggattaaacagcatctaactaataacccgcaaaagaccaaaatacagacgataacacatcaatatctattctgtagggatgacgtataaagagcattatgcactcagattttaatccaactaatacctaatagaacaactcataattaaagacaaggaattagacaggggtggtgg

SEQ ID NO: 636374 - DNA, 226 bp, Homo sapiens
aaaatgttactgaactattgactgaagtaaatttagataaaatacagcttttttccttatgggcatttgtttggtgtcaggtcatcataactaggtatggcattgctatccgtggatacagacgctagctcttaaaggattttgttttatgtaactgtgatattggaatgtcactcacctcatggtctgtctatctcatgtctcaggaaaccatgctccagtatcg

SEQ ID NO: 636375 - DNA, 119 bp, Homo sapiens
ttagggtggcatttggtttatttgttgtggtggcaatcagtggtagtagggagtgggagggcttatatttggtttttccagactataaagtgggacatatgtgtgtcgattgttgcttt

SEQ ID NO: 636376 - DNA, 798 bp, Homo sapiens
  misc_feature (26)..(26): n is a, c, g, or t
  misc_feature (82)..(82): n is a, c, g, or t
  misc_feature (87)..(87): n is a, c, g, or t
  misc_feature (108)..(108): n is a, c, g, or t
  misc_feature (118)..(118): n is a, c, g, or t
  misc_feature (121)..(121): n is a, c, g, or t
  misc_feature (127)..(127): n is a, c, g, or t
  misc_feature (140)..(140): n is a, c, g, or t
  misc_feature (165)..(165): n is a, c, g, or t
  misc_feature (170)..(173): n is a, c, g, or t
  misc_feature (292)..(292): n is a, c, g, or t
  misc_feature (297)..(297): n is a, c, g, or t
  misc_feature (345)..(345): n is a, c, g, or t
  misc_feature (362)..(362): n is a, c, g, or t
  misc_feature (374)..(375): n is a, c, g, or t
  misc_feature (387)..(387): n is a, c, g, or t
  misc_feature (391)..(391): n is a, c, g, or t
  misc_feature (397)..(397): n is a, c, g, or t
  misc_feature (408)..(408): n is a, c, g, or t
  misc_feature (415)..(416): n is a, c, g, or t
  misc_feature (431)..(431): n is a, c, g, or t
  misc_feature (435)..(435): n is a, c, g, or t
  misc_feature (440)..(440): n is a, c, g, or t
  misc_feature (442)..(443): n is a, c, g, or t
  misc_feature (445)..(445): n is a, c, g, or t
  misc_feature (621)..(621): n is a, c, g, or t
  misc_feature (687)..(689): n is a, c, g, or t
  misc_feature (751)..(751): n is a, c, g, or t
aagttcagaaatttctgtaagacaangtacattaatgaaatgtttccaaagaaatactgaacaatatatactctagtttgcngacgntccagcctcaagagcttcaancctaattctngtncaatanaaatcagcatggntcttagatgatctagaatacactgngtttnnnnatccacagctggtttcatttttaaccattatgaaaaaccagtactcctattccatcaaatgtgttttataagcaataataaattcagatccactgtattatgcaacatacatctttggnaagcnacataaacagtgagatcagatcagtagaaatatacacagttaaaaganatacacaaagtactgtngttttattaaannctactacttganacanacatcnttccacaaatngcataannctgtagaatgatgantggntttgngnnanctttacagaagcttaattccaattgtatcttcctgagggtggtggcaaagggtatttccttccttctctgggatatccctgtctccctccacgatcatctcgtctgggtggatacccaccaggcccagctagcatctggtactggtttggctggaaggctgcattctgggtttgcngcatccggttccatgggagcagaggttcagccccaacgcctctgtcaaacctttgctgccggcccnnnggaggaggactcgccaggaatcctgggggctcatatttgacataagttttggaatctgggcntgtctctcaaaagcggcctgtataagtttcctggtaagtcacaggtg

SEQ ID NO: 636377 - DNA, 114 bp, Homo sapiens
ccgccatagcccgggtttagattgttatcccgaaagacaattaacagcccaatatctacaaaaaatcccaaacatataactgaactcctcacacccaattggcccttatccgag

SEQ ID NO: 636378 - DNA, 1051 bp, Homo sapiens
gtggcacatgcctgtaatcccagctactcaggaggctgaggcaggataattgcttgaacccgggaggtggaggttgcagtgagccgagatcatgccactgcactccagcctgggcaacagagtgagactttgtctcaaaaaaaaaaaaaaaaaaaaaaaaatttgggggatgaaattacccaaaatgaaattcgcttagaaaacctccgccaagcgggaagcctcccttttctcacccttttggttcccctttgccgattaaaattcagccacatatttagcaaacagttgaaagaaggtctcgtgtttaaaacatgtgattgacagcagtccttaactattgtttttcgaggggtgacacttatttagattggaagagaggcttgcatttgggcagacgtgatttgctataggaagacccaatttgtgttatgatagcttcatccctgtgcggggaaaatgctttcgacattatacgcctctttacccacagactgggccattcatagttgaacagggtgggtaacacctttggggcttgcccaagaaacatttatatcggttccccctttaccttaggaggggaaagattacccgggtcatccaacagttctgtatgtaagctattttacatttgctcacccaagccatattccgtcggggaaaacaccaagttgctatctaactctgacaaagggtttatcacggcttcagggctgacacaaaattgggatgggtgatcctatgtgcattggggaggagcccttggcttaattccagatgcggcttgaaatcaagtaggggggctcgaaaagggtgcccgatttctcgcatatttcaggggccccactgtgaaggcgggttgggaatcatacctgggctaaatgagtgtattcagcctgtgtcacgtgtactggaacggtcggaatcttagagtgtccggtggatttcagacacttcttgaagtcatacgaaagacatgtcgagcgcaacagggggatgcggacgttacacagagtatgaggaacacttgggccagtgtggtatatgc

SEQ ID NO: 636379 - DNA, 765 bp, Homo sapiens
  misc_feature (737)..(737): n is a, c, g, or t
agtctgcctccaatagtaggaattttcaggtcaatgcgaaatgcctcggtatgagctgttagatatatcttgtaatatcttcaggcttatttgaccaaatagtatagctggttcacactgttcacatcagacataataggtatcaaagcaaataggcattagagatgatagaggatcatcagcacagtgggtaaaaggttcagttcagatataggtacatattatagtaaagcaaagaagtatcacagaatacatataaggataaataattcagatatttaaagatacttaggttaagtgaaagttttataagtgcttgtaatacaaatcagaaacatggtgagacatcaggagaaatcatttttgagcaacaaagtacctaagagggctgcatggacaaggaaaacttttccctccctaagcccataccttctagcttgactaatcgtgttcccatccccaggtcccagcaaacattctaagacgctagaacaggtttactgggaggaattcgaggcactgcagcttcatgtgctgagttaaagtaagtctctggaaatagaagctgaagaatcacaatactcaatctaatttaaccaaagtctaattagagaatctaccagaaattgagagacttgctagacataaatttgcctgtataggaagtcacgtatttgtcatcctttcaaatttttaaatgtatggtataatcagcaaaatagaagtaaattatcaantacagcctaaggagagatattttcgttt

SEQ ID NO: 636380 - DNA, 94 bp, Homo sapiens
gagaaaaaccttacaaatgtgaagcatcttataaatcctgtaagcgtcttataaatcctgtaggtcaagctaggcataattcagcataggaatt

SEQ ID NO: 636381 - DNA, 681 bp, Homo sapiens
  misc_feature (82)..(82): n is a, c, g, or t
agcgggctggggacccagtgagccgagaggccctctgggctccacttatgcatatgcaccaaaaaaaaaaaaaaaaaaaaangggttttttaaaaccaaaaccctttaaaatgttaagggccccagggcgggaaacccggtttgggggcccccgagtaattggataacacgggggcaaaaggttaaacagcgagactaatttgatacattcctgggggagccaataaccgctagctgcgagggagtttttgggcatagcagtggggcgcccaatttaggggagacctctcctaaaagcgaagctccaagaagcacccaaaggagaacgagcatcagttcacgatatctcccggatggaggtatacacacccacccgggcaccacgagagggagaccttgggcgccccaaaactccccggggttgggcccccccgtgggggggcaccccaaaagggtttgccccgccaaaatagaggagtgggctcgaacaaaaaaggacaacacaatcttgtgggaggcaacactaggggcacacaggtggagtgattgaggtatggaacaaacacgggggggggacataacaacgattgtccacccaagagtaagggaaaacacaccacgatcccacgggggagcgacgacgaggggagcaggacccaaagggacgcacacaaacaacag

SEQ ID NO: 636382 - DNA, 991 bp, Homo sapiens
  misc_feature (991)..(991): n is a, c, g, or t
cccaagtccagagttcatgtccaagctctcgtggaagagctacatgattggcacctatgccagtatggctatgtgttcggcactaccacccccgctcgtatgatggcctctgagggattcgggtaccatgcatcgagtctcagccctgccagtgggggatgagagggggcgtgtggtggacatctagtccaggtctgatgttatcaatctggcggcagaacaagagcacctacagacaacctagatgtatctgctgacgtaaagccttgcacaaccactcgatgcacatacactcttgaggggtgttctcaccgtgcttacctgccgtgagactctgtgcagaccatcagtcaagcaggctagtggaagcagaggttcaacgagcattgttactggtgggtgaagatgatgtggtcacaggtgaacttgtatcactggcgtgagcatccttgtaggccctggttgctccccggtcggagtgaccgcacgtcctgaggctcggggggattgcggcgtgagtgcacgcagcaggtgatattgctcaagtcagttgccttggatgctagctctgttgggagtcacgattgacattctgattggagttgttgactctgttccctgtcctgcgcccctgccttctgatctccggagctgaggccaggatgggggggatgcgagccatgattatcggcggcccttatcctgcatgcattagtgcggagacctaggccatagccagtctagcaccggaactctagatgtattccccttactggtgatgtgggcaggacgtcggggttcggatccgaagaatccggctcgatgctctgcgcgtgtggtcgtttccacggatcactgctaagtttgagatggttccggcggatgggagcaccctggcttccgagaggggcgggaggggcccgacaagaaggccaggagtacaggggggtacgaaaacgggggtcttctctcttcttcttttttctattgn

SEQ ID NO: 636383 - DNA, 870 bp, Homo sapiens
  misc_feature (20)..(20): n is a, c, g, or t
  misc_feature (389)..(389): n is a, c, g, or t
  misc_feature (611)..(611): n is a, c, g, or t
  misc_feature (701)..(701): n is a, c, g, or t
  misc_feature (705)..(705): n is a, c, g, or t
  misc_feature (718)..(718): n is a, c, g, or t
  misc_feature (720)..(720): n is a, c, g, or t
  misc_feature (725)..(725): n is a, c, g, or t
gcctagccttcctgccaagnttggattccagaaacacctcttggtgcctcagttttctcatctgtttgtgtgtgtgtgtgtgtgtgtgtgtgtgttggtagatagggtctttctctgtcacccaggctggagtgctgtggtgcgatcatggctcactgcaacctctacctcctgggctcaagcaatcctcccgcctcagtctctcgagtagctgggaccacaggtgcacaccaccatgcctggctaatttgtgtgtgtggttcatttttgtagcgacagggtctccctatgttgcccatactggtctcaaactcagctcaagtgatctgcccgcctcagcttcccaaagtgctgggattacaggcatgagccagtgcgcccagcccggntttctcatctgtaaaatgggttgacaatgcccacccagataatggttgaaaggactcgtgaaaccacgtaggaggcacaggcagacaggcacttgtgggggtccatgaatgagcctcagtgccagctcccccaggcagcttccagcttcacactgtctgggcagaggagtcttcctaaaacagaggactgtgtggagcacttctccaagagaagcctcttgnctcaagtcagtgacactgttctccagcccaccaatgtcatgtgcccaagctcatcatacttttcctcaaaccctgtctgtcaggaaaatnctantcacccgaaaatncntgtgngatgcccacttgctcatttaaatggctcacagggttttctaaggaaccaagaaacatttctctgtgtggaccctgcgctggtggccactgggggctccattctgaggtccctttatagggacctaccagaaggggggggaagccg

SEQ ID NO: 636384 - DNA, 172 bp, Homo sapiens
ctatacattgcaatagccgacgcctgtatgttaccactggactgctgaacaggatcgtgtctactggctttctcatcaagaagaactcccaacaaaatcagtcagacaactcttgaagttggcttatcaaagtgccaataaacagaatgtatggctttcctcgtggcgatca

SEQ ID NO: 636385 - DNA, 558 bp, Homo sapiens
tataagcttgatagtcaggagttcaagaccagcctgggcaacatggtgaaaccccgtctatacaaaaatacaaaaagttagccaggcacgatggcaggtgcccgtaatcccagccactcaggaggctgtgttcaagctaatcgcttgaacctgggaggcagaggttgcagtgagccgaaattgtgctatagcactccagctagggcagcaagagcgaaactccatctcaaaaaaaaaaaaaggataggggttctctgaaaaaaccccagaatctcaccctgagggaatccctgtggcccaaggttaaaacacttcttgggttaaaaaaccaaccatgtgttggttacggggattttaaccccattaaattaaattattttccccttgagcccatggtggatatgattattaaccaatggggggaaaaaaggctttccctcatagatttatatcctcattattggtagagggaaggtgtgaatttgaaggtcacactgggggcacccacaaaggcattaatggtggcgaacaggttccttcggtggctacattggagac

SEQ ID NO: 636386 - DNA, 744 bp, Homo sapiens
gatcctgtgcggtcacttagccagacgatgcctgaggaaacccagacccaagaccaaccgatggatagaggaggaggttgagacgtctgcgcctttcagcgcatgaaattgcccaggttgatgtcattagagtcatcaatactttactactcgaacaaagagatctgtctgagagagctcatttcacaattccactcagagtgctacttggacaaaatccggttatgaacagcttgacacgagtcccagtaacacttagactctgggcaaagagtctgcgatattaaccgttgataccgaacaaacaagatcgaactctcactattggtggatacgtggaactctggaagtgaccaaggcattgactatgatccaaataacctgtggtactatcgccaagtctgggaccaaagcgttcatggaagctatgcaggctggctgcagatatctctatgattggccagttcggtgttaggtttcttattctagcttcatttaggttgctgagaaagtaactagtagatcaccaaacataacgatgatgagcagtacgcttgggagtcctcagcagggggatctattcacagtgaggactagacactacggtgaaccctatgggtcgtgtcaacaaaagttatcctacacctgaaagaagaccaaactgagtactcggaggaacgaaggaataaacggcgcatgtgcagaaacttctcagtctgttggctatccctcactcttttgtgg

SEQ ID NO: 636387 - DNA, 197 bp, Homo sapiens
  misc_feature (130)..(130): n is a, c, g, or t
  misc_feature (178)..(178): n is a, c, g, or t
gcttcctcaagccaagctccccaggcccaggtcaggctcacggtggcctccaggatcagctcctgccctccaatggcgtctccagacccgaaatggtctccggtcggtgggctcctccacgccagcttgncgtcccggcgacctctgcaggcccaagtcgtcctgaagtcgcgtcgcncgccctgcctcccagcaag

SEQ ID NO: 636388 - DNA, 109 bp, Homo sapiens
acactcaacacacagtagccttactcatgggctccggagttgttctaacgctcacaggaatgctgcagaaagatacgactacttactagcagaagtgaagtagtcgtat

SEQ ID NO: 636389 - DNA, 319 bp, Homo sapiens
cttgtgtctggagtgtatggtgcgatctcagctcacgaaacctccacctcctggggttcacgcgattcttctgcctcagcctcccaaatagctagaatgcaggcatgtgccacacacccggcaatttgcatttttagtagagacagggtttctccatgttagtcaggctggtctcgaactcctgacctcaagcaatctgcctcctttggctccccaaagtgccgggcttacaggtgtgagccactgcacccggcctacaatttctttttcacagttatagaaaacaagcaaagaaaaaaaactagacacaagggaaaca

SEQ ID NO: 636390 - DNA, 284 bp, Homo sapiens
gctcgactgtgattgcatgcaaatcatatagcaatataatgagtcattgaaaccaaaagttttatgcagaaagcatgtcaactcagaactatataataatcatgggtctaataattaggaaatgtatgttgataaggaaaaacatttcattgataccaaataattttctcactctttaactgggaaaactttttttctcattagagtgacgaaaagttaatattcattaaggacataaaatataacgtaagatcgagcaaatattcaaggttggaggcgtcgac

SEQ ID NO: 636391 - DNA, 113 bp, Homo sapiens
  misc_feature (90)..(90): n is a, c, g, or t
ggttcaggcaggctctggtgtggctgtgacaccaatcacctccaactcctgtgcctcctgtcgtggctcgttcgggtggctgcatcacangtgtgtgatggtcactgtggcaa

SEQ ID NO: 636392 - DNA, 879 bp, Homo sapiens
taaaaaaaaacaatttctcatttcctcccccaaggggggaagtaaggggtggatcaacaaaagagggcgcaagcaaaggggaggcccggatgccacgagaggtacgagagcggggagagaccaggaagaacagacagcgggagtaacacccacccagccggagggggagcagcacccaccccggcgtcctcctcagaggagaggagcagacaacacccgaggggaagaaacacaaccagcacactattgtcacacaagcacacacacggaggggggaacaatagaactagaacacgacccgaggggacgacacaaacgcggagggaggaagggagctctcactcacacacacaccaaaagaaaagagtgaacagctagaaggaagcagcgagacggcacccaagagaggggagagagaagaagaagagacgaaaacagaagagccagcccgcacgacgacggcggagaaaccaatacaacacaaaaaaccaaaaagaaggaggagggcgagggcgcaacacaaaaaaggaggcgtagaccgacacacaacaaaaaaaacaagaagaggagcgcaggctagcccgagcgaaaaagaagaacagaaagaggggcggacgaccgacagaacaaacagaaaaatagatcgacgacaggtagcaaaccaaaaagagagggagagcagaccacaaaaaaaacaaaagacaggcagcaagagcaacaccaccaacgtgaggggggagcgacaacaccacaaagcacgcagacaaccaggagaaggagcagaaaaaaagaacgacgcaccaaccagaggacacaaagaagagagagagagggagcagcgacacaaaaaaaacaacagacagacgacacggagcacaa

SEQ ID NO: 636393 - DNA, 566 bp, Homo sapiens
tccataatgtgtgcccacgcttcgatagcaactcaatcaagtagaagaaagggtatcagtgattgaagatcaaattaatgaaataaagcaagaggagaagtttagagaaaaaagtaaaaagaaacgaacaaagcctccaagaaatatgggactatgtgaaaagaccaaatctacgttagattggtgtatctgaaagtgacagggataatggaaccaagctggaaaacactctgcacgatattctccaggagaacttccccaatctagcaaagcaggccgacattcaaattcaggaaatacagagaacacgacagatactctttgagaacagcaaccccaagatgtataataatcagattcaccaaggtagaaatgaaggaaaacatgtaggggcagccacagaaaaatgtagggttacccacaaacggaagcccatcagactaacagtggatctctccacagacactctacaagccagaagagagtggagccactattcaacattcttaaagaacggaataaccaaaccagaatctcatctccagaccacataagcttcatacgtg

SEQ ID NO: 636394 - DNA, 389 bp, Homo sapiens
  misc_feature (62)..(62): n is a, c, g, or t
ccccttatcacacatgaattattttctggtagcacattttaatataagtgactttaagaggncgggcgcggtggctcatgcgtgtgagcccagcactttgggaggccgaggcggccggatcacgagatcaggagatcgagaccatcctgactaacatggtgaaaccccgtctctactaaaaaatacaaaaaaattagccgggcgtgggggcgggcatctgtggtcccaattacttgggaggctgaggcaggagaattggttggacccgggaggcagaggttacagtgagcagagatcgtgccactgcattccagccggggtaagagagcgagactctgcctcaaaaaaaagaaggcttagtgtgcaactcatcagagttgcacagggca

SEQ ID NO: 636395 - DNA, 200 bp, Homo sapiens
atgatacaatcagctcggtacctgtacattcgtgtcagcccaccgccgtgcgcttgtgtcatgccctacgttggtatatcacatcaatgtcttacgaaaaggaaataggccagtcctgccaggagtgaagaaagctttgggcatatatggtcctgccgttgtgtaatatactacaagaagtggatctacagatagtatag

SEQ ID NO: 636396 - DNA, 424 bp, Homo sapiens
  misc_feature (136)..(136): n is a, c, g, or t
cagactccagtgtacaaagcgtttaacgagcatactatacgtctagtacgagcggtgcgatcgccgagtcactcactgagcttctctgaaagcgtctcttgcatcctctatgaaatacgtgatgcttacggagtcnacctcatcagtgcggccctctcgtggagccagtatcaacagctacctgtgctgagagggactctacctggagaatccagaaatcaagatccggatccttggggagcccaagcagaaacgcaagctggtggctgaggtgtccctgcagaacccgtccctgtggccctggaaggctgcaccttcactgtggagggggccggcctgactgaggagcagaagacggggagatcccagaccccgtggaggcaggggaggaagtcaaggtgagaatggaactgtgccgtccaat

SEQ ID NO: 636397 - DNA, 1816 bp, Homo sapiens
  misc_feature (1092)..(1092): n is a, c, g, or t
gggcggctgcgcgccagtgtatgtggtgggggttgcgcccgggtggtggtgtggtggccggcagctgcttcgctgcgtgtgggggcgcgcgtgtttcgtgcagttgagcgcgggcgtttgcgtactgtgtgtgtgtaaccagcagctggttgtgcggtcgtgttcgtcggcaggtgattgcccgctgtatggttccccgtgctcggcgatcaggagcgtgttgcagccgcgctgtcctcgcttgtgagggttgtgccgatagcgctgggtgtgagtacgctcgggggagggttttggccgctctggtgttggggtgggcccagggcgcccttgggcgctgtttccgcgtggacccatgtggggacgacttgggtgagcgtgctgttgatgttgggggaggttgtgtagcgctgaccacaaaggtgttgtctgagcacgacgccatagggctgggggtggttctacgggggaggggggtgttgtgccgcggcttccggtgtggggggggcggtgtgtcgtggtggcggcgctgggtttagggggatgtggtgggtcgcgccgtgttgttgcccggggctagtttgtgccagcgcggggtgtgcgggcgttggtggtcgcctcataccgttggtggggccgttgctcgcggcgccctcttgtgtgtggtgtcgtgaggggtgacgttgggtcggggaggaggcgcgcgtggttgtttcccccccgctgggttttggtgtagagaagtatgggtgtaatactcctgccgtaggttgtgttttgcacgcacacatgagggtgagtgcgccctttgagtgcggtataccgcgacagagggggtgcaagaaggaacgctacgccggggttcgcacgcggcttgtgtggtggtggcgtgcggggggagagagtgcgcctggtccacgcggcgacgaggggctttggcgggagatcgcaggggttttgacccacaacgtcgggcagaggtgagagggggagcaggcccgctggggcagatgacgacaggcccaacagaggaagagggcgcgccgctgcaaagggggcgccggggcgcaccaacggcaggctcgccgtggngctccgcaaaggaggagagaatagggggctcacaacgggggccacacagggcctcggcacagtggcgccccacagcgtggtgggacaacagacacgacacagcgtgtgataggagttgcgcgcgtgagcgcgcgcgggggacagcacatgatgctcgcgccttgtgggacgcgggtgggaacacacgcggcgtacacatgggtagatgtgtgacggtgttcgttggcacacgacgcagttgtgtttcacaggactcccgtgtgtgtctatgactgagagatttgtggttgtttcgcgcgcgtctatgtgatggagcgcccatctgtgggggtaaataatgatgatgtgcgcgcaagtgtgtggagatatgtgagaacaccgcgtggacattcgcgaattatgcccagggcgcccaaggtgatagcgccgcctcttgtgtgcagacgcgccacgccagttgcgtggcaccgtgtggggggacatttccgccgagagtaggatctaccgggtgtggacgaagaataatgcaccaccttaaggaatatccccgtggttcgagctcctgagctccagacccactgagtgcccctcctgtgtgtgcccctggcccttttttcctgaaccccttttaattttactcattttttcctttgcccttgattttttagactcagtgccattaaattcactagaaaccccgaaattataaaaaaataaaaaataa

SEQ ID NO: 636398 - DNA, 961 bp, Homo sapiens
  misc_feature (961)..(961): n is a, c, g, or t
cggacgcgtgggtcgacccacgcgtcgcttcccaataagccatttgagtaagaatcccagcctcaggttctgcttctcaggaacctaaacgagaaaggaactcttttcaggtggtcgtaacactcatccctaagaacttgtccctaactggaagacgtagcccctctaacaacagaagcaatgtagattaaggatgttgattcttttaaatgtatctacttagtttcctggatccaagatatatcagataatcaacactgggcaaccatccatgtgtagctttctttgggtaagaagatcatcagtgggtgctaagaccattgggtgaaatttagttgggaaataggttattattaatcacatagggaaaaatacgcttttataattaaaagaattggcattaccaccttaacaaagtgatcaaactcagcatcagtgatattggagcaagccaacattacatgcctctcagagggatgataggaaataaacaataacacttaagtagcattcttgccagaaatatttaacctgaatccaatcattagaaaaatatcaaacaaattcagcttgtgagacattctactagacaatgggcctagagaatgtccttgtgtttggcagctgaaggttcattaaaaagtgttaaataagggcgggtgtgatggctcgcgcctgtgtgttccagcacttttgggaggccgaggcgtattgatcaccggggtccaggagctcagaccagtctgggccggattggtgaaaacctctctattttaattccaaaagattgcggatgtgggctgctgtgtaccgctactcgaggtgagggagaatgctgaccgggggggtgtgggccctgtcctcgctccccggtacagtcttttccaaaaaaaaggggcgattatacgcggcaccctttaggcgagggttagcgggatagagggttagtcttgtggccatn

SEQ ID NO: 636399 - DNA, 978 bp, Homo sapiens
gctgtgacggggttcccagaagaatgtggaggaagccatcgaccacatcctcgatctggcacggagtgataatagctagactgacgtggtggacagtgaggcggctggtggtatacatgaaatccccaggagacgaagaggccacgggaccttccagagtgcttgtgtggatgcgggacgcaacctggagcggcaggcagtatgatgagaagggttccgtgaactatgagcagttgcatgagggaatgttcccatgcttatggggctctatggttggttccctaatgaatccatcctcttgggggcccgagcatcgagtaatgatcatatgatgaatacgagaccttcgtcgctaggccgtgcattgacccgagtccgaaccacaagcaattggttctgtcttcaagtctgacaccatgtgggtggatcctccgataaatagttgatgcgtcttccccccctttaacactgaggtgccctgcaggggaagctctaagttgcctggcatgtagttggtgccgtgacgcatcttccgaggcctgtggcgtgtccgttcgaggacctggctccgaattgtttaaagactgaaacacaatggtcatgaggcgattcgtgctggtggatagagcagattgcacaggatcacgtggtccagcccgagattgttcaggtcaggcactcatggcctttcatcactgatgatgctctccggagccgtgtctaagtgattcccagcgttccctgttgtcgatgaccctgaggagaataagagttctttggacttttattgagcaaaccaaacatcctgaggccttggtggggggccctcattgtcggggtgggggggacactttgatactgtaagtggcgcatgggtccaaatggcgttcccgcgacatcgaattgcttgatagccgttcgcagatcggggccaccatacgggagcggtaaacttgggcataacgtgtaacgccagag

SEQ ID NO: 636400 - DNA, 298 bp, Homo sapiens
gtatcattggctatcaggatgccttatttgagacaatagaggcggaattgaatgaattgggggccggtagtgttaagtcattgctagcaggagtcttgtgcttgggagatgtgaccgctgagagtgagagcatgcgtggtagcgagcgcgatttcatgctcaatgctcggtcctgctagactgctgggagacaggcaggaatgtggccagggaaggttgccatgagacaaaagttgggcctggaaaggcccttgtgaggcatgagcttggcctaaagaggccactggatgagggcatg

SEQ ID NO: 636401 - DNA, 204 bp, Homo sapiens
gcgtataactagtacggcgcagtgtgctggaatacgctacggaagcacactgcaacagaaactagtatagatagtatcttgaagtatgactacttaaaaacataaggtagtaaaggaaagacatacagactggtaccacgtagggcatgtacagcacggcagcaggaaccctagctataccaacaaactagatataagtaccag

SEQ ID NO: 636402 - DNA, 285 bp, Homo sapiens
cctagtgagagtcatacatatgatggtcagatgaaagctctgggatccgtgctactctctataattgctcccttatgtatcgccttcaaggcctcgcaacggaatctggaactagctgtgtcttcaatggttcagccacaactggggaatgagtgagagggtattgtgcgtaaatacagaggacaaggggctagccacatttgcttggataattacagttactgtgctccaaacgaatacaaactggcgcctccccatcgtgactcatgacggctgcatcgcgag

SEQ ID NO: 636403 - DNA, 591 bp, Homo sapiens
  misc_feature (279)..(280): n is a, c, g, or t
cctctccttccctccaaaacaaaaaaaaaaaaaaaaaaaaaaaaagaaacccccacccccccccttccctccccccccccccccccccccccccccccccccttttttttttttttttttttttttttcaataaaaaaaaaaaacccaaacattttgttgttttttttttttttctcctccttttaaaaaaaaaaaaaaaaaaaaaaaattttggtgggggggggggggggcgggggcccccccccccccccccgtgggggggggtggtgtggggggtnntggtgtgtgggggggggggggtctctcccccccacaaaaaaaaaagaattttttttttttttgggggggggggaaaggaaagaaaaaaaatttatttttttttttttctccccaaaaaaaaagagaaaaaaccccatagggggggggggccccccccccaaattttgggaaagaaaaaaatacctttttttttggggggggggaaaaaaaaacccaaaaaatcccgccccccccccccccccaaaagggaaaccccaatttttttccctttgcccaaacccaattgaaaaaacctgggaaaaaaaaaaatc

SEQ ID NO: 636404 - DNA, 1087 bp, Homo sapiens
gtggtcgcggatgggggctagacgggaacagcagagcgaggtccagtgcaccgaagacttagagcaatgaacttgtttcgcattcacagtgacgctgtgatggtctggtgcagggtcataatattcatcgatgtggcagatgacaggtaatgaccagtgatgctgaacattcaacaagccgcagattctccaaagaaggaaaatgtgatgaggtggatgagtacggtggcatctttggaggctctctgaccaggaagccgagcacccgctagtgctgggtacatgcatacctttagccaggagtagggcgccatggaaacggaaaaacgaattcaccagaaaacattgttcgatgttagattgggctacctcagcagagtaaacggtagaaagtgaatagatgattaacagaagttaggcatgtgactgtagtagtatcccagtttgacatttatagaaagtatataacagttgcgagatagagggtatggaaaagaaaagaataacgaaacgaaaagaatacgaacacacaactggcctgcgcgatagaggaactcgacacacgactgaggctcagagggagccagagccaacgagcgagggccagaccaaggcgagcgcagtggcccaggggaaaacacaaccagaaccaaaagcaaaggaatagcccacgagggacacgcacaccaggcaccagggtcaagactcagagcgcatgacagcgtggcaccaggaacacaatgggaggcaatagcaattggacgcgcctggcttatgtaccaccacgacaattaacactgctcacttgacgctgggcgataatttggaaacccgcacacctgggaccccaggaagaacagccgaagaggcatcacaggtgcagaccccaccagactgggaaacggacgggatggggccccgaactcaagagaggtaatagcgggaaccaaatgagcgccgcaggaactcacgccggccaaggacgagcaacatagcggaagtaagacggaggccaccaaacaaagcacgacagagaactaggagggcacataccgcggaatacagtggaggcacagcaggagtgacc

SEQ ID NO: 636405 - DNA, 347 bp, Homo sapiens
  misc_feature (252)..(252): n is a, c, g, or t
  misc_feature (257)..(257): n is a, c, g, or t
  misc_feature (279)..(279): n is a, c, g, or t
  misc_feature (290)..(290): n is a, c, g, or t
  misc_feature (298)..(298): n is a, c, g, or t
  misc_feature (304)..(304): n is a, c, g, or t
  misc_feature (317)..(317): n is a, c, g, or t
  misc_feature (319)..(319): n is a, c, g, or t
  misc_feature (340)..(340): n is a, c, g, or t
ttcggcacgagcacattccaccttactaccagcacaccctagagcacaaacccattatacccaatataagagatatagcgcgtatagaattttggaaaaccctgggcgcatatagatataggtacccgaagagagaagagatgaaaaatttataacccagtgcatatttataggcaggggtctaaccccatataccctttctgacatattgatttaacctagagaataacctttgcaagggagagccaaagngctanagaccccccgaaacccagagcngagctacctanagacacanctaaanagagcacacccgntntatttgagcaaaatagtgggngagattt

SEQ ID NO: 636406 - DNA, 228 bp, Homo sapiens
  misc_feature (26)..(26): n is a, c, g, or t
  misc_feature (206)..(206): n is a, c, g, or t
tttacacaggagcgcatggccatggntttggaaaggagaatggaaaaatagaagaaggtcggccgggcttggtggcttatgcctgtaaccccagcactttgggaggccgaggtgggcggttcacctgaggtcaggagttcgggaccagcctggcaaacaccccatctttactaagcgaaaacccatctttactaaaattacaaaanttagctgggcatggttgcgcat

SEQ ID NO: 636407 - DNA, 434 bp, Homo sapiens
tatactcaactgtctctgcgtgtggacacagagtacgggaaaatgagaacaagataactatcactaatgaccagggccgtctgagcaaggaagacatcgaacgtatggtccaggaagctgagaagtacaaagctgaggatgagaagcagagggacaaggtgtcatccaagaattcacttgagtcctatgccttcaacatgaaagcaactgttgacgatgagaaacttcaaggcaagattaacgatgaggacaaacagaagattctggacacgtgtaatgaaatgatcaactggcttgataagaatcagactgctgagaaggaagaatttgaacatcaacagaacgagctggagaaagtttgcgagcccagtcatcaccaagcctgtaccagagtgcaggaggcatgccaggaggaatgcccgggggtaggaggt

SEQ ID NO: 636408 - DNA, 368 bp, Homo sapiens
tacatttacagactctgctggtccctaaagactggtaaaacacaggttttcacctattagccaaaatccccctgccatttaaaaacaacttctgtctcatgagaggcagtacagcttaatagtctggctcaggaggctgaggaggtggatacctgaggtcaggagttcgagaccaggttggccaatatgggtgaaaccccatctctgctaaaaatacaaaaattagctgggcatagtggcatgtgcctataatcccagctacttgggaggtcgaggcaggagaatcgcttgaacctgggaggtagaggtagcaatgagccaagatggctccactttactccagcctgggcgacagagcgagactccat

SEQ ID NO: 636409 - DNA, 413 bp, Homo sapiens
tcgtcagagctatcatcatcgatctgaactttgggatgcactggttccacaaagagatcttatttttgtgctgtgcccacgattttagtatagaatgatttttcatcagtacataccatagcttgctcgattttgttgtcaatagctaccacacttgcaccagaggagctgaaaaagaggagggaaaaaggtcatcgataaatggaatttatcttaagcgtccaagataaaaaggatctcccaattttgtgatattgctagcatcatatttcgaatgttatttaacactatgtaatgtatcaccccccagaaaatgccagcccctctcttactaacgaatatccaggcatctccctattttagtaagccacaaaggactaaattacatcatgtggggaaagcctgttctctgg

SEQ ID NO: 636410 - DNA, 344 bp, Homo sapiens
gccggccgcgtcgacttcacaatagccaagatttggaagcatcctaagtgtccatcaacagatgaacagataaaatgtggtacatatatacatgagatcctgtcgttttcaacatggatggaactgggggtcattatgctaagtgaaataagccaggcacaaaaatataaactgcatgtcctcacttatttgtgagagctaaaaatgaaaacaactcggagatagagagtagaaggatcgttggttaccagaggctgggaagggtaagcggggtatcagggagagtgagaatggttaacgggtacaaaaagtcgacgcggccgcgaatatagtagtagtagtag

SEQ ID NO: 636411 - DNA, 891 bp, Homo sapiens
gtaccaagtgaacagagtacctagttcatcagccgtccagtaaagcaacccaggaaactgactgggtctctttgcctaccgtattaacattaacacattgatgtactgtattctgtactttactgcacccagcagactttcaacaactcattgatccaaagatacatgcacagtctgagcaccagctatggtgctcataacttctttcaagcacttgaaccctttcaatctgtgatgattcattcaaattggcaccattgcatgatgagaatacacattgtcatgtaatctgtgcacatgacagtgtgtgtgtgtgccacgtagcatcactgtcatcagtcttcaaaaatcgcattatactggccaggggtggtggctaacgcctgtcacatcccaagaaactttgggcaggccgcaggccgggtggatccactgtggtcaagggagtttgcagatcagccaggacaacctggtgaaacccgtctctactacaaaatccaaaaattagctgggacgtgatggttgggcgcctgtaatcccagactacttgggaaggctgagcgcaggagcaatcacttgaacccgggacggcgagaggttgcaagggagcccgagatcgcaccatatgcactcccagtcttggggcaaacgagttgagaattaccagtctcaagcaaaaacaacacacagcgcgacaaacacaaacaagacataaaaccgccatgcactgagtacaccagcgcgacccattaacacaacggggaagccgcaccaacacacggcgaagacaaccacaacacagcaactgcaaaggtaccaggactagcgaacaagcgagcacaaaaacaacacaaccaaaaagaggcccgacgagaacgaaaccagaaacag

SEQ ID NO: 636412 - DNA, 156 bp, Homo sapiens
aaaaacaagacaagcagcaacagctgttttgttggggctatagatttaggtcaggcatagtcaatttcagattacctaagagtggatatatgcatatggggaaattatacccttcccctttttatttgcccttgcgatccacctccttttgagagg

SEQ ID NO: 636413 - DNA, 1005 bp, Homo sapiens
gcggtgcgcggcctcctgaggggagcagcccgatggaatctgccgggagaggtccgggaggtgacatcgtccagcatgcgcacgtgctatcggaggactcgtggtatgcagtgaagatccctgggcccggtgcatgaacctcgccatctcaggacgctgacgtccaatacacaaggacggagatgggcttcgctgagggatgtctccagttgaaagaatagggctcaggttacttaatgaaggagttcatgaggaatgcttcgctattactgacacacggccacaagtcccaaccccagttctgtgcagtgcttgtggtgcctctgctgaggacgtgatgtgaggagttgctagtgccgtgcgtccgtgtctcgagtgatgagagggagctgctcgcagcgtggttgatactacgcccgtcacctgagtggcgtagtgcttctagtgggtatcagtgacactggattgacccaggaaagaactttggtacccacgttgctcgccggacatcgtggtctgatcaatatcgagtaaggagttgtggatggagggaactcggtggaaagaacgttcgccggttgggtccactgacacgagaggaacttccttggggtggccgaaggcagtcctagtacgcggatcgaggccacttctggggggcatggtatgttgcgtgggccaaggattcagtgcggaggggagggcggctgacctttgaacatggcagcggggcctggaggttctccgcagtgtacgggaagtatgggagggcaacgcgaaggacagttgcgtcaccagcgcggaattctggcaccggggctcggggctagtggaaggcatgggggccgcaggcccgtaggaaatgcaacggccggagaagttcctggggttcgcgattgaggtaccagagggcgcttgcctaagagagattgatagcatggggagtcatctcaaaaaagagcggccaggaaggtaagtgggctacttttcccttggggaaggcca

SEQ ID NO: 636414 - DNA, 149 bp, Homo sapiens
agcttctattgattgcggttatcgtgtcacgcggtggatgacacgaaatagctcaaccctgggtgttcagtatagcttagttaatctttcgtttattgctaaaggttaatcactgctgtattcccgtggagggtagtaggctacggcta

SEQ ID NO: 636415 - DNA, 730 bp, Homo sapiens
cagaagatctacagagactacaaggatgaggatggcttcgtgtacatgtacactactgcctcccaggtagacattaggcatgtctggagtcatgcagtcccccatggatgggtagacacgccttgaggacgagacgcctgcaatcctctcttagcccatgtcgggcaaggaatgtgtgctctagacagtacagtgtcatgatgctggcagaagggatggtatctctcctgtgtatacagcggcaggagtgtgagaagcagggatgcctggggtgatcagctccaaccagtggcagcagagtggtggctcttcctagtttagtttttgtgctccgtgttcttgtgtccttctaagaaaaatgtgggctgctcttgaaagttatataattatcatttttttttttggaacacagggtctggctctatggcctaggctggagcacaggggcatgatctgtggctcactgcaacctccgcctccggggttcaagtgattcttctgctccacccccagagtggctggtattacaagcacatgccaccacaccaggctaatcgggatcccagtagagacggggtttcaccattgtgtggccaggctggtctcgaactcctgacctcaggtgatccacccacctccggcctcccaaagtgctggcgatcacaggcgtgagccatggtatccagcatataaccgtattctaaataagacatgctggcttgtgtagaac

SEQ ID NO: 636416 - DNA, 1073 bp, Homo sapiens
taacgacggagtgccagcgagggattcggggaactaaatgaaccgtgcgaggatcctggctagccactctggaatccgataccgatatctcttatgacctcaggcgactgacaaagggaacggtgtctcatcccccttcctcctctcctccctgatcctgagccttagccatggccgatgcagggtgctgggcctgagcgagaccggtcactgcagtacgaacggctctaccggtgatcaaccagagactcctgcattgcactttgcgggatcgaaggtacggaagaaaatcgaggcagaggcatttatactttctcgcttctgagagacgttgcctcggagagcctcttcctcagggagatagccgcgtaacgcacttacctatccacatacttccggtacagaccggtagaggcgcaggaagtaccaaacacgggtagcatatggcactaaccgtgcacgacattgtgtgcactaagtgagccacattgggcctgccgttccatcgcaaactgactgcttgtatttatggagtacaacctcagggccttctggcgaagagctccaacggtatatacgtgcatgcaggtaggcaacgaatgagggctggtggtgcatctcaacacgtagtgtaacggtagagcgcgaccgcgataggacggagctgtcggtgcaacccttaggcagcggacccgcagcggacgaactcatggcgttcttgaaattgggacaaccctatacagccacttggactctacccaaaagtgacactgggaagaggctttcggcatagcctgctgggatcttcttagccagccacccgggaaccatgatgccccttgctcacatatcaacggatggccattccaaggtgcgccctttcccgttggtattccaccgtagtaggagccaaactgacccatggggtacctcaaacaggctagtgagcgtaaacgcaacaatcacaggcaactacagctagtgggcatttccaagggcgacactaccattatccaagcggggccacactccttcatttcatttagaaggaccattgtacagccaattccccc

SEQ ID NO: 636417 - DNA, 362 bp, Homo sapiens
tcccgactggtcgaccaggttgcgatccagattaatcccaccagacttctattgcacacttcgcaataagccaccgtcctttggtcgtgagttcacgtaatactggtcccgtgcacgcagccgtggtgccacaccttaggtgccgcaagctgcacaccaactcaggtctgacctgctccatgtggatgtaccggatggagcgtgcgctgtacgtgttcactctagctcctggcacgatctccgacagagatcttcgagcgccttctagcacattttggtcaaaggcgcgagttttcctgttctcagtacttgttgttgtgcgtcagctcgttcggctccttcatccggtaccttcctgacct

SEQ ID NO: 636418 - DNA, 254 bp, Homo sapiens
aaaagcccccccggggggggggggaggtaaaggcctttcattttttcccccaaggaaaagggggccaagaattttttccttttggggaggggggggggcttccccttttttttttttcccccccccccccccaagttttttacattgggttgggtttgggggcccaaatagggggtttgtttttttccccccagggcaagggggttccccattgcaaaaccttgcccaaaacagtaaaaagggcctgcttgcca

SEQ ID NO: 636419 - DNA, 165 bp, Homo sapiens
attcgcggccgcgtcgacggccaggcgtggtagctgggttcacaccagtgatcccagcgcttcgggaggctgaggcaggggaatcaccttcagcccaggagttgccagcctgggcaacatggcaaaaccccatctctacacaaaatatacaaacttatctgggca

SEQ ID NO: 636420 - DNA, 775 bp, Homo sapiens
tgtggcaaaatatttaattggctagccatccccatggtgagccgcttggggtgtgaggggtgaagctgggtggtggatcacagcatcttctggaatagggcgatggcctcatccaccattcctgagctctgcttctgtctgtatggagcttggatttcatctggcctcctggatcttcgagcggacactttgacaggatagcccgaggcagtcacgggtacccgcagacgctgggcctagccgatgggcctcaaactcgcttggttttgcaggtttgcccagctcccgtgcagggtccaccaagcccctgaaagctgcaggtggatggagcagcgatcaagaagccagagccacagcgcaaccctggggggcgggagcccccagggccagaaacagccaccacaacctgcgctggccaggcctgacacgataagcccgacaccgccgatgccaggcgcccgtggcctcatccgcatttccaggaaacatgtcaggcacggttccgggtgaaggttgtatcggcccggagagatcagcacggctcgcgtgatgcttacgccagctcaagggggatcttgccatcggagatcatccaggcaacccatctgagggcctcggaatggggtaacacaacaggataggggactctgcgaatcctccgggcagccttgggaacagccctccgtagagggctaagttaaagcagccgagcaagtcaggactgtatggttggggcactcgttcctgttcccattatctgtttgcctcgtaattg

SEQ ID NO: 636421 - DNA, 890 bp, Homo sapiens
gagactgaccgcggggcagtgaggagatgtcagaccccggcccggaggaggctcatgcgggattcaagcggttacaagaggacccacctgtgggtgccagtggcgcaccatctgaaaacaacatcatgcagtgaatgcagtttatattggcaccagcaagggacacctttggaagatggtactttaaactagtaatagaattttcctgaagacatatccaaataaacaccaagtgttaggtttttatccacacagtgttttcactccaaagtgtgtattgctgagggtagccatatgttagatatccttcagaatcgatggagtccaaacatatgatgtatcgttctatcttaacatcaaattcagtctctgggtgggatgaacgcggaaattctaaggggtccagctccaatagacaaggccagagcagtttatcagggaaagcaaaacgagaatatgagacaagaagttcgggccatttgtttgaacaacagctggaagtgattcataatagaacaagtggtgtgtgaactcttttcaatcattgttgtgtataatttagctctcattaagaaagggctaacaaattatacgctgccaaggttttagggattctggacgacaacaaaaagaaaattccttcaggtgaagaactaaaaagctggggtatctgataaggtacttgatgcaggggtgactagttatgcggctaattggataatcggaggatgaacagggctagagggggggatcagaagaatcactggacatgtatttcactgagctatgaatgagtaaggacgatagttttgatgaggagaaaaagggaaaatatgtgaggggaccatggaacaaagtgagagaagaatagtagtctgttttttgttaac

SEQ ID NO: 636422 - DNA, 252 bp, Homo sapiens
ctttaatcaaagacaaacagcgctaactgtatctaccttagacaaagacaatccgccctctctattaagagacctacgctatcttcttttccagctactatagcactcaccagtaagagcctcctgctccgccctcttcttctggcggtacctagtggctagctgtcttgtttagctaccataaatttcagcttcttatccagtttctcaccctttacttttgctgctaccatcttctctccaggaggatcg

SEQ ID NO: 636423 - DNA, 785 bp, Homo sapiens
ctaataacggcacaccaagcagcatctcacgtcttcgaaactgtctccgactctaagaccccttccaacaaccaggctaggctcccctatatatgctggaaactaccccctgactctgagaggtgaccatgtaaccacctacatctgtgtgggcctttaaagagctgggccctggacttagtgaagaccgatttcagaagaggaagccaccataactttaccagatggcttcccctgcctgccttgaaggttttgttcccaactctgggtggcacccgagttcagagttcttcagaccggttagccctattactttctacagcccattcaccctccctgggcccttacttactcccgcacttctgcctcactcgtatcttatctgatgtgacctcccaggtctacctcatgctccttctgcctgtttggaagagctttagcgccagctatgagttctatcggtactttgagaactcagccacccagtccagtacccccagtgtttaccccaaactccaccagaagtccagagaactggataatgttctaccaaccacgccagtgcgtagcttgccagctcccatctgaaagccattactgaatgaggtaataattcttgaagatgaacttgaaaagcttgtttgtactaaagaaaccccagaactagtgtcagaggcttatcccctcctaggacaagaaattttaagttgattcagccccacgttcaagccagccaccattgctgggaagaggccctttttcaggtcgaccaactgctacgaaga

SEQ ID NO: 636424 - DNA, 738 bp, Homo sapiens
aagactttggatgccccactcccgggaactgttggcgtgattgccccgggctttcccagacatcatccgcctttactggcgctcccaaaggctttgggcaaggtcatccctgagctgacgggaagctcactggcatgccttcccgtgtcccccactgcccacgtgtcaatggtggacctgacccgccgtttagagaaaacctgcgccaagtattgatgacatcccacgaaaggtggtgaagccacggccttccgtgagggccccctccaaggggcactcctgggctaacacactgaggcacccacggtggtctcctctgaccttcacacacgcgattcaacccacctcctccaccctcttgagacgctggggactggcacattgcccctcgcaacgagccaccttgtgtcaagcgtcattttcctggtaatgagcccagcgaaatttggctacacgccaacacgggtggtggagcctcactggcccaccactggccttcccacaggaagtaaagagcccctggagccacccacgcccccagcacagagcaaccacagaaggaaagagagaaaccctcacactgctggggaagtccctgccacactcagtctcccccacacaccactgaatttcccctcctcaccgttgcccatgtagaccccttgaagaggggaggggcctagggaaccgccccattgtcatgtacccatccaataaagtaccctgtgctctaacaca

SEQ ID NO: 636425 - DNA, 376 bp, Homo sapiens
gctgccatgggactttcagcccccagttgcttatccaaatgtgacagagctggacccaagccaggttgcacacttctggattgggataacctgctctccctgggaaagtcggccgagggcccaaagctgcttaggggtttgaggttggtgcccccccccaaaatagtgcgttttctgcccctccctgcccgcgtttcagggcctcggtccatagaaaacaccccccccatggccaggtggaagggtttattagtccctgccagcaactgtcctccctggtgcagttggcctggccagccccctggattggggacgggccaggctgggccaggtcgggggctcagtttgggaggtaataaaagcagtcccaccccca

SEQ ID NO: 636426 - DNA, 410 bp, Homo sapiens
gacagatgggtcggtatgatgcaggataggaggagagggatacacaggagcaggaatatcaggtggaagggatcttggtgagcatacagaaggcatagtcaacacacccagctttccttcagaaccacctcttttcatcagcccggaatctctataaatagtgctggactgccatgatctgatggtagctgtcagaggcatctggaactcatggccgggttaagaacaagtgggaaggtctcctttcccccttttctctttcttttacccttctcccctctctcttcctctcagccttacccccaactctagtctttcttggcttctagtgagcgagcaggagatgctctgagagtcaactgggaatgcagctgataagggtctgctgggtgcaggaaatgtcggaaggt

SEQ ID NO: 636427 - DNA, 115 bp, Homo sapiens
gtatatcgagcatgttgtgactacctacaatcacagaatgcagatacttaaaccactgaggaaggcagtagatcgaactagcatcccgatggataactagtaccgattcgtcccc

SEQ ID NO: 636428 - DNA, 116 bp, Homo sapiens
gaatcgagctcggtaccggtgcgtggggatgctggtacaagttgtgggactgcatgctactgtctagagcttgtctcaatggatctagaacttcatcgccccccccccaagtgcct

SEQ ID NO: 636429 - DNA, 221 bp, Homo sapiens
tccccagcctccagctgcagtacgtcccactgaccttcactccaccacgcagaccactgcaaggagttcctggaaggcctgccggtagctagcactgaagactatatattctattggtataagccgtccccttaaggggaagggaaatcaaatataatatttactcgttagacataaggaaatttaaggaaagagacagcttgcttaacagatagtcgcgc

SEQ ID NO: 636430 - DNA, 357 bp, Homo sapiens
cgactgtggtctgtgatgaggtgaaatgagatgcatgcagactctggtcccctgccaaagtgggctccaagaatgtcatccctgccctgggaactggtggatgccccattaagaatgcacgaggtccctggcaaagtctgactgtttacttgtgatggtgtgtgatattcctgcgtgaagcgaggctgaccaagtctgcattgactaacaacaacgactgatgaaagacaatactcgagcgcttttcgacaacaatgtgctcttaaagctgccgtaagtcccgtgtctggaatgagtgccagtgagcgttggtaggacactgtacaggcaggctctcatccttgtctcatccctgct

SEQ ID NO: 636431 - DNA, 183 bp, Homo sapiens
catatggggctggatcatcccctggagtgggacgtgtcatgtgcatagtagcatatatttagcaacatccctggactccctgcaccagatgccagatagcagtccccttcccccaagtagtgacaattaaaaaaatgtgtctagatgttgctagtgtccctggggagacagaagtggtccccg

SEQ ID NO: 636432 - DNA, 226 bp, Homo sapiens
cggctgactgagtctatatagaatcctgcctccttttacagagttagaaagagaatgccaaacactccaaaaccagatccaaatccagagtgagggatctattcaggccccagagtactgcacagagctatctgatggattctcagctcagttgcgactaattatagaaaagcctgttggaagacatgaattcagcagagggtgctattagtgcccagttggtacc

SEQ ID NO: 636433 - DNA, 140 bp, Homo sapiens
ctatttcgatacacggtgctataacgataccacggtgctatacgataccacggtgctataacgataccacggtgctataacagataccacggtgctataacgataccacggtgctataacgataccacggtgctataacg

SEQ ID NO: 636434 - DNA, 633 bp, Homo sapiens
gctgggtgcagtggcttgtgcctgtagtcccagctacttgggaggctgaggcaggagggttgcttgagactagcctaggtaacatagtgagaccctgtctcattaaaaaaaaaaaaaaaggcatggtggccgcactgtatcccagctactcaggagactgaggctaaagatcctttgaacctaggagtttgagaccacctgggcgatatagtgaggccccatctcaaaaaaaaaaaaaagcggggggggggagttggcgctgtgtttgaaattgggccgtgcagcccaaacaaacaaggggaactaggaccgacagtgactttcaccagtcttgttaggtcacacattgaggaggactggcggggctctgtcatacctgttgcttctacaagactcccttattttgactgtaaaaagctagcgctaatactcactgtgttctccaatcccaggtagccattggtagcagctgtgggttaggaggttgagcagctgccccaggatccaagttgtggtgctctgaactggcaagaacctagggcaacccaggaaaggccgctgatctgcctttataagcccagtcatctgaaaattcagggcctgcctgcaaggacaggaatcccccaaaaaaac

SEQ ID NO: 636435 - DNA, 365 bp, Homo sapiens
atcctctttgatcaacagcggaggcgcaaccttgataatgtcgccatgggttggcttgcccaagagtccattatctcgaagttgtagacacaccttccttctcgcgccagtcacaccttcaagaggtagcttcatgagttcttttctcaagataatgcccattttgtgcgcttttctcacgcaaggttttcttcttataaacctctcaagggttgcgatggccactcgacagcatagtggattgcccgtgtatgtggacccgtgctcctgtggtttaatggtcagcatgatgtctttatcacacagcagtgcagacacagggtatgagcccacagagaggctctttacgaggaggtatatctcag

SEQ ID NO: 636436 - DNA, 139 bp, Homo sapiens
atagaactagatgcaagaattgaacgtaattgcccctcgtgtaaacattttttcccaaaaaagttagcatcgaatcttggagtgcactacatgagttatgggaaggagcatactgaaataatggacacgaattgtttca

SEQ ID NO: 636437 - DNA, 1027 bp, Homo sapiens
  misc_feature (258)..(258): n is a, c, g, or t
catggctccagtggagcacgttgtggcggatgctggggctttcctgcggcagtgcggctctggaggagcatcgggaagaacatttacaccatccgggaggtggtcactgagattcgggacaaggccacacgcaggcggctcgctgtcctgccctacgagctgcggttcaaggagcccttaccgtgaatacgtgcggctgggttaaggtgagctcagtcgattcacgcacccgatgaaagcaccgtcgtgcacatttcntggtttccatcgtgcctctacaaggcctaagacccccacaacgaaacagaacacaaggatcactcagtcttgttgagcctgagtaacctggcaattgtgagttcctgtcatcgttactggatgacaacgcctttgctccaaacatacgagtcactgaatctgcgatggatgcgtagctgattgtacaggaggtgacggacgataccaaggtgagagaggcaggcagcgaggaacgaagaacgcggttgtgcacagacagcaaacaagatgacgagctgatgactgacaggggagtgggctggtatagaccccgcagtgagacatcagagcagaatcccagcacggagcctggagcacgtgtgacagtcccgcgacggacgctgctgggttggctagcctgtaccatcagacttcgcgcatgcgagaatgttcctgcgtgcagcatgggcgctgcaacgtgctaggacggtgaacaggcatgctagattccgtgatggcccgtagctacagtcttgctgctgccatgggctgtttcaaggacaacgtctggacatgagcgcgagtgttctgctcacacttgtgggaacaagatcctgaagaaaagtgtccgtgaccagtcagcgacgacggcacctgcacattgcacgttctccctgaacccaaggtgctgaaccccgaggctccggtactcgcttcccatcccaaagggggccaatacgcatcaaccccatctcaccgaggatccgcgcttccttcagtgcgattctcg

SEQ ID NO: 636438 - DNA, 259 bp, Homo sapiens
  misc_feature (44)..(44): n is a, c, g, or t
gggaaggctgaggcgacggctcacctctgaagtcgagaagtccngaagacccagtcctggactaacgtggcgaaaacctgtctctactaaaaatacaaaattagccgagtgtggtggcgcaggcctgtaatcccagctattcgggaggctgaggcaggagaatcgcttgaacccaggaggtagaggttgcggtgagccgagatcgcgccattgcactccagcctgggcgacaagagtgaaactctgtctcagaaaaaaa

SEQ ID NO: 636439 - DNA, 319 bp, Homo sapiens
cttcctcacaacattgctcaaaaatggccttcctcaggctcccagctgacatgtatccaccaggaatccactgctcttgtctcttgctgttctcccagcaggaccaggcttcggccgagaggcgggtgccctgagtaaatgggagaccatgactggattacagaccccgttctagggataagatcagagtcataggctggctaaagtaataaacagacctttttgttctctatgtcttttattcctactctctgccccaagaaaacagggttcccagaaaaatggggtttttacagcttttgactgcctggtaccccat

SEQ ID NO: 636440 - DNA, 215 bp, Homo sapiens
aaaattattgataagctgaatgaattaaaatttaagtataactaaggtagtatattttaaatgtgactgtacacatatgaaaatagtattctttctttaaaaaaaatcttgggcctggtcttgaactcctgggctcaagtggtctgcccacgtcagtctcccaaggtgctgagattataggcgtgagccaccgcacctgcctggtttctttactt

SEQ ID NO: 636441 - DNA, 157 bp, Homo sapiens
ctgagggctacctagagtatgctaaccctcagcagctcattagcatacaaaaggacgacacttttgaaatggtaagggttttaggagttgtatgtcaggaaacaggttgaagaccaaatatgtatttcacagtatcacagttacagctggaatttca

SEQ ID NO: 636442 - DNA, 735 bp, Homo sapiens
  misc_feature (41)..(41): n is a, c, g, or t
  misc_feature (63)..(63): n is a, c, g, or t
  misc_feature (207)..(207): n is a, c, g, or t
  misc_feature (218)..(218): n is a, c, g, or t
  misc_feature (229)..(229): n is a, c, g, or t
  misc_feature (294)..(294): n is a, c, g, or t
  misc_feature (321)..(321): n is a, c, g, or t
  misc_feature (349)..(350): n is a, c, g, or t
  misc_feature (356)..(356): n is a, c, g, or t
  misc_feature (359)..(359): n is a, c, g, or t
  misc_feature (372)..(372): n is a, c, g, or t
  misc_feature (395)..(395): n is a, c, g, or t
  misc_feature (398)..(398): n is a, c, g, or t
  misc_feature (402)..(402): n is a, c, g, or t
  misc_feature (406)..(406): n is a, c, g, or t
gggcgcgcgggtagtgaggcgtcgtccgtactggaggctanctcttgtcgcggcgcgggagtnacatcgtttccaatctgtccgcggtgcgcaccaagacagagccagaatgtcaggatgctgaacagcagttttgaggatgaccccttcttctctgagtccattcttgcaacccgagaaaatatgcgacagatgataagaagtttnctgaacccttnggaagagactngctcagtatctctgatggtagagggagagctcataatcgtagaggacataatgatggtgaagatncttgactcatacagatgtcagctcttnccagacaatggaccaaatggtgtcaccnnatgagnaanctatatgcagaanttagaaagaaacttcggtcaacnttncagntggntccaaatggacattcatttgggttctttcctcagttatgactttattccaaaattagggagatgaaccggcaaagttttttcagggcctcaactcaaaattcgtcgagctccccaggagcgcatttaacgggaaaacccggaaagcacttgagagatatctgacgggggcttaggaacaaatgggctatgggtcctcatttccatgaccgagctcatgtccttcacaagtcacgcaccacgtcagactgacttgaagaggcaaccagggtcaccactttgatggacgtagctcagctagatgggagggcactgcggttggggccacccg

SEQ ID NO: 636443 - DNA, 907 bp, Homo sapiens
  misc_feature (190)..(190): n is a, c, g, or t
cagagttatagaacgagaaacttccagtctatcaggtcacgaatgcaagaacacaagtcagatttgaaaggctacaaagcctggtgctgctcaacattaccagagcctgcaatctgcggagactcagtcgaatatgggtattcagtcatgatgcgtcggaatgaaaaattagcttctcgcactgattganatgcctatagtgacgtaactcttatatagtggctcatatttgagcacaagaaggaaattgctttctcagatcccactcctgatggaaagctgtttgcaacacagtactgtggcactggtcaatttctggtatataattttcattattggcacagaatagcacgtacaagacaaattcttgcctacaccactagaagacttctattgcacgagaatggattggttgctgactttaaccaggaactagggccattctgattcacacatgaactcaggactggcaactaaccatatggttcgttccattttcagtaaacattggaaacaatgcagtaatagcttattgttgtggttgttcttgaaagaagatatttcattatcttttacagaaatttatgattgatgtattttatctatagttatttagacatgtttacttgcatgcagataattcgttcatagtggactgaaaactaatgcaaggactatggtctcagtgataagtatatttcgaagttcttaatatggcaatataccagtgtacgcttggtactgtattgttgtataattgatctgctgataccagtgataggcttacagatcgtatttgcacagagtggaaagcactttccaagttattgtccaggagggtgcactattaagtgtcgggaattcgaagcttatctcacaggcctgaacaatatttgaagaaccccta

SEQ ID NO: 636444 - DNA, 389 bp, Homo sapiens
  misc_feature (72)..(72): n is a, c, g, or t
taagcagcagtgtctgcctcaagaaagaaaaaaaaaaacttttcaaatatacttaatacatgaaaatactcncgatgcaaaataagaaaatagttatgggcccagcacggtggctcacgcctgtaatcccagcactttgggaggccaaggcaggtggatctcttgaggccaggagttcgagaccagcctggccatcatggtgaaaccccatctctactaaaagtacaaaaattagctgggcatggtgacatgcacctgtaatcccagctatgcagaaggctgaggcaggagaattacctgaacccaggaggtggaggttgcagtgagctgagatagcgccactgcactccagcctgaaccacacagcaagactctgtctcagaaaagaa

SEQ ID NO: 636445 - DNA, 170 bp, Homo sapiens
  misc_feature (57)..(57): n is a, c, g, or t
  misc_feature (145)..(145): n is a, c, g, or t
tttttttttcctaaggtattttagccatccttatttcttcttttcagaatggtatantcctgttgtatatccattttgatatcttaatgatttataaccctttataaaaatagaatgagtgctaatcctttgttatgtgtactanaaatacatatttttttccagtctga

SEQ ID NO: 636446 - DNA, 206 bp, Homo sapiens
tgtgtagacgggttctcacagatgttggtgtgcgtggtcttggaactaccgtggctcgtgattcggcccacttcggctcccgtgtagtgtggattacaggcatagagactactgcgacccaagcgatttagtattttaagtagagacgaggtacacctacgttggtcagcctggtcttgaactcctgatctcaagtgatccgccca

SEQ ID NO: 636447 - DNA, 465 bp, Homo sapiens
  misc_feature (405)..(405): n is a, c, g, or t
aggatccatatatatttagtgggaattataccaatacggtatgtgactttggagtcgggctggtttcacttaaggtaaggttttcaaggttcattcaggtggtagcatgtataaatacttggttcatacagatgtggcatatctggttaagtttatctaaggtattttattagtactgaatcttttaagataataggttggttatttatttatattcaatcatctcacttctcttacggttggccaggatttcttagtggaggctctggaattttcacctccttacttttcttatttaagacttcggtttcttctaactccacgggctagtacctctagaacaaggttaactaagtgtgataaggacatccctattgtgtttcttttctttttaggttttgggtntgagacggagtctcactctgtcgctaggctgcagaacgagacaccgtctccaaaaaaaaa

SEQ ID NO: 636448 - DNA, 694 bp, Homo sapiens
atgcaaaaaaaaaaaataaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaataaaaggaaaaaaataaaaaaaaaaaaaaaaaaaaatttttcggcccctttcccccaatatcctttaaattttgccaactttttcccttggccccaaattcgggtttatttggccaaattccccttttagggggcccttaccaaaaaacgtgcccagcttttaaaaaccctgaatggggaaaacccttgggtaccccaaatatatggctttgggaaaaattccctttttgccaaatggggtaatttttaaagagccccccccaaagggctttaccaaaatttggcgccctcaaatggccatgggaaattttaagcggtaaattttttttaaaaagcgggcaaaatttttggaaaaagaacttcatttttaacccatgggcccaaatttgcaaaaccctttttaaaataaaagaaatctccccttaagggtttattgggtccccaatttgcaaaaagaccccttttaaaaactcggggctcccacttaaaagggcaaccctttttctgggggggcccatattggactctatccctcagttttttgggttggggttccc

SEQ ID NO: 636449 - DNA, 3613 bp, Homo sapiens
  misc_feature (1113)..(1113): n is a, c, g, or t
agcggatgcgctgtgcgcccggccggcgtggctggctgtttgaggactgcgcgcggagctccgtggcgggtgtctgaagtcgtgagtttactgcttgtaaggaacatagcgatcactgggaacctggaagtagagactcctttctgccatccatccgtccctcgggctgctgcgaatccccccgccggcctccaggaccccgggctgactgaacgcccgcaccggtcccgccgccccagggcccgctacgcgcccggcataatgggagaaaaatcacgacggaaaggcccagcccctcgccatgcagacgggaagcttggccgcacgtgtgatcacccttacgccccttggagtttcaccccctcttcgcgggctccaacagcctgggtcaggcctccttgtcctgtgtgggcctctcggctgcaagaacacagtcccgagccccggcgagcccgcgcgcctcccacccgccgtgcacaggctgcactttacgccccagcactgcgcctgcgggaccatctggatcgcttttccattctgatgacgtcctgtacttcgtggctgcaggctcctcaagccccaggtctgtgcagagacgagcaaagcagcagaatatccgtgccacagctttctggagcacccattttactaccagatttggaaggaacgaagttaagtaatttccaggaatcatctcccctgccccacaaacatgaaagaaaagacaagagaagcaccccagaagaggaggggagaagtgccccagaaaaaatcatccagtctctgaagctttgcccaggtgggcacaggccagccagcctctcctctggttgcccagctggctgcaggctgtcatttaaccttccgcccagcatgcttttgagtgtgcagaagtgctgcatgccctcttctttgaaaacctgttgagcaaatgcctccgcattttatgcaccttcaacctccacagccaaaggcccccaagaccaaacatgctgtgcacacacagcagctctttgtgtcccactcctggccgatctcctgcatcatctcgttgagcttcattgaaccccgcagtctgcatgctctgtggaactcagggtcttcattttgcangaaactcagggtcttcattttccgtggaactcaaagtcttcttgctctgtggaacttggagtctcagggcctttgtgctccatggaacttggggtctgtgtgattcatggaactcagaatccttgtgctctgtggtactcagggtgtgcgtgctctgtggaactcggggtctgcatgctccatggaaagcaccaggatgcacttgaccccccacacccatacatacatccttcattttattcctggccctcacctgtccactctgtgaggcttcttcacccccactctcctttgagctcatgccgggtctttcagactggcctgaagcatgggtgttcgtaggggggagtggctgatgtcacaccttcaggcaaattctgctagtgtcacacctgatggagctgcctagggaggatgtttccttggaggatgcgccctggcagccactggcttcttacggtgcctgcactgctgctgctgccatgggggtgccacagggccacactgggggctgttctggaattggtggttttcatttccaggttaggtagggactggcaggcaccttggctgtccttgtggcttctgtcttgaccctggtcctccccaggcagctgattttctgggctgctgctcttccaggaagaattaaaggtgggaatggctgaaacctcagctttggattcacagagaccctaggctgtgtcatgcagaaagggaaaggattgcagatggtggtgggatcagccgaaggcagggccttcactgtgatgctggagccctccatgctgggatgtttgcatacagcccaggttcagttcggtggtccatcagcgagtcctggatctggtctcactcacaagccatggacaacatgagctcagtttgccaggactcttggggttagggagagctcagcatccgggtggctctggttccttctcatgctgaaactctgctggtgttcctccatggggcaaatgtgggtttttctgaggtgcccctcttgctggagttgaggatgagaaatgttttcagtgggtttgcaccctccacacatatgtaagaggtgttgtgtttcattcctgtcaggatccattgctgcagcttcctgaagttgtgtccgttaaaaggcagggacccggtgtccaggctacagagggtgactccaggttccacaccaccactgtggaccagtgtgcctatggacttaggagagttcccagatcgcacaagggggctgccccagagggtgttcagcttgttgccaacagttgctgaagccaaagtctgcaaccttgatgttcaggtcaagtagccagaaacaggtgttctggctttaggtccctgtggacaatgccattctctccttcccaggctactgatgtcctgggttgctcctcttatggtagaagctcaagatggaatggctggagcttggctgcctccggttagagcctgggctctgtattgcagacatcacctggcagaattcctcatgggccccttttgtcgtgggtgcgactgctgggccagggttgtcgtgggtagtaaaggtatttaccaagacaaccgtgagtaaagaaaggcaaatttattacagaaactatgaaaatacattgcaagaatgcaacatgcagcacagcagagaaggggctgtctgcaaagataaagggctggagggaagttttctaaggttgtgctggacggcgctatgtgcaggtgagcttgtgctatatgctaagaatatgttggaataattttaactgccagacctttcctcttctggtgcccgagggaaacgccctgctgcttttagctgtcttgtaacccacacgccttttcacttctgaagttgcaagaataacggctgtggtttttcacacaaaagggttgcagactgggttaggtccctgttccgccaacctggctgtttcccagtttcagttaacttagtggtttactagagccccacacctttctctttcatatggccatgatccaggaggtaatccgtcacctcccctccactagagtgctccatggccagggataatccgtcacctcccctccaccagagtgctccatggccaggggtaatcctcacctctcctccgctagagtgttccatggccaggcagtgtttcctgggtccagagcacctcaaacaatttcagtgttgtggtgactcagggccttcaccatacagacttgacagcatagtctagaggctggaggggctctgtgactcccattaatgacagtcactgccacggtttccccaggcaggatgtgccaggagaactgctccatgttggctcagcagaatgttattataggtagctcaaaaagagagggaacagggcttctctagattatttcagggaacgagctattatttgaatgttaatttaagactattttatcaattaaaaatgtaaggcccaagaaacttcagtgaggaagaatgaacaaattgaataaatactgttaaacttta

SEQ ID NO: 636450 - DNA, 413 bp, Homo sapiens
  misc_feature (150)..(150): n is a, c, g, or t
  misc_feature (182)..(182): n is a, c, g, or t
  misc_feature (187)..(187): n is a, c, g, or t
  misc_feature (212)..(212): n is a, c, g, or t
  misc_feature (278)..(278): n is a, c, g, or t
  misc_feature (295)..(295): n is a, c, g, or t
  misc_feature (309)..(309): n is a, c, g, or t
  misc_feature (402)..(402): n is a, c, g, or t
agtgtcatggaggcctacgagcaggtccaaaagggacccctgaagctgaaaggcgtcgcagagctgggagtgaccaagcggtgaggcccgagggcccgcgggattccgtcttcatcccccttagaccttttctcgggacccctggccctnatcctccgaccggccgcctcctcatgtctttntccangaaaaagaaaaagaaggacaaaganaaagcgaaactcctggaagcaatgggaacgagcaaaaagaccgagagagagagaagcaacacggcntggaaaagaggaccccnacccaggcagcctncgagaaatgcaggagaagcggcaaatggaagaatcctaaagaaggcatccaaaacccacaagcagaagtggaggacttcaacagacacctggncacactcacag

SEQ ID NO: 636451 - DNA, 3707 bp, Homo sapiens
  misc_feature (777)..(777): n is a, c, g, or t
  misc_feature (1207)..(1207): n is a, c, g, or t
agcggatgcgctgtgcgcccggccggcgtggctggctgtttgaggactgcgcgcggagctccgtggcgggtgtctgaagtcgtgagtttactgcttgtaaggaacatagcgatcactgggaacctggaagtagagactcctttctgccatccatccgtccctcgggctgctgcgaatccccccgccggcctccaggaccccgggctgactgaacgcccgcaccggtcccgccgccccagggcccgctacgcgcccggcataatgggagaaaaatcacgacggaaaggcccagcccctcgccatgcagacgggaagcttggccgcacgtgtgatcacccttacgccccttggagtttcaccccctcttcgcgggctccaacagcctgggtcaggcctccttgtcctgtgtgggcctctcggctgcaagaacacagtcccgagccccggcgagcccgcgcgcctcccacccgccgtgcacaggctgcactttacgccccagcactgcgcctgcgggaccatctggatcgcttttccattctgatgacgtcctgtacttcgtggctgcaggctcctcaagccccaggtctgtgcagagacgagcaaagcagcagaatatccgtgccacagctttctggagcacccattttactaccagatttggaaggaacgaagttaagtaatttccaagagatggggtctcactctattgtccaggctgatcttgaactcctagcctcaaacaatcctcctgccttcagcctccccaagtgcggtatnacaggaatcatctcccctgccccacaaacatgaaagaaaagacaagagaagcaccccagaagaggaggggagaagtgccccagaaaaaatcatccagtctctgaagctttgcccaggtgggcacaggccagccagcctctcctctggttgcccagctggctgcaggctgtcatttaaccttccgcccagcatgcttttgagtgtgcagaagtgctgcatgccctcttctttgaaaacctgttgagcaaatgcctccgcattttatgcaccttcaacctccacagccaaaggcccccaagaccaaacatgctgtgcacacacagcagctctttgtgtcccactcctggccgatctcctgcatcatctcgttgagcttcattgaaccccgcagtctgcatgctctgtggaactcagggtcttcattttgcangaaactcagggtcttcattttccgtggaactcaaagtcttcttgctctgtggaacttggagtctcagggcctttgtgctccatggaacttggggtctgtgtgattcatggaactcagaatccttgtgctctgtggtactcagggtgtgcgtgctctgtggaactcggggtctgcatgctccatggaaagcaccaggatgcacttgaccccccacacccatacatacatccttcattttattcctggccctcacctgtccactctgtgaggcttcttcacccccactctcctttgagctcatgccgggtctttcagactggcctgaagcatgggtgttcgtaggggggagtggctgatgtcacaccttcaggcaaattctgctagtgtcacacctgatggagctgcctagggaggatgtttccttggaggatgcgccctggcagccactggcttcttacggtgcctgcactgctgctgctgccatgggggtgccacagggccacactgggggctgttctggaattggtggttttcatttccaggttaggtagggactggcaggcaccttggctgtccttgtggcttctgtcttgaccctggtcctccccaggcagctgattttctgggctgctgctcttccaggaagaattaaaggtgggaatggctgaaacctcagctttggattcacagagaccctaggctgtgtcatgcagaaagggaaaggattgcagatggtggtgggatcagccgaaggcagggccttcactgtgatgctggagccctccatgctgggatgtttgcatacagcccaggttcagttcggtggtccatcagcgagtcctggatctggtctcactcacaagccatggacaacatgagctcagtttgccaggactcttggggttagggagagctcagcatccgggtggctctggttccttctcatgctgaaactctgctggtgttcctccatggggcaaatgtgggtttttctgaggtgcccctcttgctggagttgaggatgagaaatgttttcagtgggtttgcaccctccacacatatgtaagaggtgttgtgtttcattcctgtcaggatccattgctgcagcttcctgaagttgtgtccgttaaaaggcagggacccggtgtccaggctacagagggtgactccaggttccacaccaccactgtggaccagtgtgcctatggacttaggagagttcccagatcgcacaagggggctgccccagagggtgttcagcttgttgccaacagttgctgaagccaaagtctgcaaccttgatgttcaggtcaagtagccagaaacaggtgttctggctttaggtccctgtggacaatgccattctctccttcccaggctactgatgtcctgggttgctcctcttatggtagaagctcaagatggaatggctggagcttggctgcctccggttagagcctgggctctgtattgcagacatcacctggcagaattcctcatgggccccttttgtcgtgggtgcgactgctgggccagggttgtcgtgggtagtaaaggtatttaccaagacaaccgtgagtaaagaaaggcaaatttattacagaaactatgaaaatacattgcaagaatgcaacatgcagcacagcagagaaggggctgtctgcaaagataaagggctggagggaagttttctaaggttgtgctggacggcgctatgtgcaggtgagcttgtgctatatgctaagaatatgttggaataattttaactgccagacctttcctcttctggtgcccgagggaaacgccctgctgcttttagctgtcttgtaacccacacgccttttcacttctgaagttgcaagaataacggctgtggtttttcacacaaaagggttgcagactgggttaggtccctgttccgccaacctggctgtttcccagtttcagttaacttagtggtttactagagccccacacctttctctttcatatggccatgatccaggaggtaatccgtcacctcccctccactagagtgctccatggccagggataatccgtcacctcccctccaccagagtgctccatggccaggggtaatcctcacctctcctccgctagagtgttccatggccaggcagtgtttcctgggtccagagcacctcaaacaatttcagtgttgtggtgactcagggccttcaccatacagacttgacagcatagtctagaggctggaggggctctgtgactcccattaatgacagtcactgccacggtttccccaggcaggatgtgccaggagaactgctccatgttggctcagcagaatgttattataggtagctcaaaaagagagggaacagggcttctctagattatttcagggaacgagctattatttgaatgttaatttaagactattttatcaattaaaaatgtaaggcccaagaaacttcagtgaggaagaatgaacaaattgaataaatactgttaaacttta

SEQ ID NO: 636452 - DNA, 3693 bp, Homo sapiens
  misc_feature (1113)..(1113): n is a, c, g, or t
agcggatgcgctgtgcgcccggccggcgtggctggctgtttgaggactgcgcgcggagctccgtggcgggtgtctgaagtcgtgagtttactgcttgtaaggaacatagcgatcactgggaacctggaagtagagactcctttctgccatccatccgtccctcgggctgctgcgaatccccccgccggcctccaggaccccgggctgactgaacgcccgcaccggtcccgccgccccagggcccgctacgcgcccggcataatgggagaaaaatcacgacggaaaggcccagcccctcgccatgcagacgggaagcttggccgcacgtgtgatcacccttacgccccttggagtttcaccccctcttcgcgggctccaacagcctgggtcaggcctccttgtcctgtgtgggcctctcggctgcaagaacacagtcccgagccccggcgagcccgcgcgcctcccacccgccgtgcacaggctgcactttacgccccagcactgcgcctgcgggaccatctggatcgcttttccattctgatgacgtcctgtacttcgtggctgcaggctcctcaagccccaggtctgtgcagagacgagcaaagcagcagaatatccgtgccacagctttctggagcacccattttactaccagatttggaaggaacgaagttaagtaatttccaggaatcatctcccctgccccacaaacatgaaagaaaagacaagagaagcaccccagaagaggaggggagaagtgccccagaaaaaatcatccagtctctgaagctttgcccaggtgggcacaggccagccagcctctcctctggttgcccagctggctgcaggctgtcatttaaccttccgcccagcatgcttttgagtgtgcagaagtgctgcatgccctcttctttgaaaacctgttgagcaaatgcctccgcattttatgcaccttcaacctccacagccaaaggcccccaagaccaaacatgctgtgcacacacagcagctctttgtgtcccactcctggccgatctcctgcatcatctcgttgagcttcattgaaccccgcagtctgcatgctctgtggaactcagggtcttcattttgcangaaactcagggtcttcattttccgtggaactcaaagtcttcttgctctgtggaacttggagtctcagggcctttgtgctccatggaacttggggtctgtgtgattcatggaactcagaatccttgtgctctgtggtactcagggtgtgcgtgctctgtggaactcggggtctgcatgctccatggaaagcaccaggatgcacttgaccccccacacccatacatacatccttcattttattcctggccctcacctgtccactctgtgaggcttcttcacccccactctcctttgagctcatgccgggtctttcagactggcctgaagcatgggtgttcgtaggggggagtggctgatgtcacaccttcaggcaaattctgctagtgtcacacctgatggagctgcctagggaggatgtttccttggaggatgcgccctggcagccactggcttcttacggtgcctgcactgctgctgctgccatgggggtgccacagggccacactgggggctgttctggaattggtggttttcatttccaggttaggtagggactggcaggcaccttggctgtccttgtggcttctgtcttgaccctggtcctccccaggcagctgattttctgggctgctgctcttccaggaagaattaaaggtgggaatggctgaaacctcagctttggattcacagagaccctaggctgtgtcatgcagaaagggaaaggattgcagatggtggtgggatcagccgaaggcagggccttcactgtgatgctggagccctccatgctgggatgtttgcatacagcccaggttcagttcggtggtccatcagcgagtcctggatctggtctcactcacaagccatggacaacatgagctcagtttgccaggactcttggggttagggagagctcagcatccgggtggctctggttccttctcatgctgaaactctgctggtgttcctccatggggcaaatgtgggtttttctgaggtgcccctcttgctggagttgaggatgagaaatgttttcagtgggtttgcaccctccacacatatgtaagaggtgttgtgtttcattcctgtcaggatccattgctgcagcttcctgaagttgtgtccgttaaaaggcagggacccggtgtccaggctacagagggtgactccaggttccacaccaccactgtggaccagtgtgcctatggacttaggagagttcccagatcgcacaagggggctgccccagagggtgttcagcttgttgccaacagttgctgaagccaaagtctgcaaccttgatgttcaggtcaagtagccagaaacaggtgttctggctttaggtccctgtggacaatgccattctctccttcccaggctactgatgtcctgggttgctcctcttatggtagaagctcaagatggaatggctggagcttggctgcctccggttagagcctgggctctgtattgcagacatcacctggcagaattcctcatgggccccttttgtcgtgggtgcgactgctgggccagggttgtcgtgggtagtaaaggtatttaccaagacaaccgtgagtaaagaaaggcaaatttattacagaaactatgaaaatacattgcaagaatgcaacatgcagcacagcagagaaggggctgtctgcaaagataaagggctggagggaagttttctaaggttgtgctggacggcgctatgtgcaggtgagcttgtgctatatgctaagaatatgttggaataattttaactgccagacctttcctcttctggtgcccgagggaaacgccctgctgcttttagctgtcttgtaacccacacgccttttcacttctgaagttgcaagaataacggctgtggtttttcacacaaaagggttgcagactgggttaggtccctgttccgccaacctggctgtttcccagtttcagttaacttagtggtttactagagccccacacctttctctttcatatggccatgatccaggaggtaatccgtcacctcccctccactagagtgctccatggccagggataatccgtcacctcccctccaccagagtgctccatggccaggggtaatcctcacctctcctccgctagagtgttccatggccaggcagtgtttcctgggtccagagcacctcaaacaatttcagtgttgtggtgactcagggccttcaccatacagacttgacagcatagtctagaggctggaggggctctgtgactcccattaatgacagtcactgccacggtttccccaggcaggatgtgccaggagaactgctccatgttggctcagcagaatgttattataggtagctcaaaaagagagggaacagggcttctctagattatttcagggaacgagctattatttgaatgttaatttaagactattttatcaattaaaaatgtaaggcccaagaaacttcagtgaggaagaatgaacaaattgaataaatactgttaaactttaaaagtaaaatcagaaaaacttcaagggggggcccgggtcccaaattcggccttatagtggagcggttttaccattcaatg

SEQ ID NO: 636453 - DNA, 4282 bp, Homo sapiens
  misc_feature (1113)..(1113): n is a, c, g, or t
  misc_feature (3659)..(3659): n is a, c, g, or t
  misc_feature (3679)..(3679): n is a, c, g, or t
  misc_feature (3681)..(3681): n is a, c, g, or t
  misc_feature (3686)..(3686): n is a, c, g, or t
  misc_feature (3691)..(3691): n is a, c, g, or t
  misc_feature (3694)..(3694): n is a, c, g, or t
  misc_feature (3714)..(3714): n is a, c, g, or t
  misc_feature (3717)..(3717): n is a, c, g, or t
  misc_feature (3723)..(3723): n is a, c, g, or t
  misc_feature (4271)..(4271): n is a, c, g, or t
agcggatgcgctgtgcgcccggccggcgtggctggctgtttgaggactgcgcgcggagctccgtggcgggtgtctgaagtcgtgagtttactgcttgtaaggaacatagcgatcactgggaacctggaagtagagactcctttctgccatccatccgtccctcgggctgctgcgaatccccccgccggcctccaggaccccgggctgactgaacgcccgcaccggtcccgccgccccagggcccgctacgcgcccggcataatgggagaaaaatcacgacggaaaggcccagcccctcgccatgcagacgggaagcttggccgcacgtgtgatcacccttacgccccttggagtttcaccccctcttcgcgggctccaacagcctgggtcaggcctccttgtcctgtgtgggcctctcggctgcaagaacacagtcccgagccccggcgagcccgcgcgcctcccacccgccgtgcacaggctgcactttacgccccagcactgcgcctgcgggaccatctggatcgcttttccattctgatgacgtcctgtacttcgtggctgcaggctcctcaagccccaggtctgtgcagagacgagcaaagcagcagaatatccgtgccacagctttctggagcacccattttactaccagatttggaaggaacgaagttaagtaatttccaggaatcatctcccctgccccacaaacatgaaagaaaagacaagagaagcaccccagaagaggaggggagaagtgccccagaaaaaatcatccagtctctgaagctttgcccaggtgggcacaggccagccagcctctcctctggttgcccagctggctgcaggctgtcatttaaccttccgcccagcatgcttttgagtgtgcagaagtgctgcatgccctcttctttgaaaacctgttgagcaaatgcctccgcattttatgcaccttcaacctccacagccaaaggcccccaagaccaaacatgctgtgcacacacagcagctctttgtgtcccactcctggccgatctcctgcatcatctcgttgagcttcattgaaccccgcagtctgcatgctctgtggaactcagggtcttcattttgcangaaactcagggtcttcattttccgtggaactcaaagtcttcttgctctgtggaacttggagtctcagggcctttgtgctccatggaacttggggtctgtgtgattcatggaactcagaatccttgtgctctgtggtactcagggtgtgcgtgctctgtggaactcggggtctgcatgctccatggaaagcaccaggatgcacttgaccccccacacccatacatacatccttcattttattcctggccctcacctgtccactctgtgaggcttcttcacccccactctcctttgagctcatgccgggtctttcagactggcctgaagcatgggtgttcgtaggggggagtggctgatgtcacaccttcaggcaaattctgctagtgtcacacctgatggagctgcctagggaggatgtttccttggaggatgcgccctggcagccactggcttcttacggtgcctgcactgctgctgctgccatgggggtgccacagggccacactgggggctgttctggaattggtggttttcatttccaggttaggtagggactggcaggcaccttggctgtccttgtggcttctgtcttgaccctggtcctccccaggcagctgattttctgggctgctgctcttccaggaagaattaaaggtgggaatggctgaaacctcagctttggattcacagagaccctaggctgtgtcatgcagaaagggaaaggattgcagatggtggtgggatcagccgaaggcagggccttcactgtgatgctggagccctccatgctgggatgtttgcatacagcccaggttcagttcggtggtccatcagcgagtcctggatctggtctcactcacaagccatggacaacatgagctcagtttgccaggactcttggggttagggagagctcagcatccgggtggctctggttccttctcatgctgaaactctgctggtgttcctccatggggcaaatgtgggtttttctgaggtgcccctcttgctggagttgaggatgagaaatgttttcagtgggtttgcaccctccacacatatgtaagaggtgttgtgtttcattcctgtcaggatccattgctgcagcttcctgaagttgtgtccgttaaaaggcagggacccggtgtccaggctacagagggtgactccaggttccacaccaccactgtggaccagtgtgcctatggacttaggagagttcccagatcgcacaagggggctgccccagagggtgttcagcttgttgccaacagttgctgaagccaaagtctgcaaccttgatgttcaggtcaagtagccagaaacaggtgttctggctttaggtccctgtggacaatgccattctctccttcccaggctactgatgtcctgggttgctcctcttatggtagaagctcaagatggaatggctggagcttggctgcctccggttagagcctgggctctgtattgcagacatcacctggcagaattcctcatgggccccttttgtcgtgggtgcgactgctgggccagggttgtcgtgggtagtaaaggtatttaccaagacaaccgtgagtaaagaaaggcaaatttattacagaaactatgaaaatacattgcaagaatgcaacatgcagcacagcagagaaggggctgtctgcaaagataaagggctggagggaagttttctaaggttgtgctggacggcgctatgtgcaggtgagcttgtgctatatgctaagaatatgttggaataattttaactgccagacctttcctcttctggtgcccgagggaaacgccctgctgcttttagctgtcttgtaacccacacgccttttcacttctgaagttgcaagaataacggctgtggtttttcacacaaaagggttgcagactgggttaggtccctgttccgccaacctggctgtttcccagtttcagttaacttagtggtttactagagccccacacctttctctttcatatggccatgatccaggaggtaatccgtcacctcccctccactagagtgctccatggccagggataatccgtcacctcccctccaccagagtgctccatggccaggggtaatcctcacctctcctccgctagagtgttccatggccaggcagtgtttcctgggtccagagcacctcaaacaatttcagtgttgtggtgactcagggccttcaccatacagacttgacagcatagtctagaggctggaggggctctgtgactcccattaatgacagtcactgccacggtttccccaggcaggatgtgccaggagaactgctccatgttggctcagcagaatgttattataggtagctcaaaaagagagggaacagggcttctctagattatttcagggaacgagctattatttgaatgttaatttaagactattttatcaattaaaaatgtaaggcccaagaaacttcagtgaggaagaatgaacaaattgaataaatactgttaaactttatgcttctttcagcaaatattttctgctcgtctctatgagtcaggcnctttgctagataacatacananaaacntagcntcnatccaatatggtgtgggtantgnatgtcnaatttaaaaataaaagtgctatataagaaacctctcagtgccctggaggcagggtccagagacatatcctgtggatgactggggctgaggtttaagggatgagcctcggtgatgagacagacgggagagggcaccctaggaaaagcgtcttcaggcaatcgtggttcagtgagctgcagccgtcgcgcaggagattgaggagcgcggcctatctggtgatttgctgtggttatgttctgtaaactcgccttgggtcctgaagtattgcttctggggaaacacagggtaaggttcctgcaagcctctggttgcaatattttcaactgccaaggcaccattcatgttccatgggttcattttccaacatccctgtaaaacaaggcagtcccatcagtgttgaaaactgctctccacatacccttttcccgtagagtacttcctgatctacagagctgccactcctgaaaagctaacactttccatgccatgctgccttttgaaaggtgccagccaggcagcattagctaaggcctcttttttgggttttncttcaacaaca

SEQ ID NO: 636454 - DNA, 758 bp, Homo sapiens
  misc_feature (39)..(39): n is a, c, g, or t
  misc_feature (46)..(46): n is a, c, g, or t
  misc_feature (278)..(279): n is a, c, g, or t
  misc_feature (281)..(281): n is a, c, g, or t
  misc_feature (283)..(283): n is a, c, g, or t
  misc_feature (285)..(286): n is a, c, g, or t
  misc_feature (288)..(291): n is a, c, g, or t
  misc_feature (296)..(296): n is a, c, g, or t
  misc_feature (298)..(298): n is a, c, g, or t
  misc_feature (310)..(310): n is a, c, g, or t
  misc_feature (376)..(376): n is a, c, g, or t
  misc_feature (407)..(407): n is a, c, g, or t
  misc_feature (417)..(417): n is a, c, g, or t
  misc_feature (438)..(438): n is a, c, g, or t
  misc_feature (454)..(454): n is a, c, g, or t
  misc_feature (457)..(457): n is a, c, g, or t
  misc_feature (459)..(459): n is a, c, g, or t
  misc_feature (461)..(461): n is a, c, g, or t
  misc_feature (464)..(464): n is a, c, g, or t
  misc_feature (466)..(466): n is a, c, g, or t
  misc_feature (471)..(471): n is a, c, g, or t
  misc_feature (473)..(473): n is a, c, g, or t
  misc_feature (476)..(476): n is a, c, g, or t
  misc_feature (492)..(492): n is a, c, g, or t
  misc_feature (496)..(499): n is a, c, g, or t
  misc_feature (512)..(512): n is a, c, g, or t
  misc_feature (515)..(515): n is a, c, g, or t
  misc_feature (521)..(521): n is a, c, g, or t
  misc_feature (530)..(530): n is a, c, g, or t
  misc_feature (535)..(535): n is a, c, g, or t
  misc_feature (540)..(540): n is a, c, g, or t
  misc_feature (544)..(544): n is a, c, g, or t
  misc_feature (560)..(560): n is a, c, g, or t
  misc_feature (584)..(584): n is a, c, g, or t
  misc_feature (587)..(587): n is a, c, g, or t
  misc_feature (597)..(597): n is a, c, g, or t
  misc_feature (607)..(607): n is a, c, g, or t
  misc_feature (609)..(609): n is a, c, g, or t
  misc_feature (618)..(618): n is a, c, g, or t
  misc_feature (623)..(623): n is a, c, g, or t
  misc_feature (633)..(633): n is a, c, g, or t
  misc_feature (648)..(648): n is a, c, g, or t
  misc_feature (660)..(660): n is a, c, g, or t
  misc_feature (662)..(662): n is a, c, g, or t
  misc_feature (669)..(669): n is a, c, g, or t
  misc_feature (671)..(671): n is a, c, g, or t
gggcctggcggctcctgcaggatcatgcagctggggcgnggcggcnggcatgcgacaccccaaccccagccctctaatcaagtcacgtgattctcccttcaccccgcccccagggcttcccttctgccccaggggggttcccggtggcttcaagttggggattggttaaaaataatctcggtataatatactttgaagttgaagacgtctgtgcctagcaatatttccagttgaccaaatattctaatcttttttcatttatatgcaaaagaaatagnntnangnnannnnttatngnaagagatacaangggaagagtgtaatctaaacttccttgtggtattaccttgtatgctgttacttttattttattccntgtaattaagtcacaggcaggacccagtttncagagagcangcggggcgcccagtgggtcangcacagggagcccggnccnancntanangcccngngcnttcaggaaagggcggncgtnnnncgtcctggaacgnctncgggtngcctacacnaggcnttaanctgnagtcgctagaaaactngctctcaaacttcagggtttttcntcnctcaaatttnggaccaaagncncattccggngtttngcctgcctcngatgctgggacccgnaaggcgggcgcncnggtcttngngctctttctagcgcccccgggtcctgtcccgggggctccccaggaccccctttccgaaaaagcgtgaacaagggggtaaatttttat

SEQ ID NO: 636455 - DNA, 601 bp, Homo sapiens
ggtggtttgcttaggcgcagacggggaagcggagccatagcatggcagtgggccgagagctgggtttgtctgcaaaacttactgtgagcccgcggagacctcattcgacgaaatctcgtctcgaccgaagagctgaacgctgagtcgggcgagtattggcgctccgcgatagcaaactgtgaggtctcggacgggtcgaatttacccgtggtcaagatccggctaaggccgcaccgggaaactgctggacgcttgatggagaaggacccacagagcgtctgttctgaacggcaagcagccctgctgcaggcgtgctgtgtccgctattgtgcggtgctgtgactgacgggcaaagatgacatgctggacttaacatccgtgaggacctgtaacgactacgaagggattctactctacgacgcagatcagctctgcgagaactccatgggtctctcagagctagggactttagggccaaacggtccaatactcgaacaactgcttcggcgattgcttagatacccggcaagtcaggccactactcaagcaccttccggaacgggtggaatcggggtggtgaaacctcgagcccaagaagggg

SEQ ID NO: 636456 - DNA, 355 bp, Homo sapiens
  misc_feature (1)..(1): n is a, c, g, or t
ntgtgtagtcccggcatccatgagacgtgattctcttcacacccggctttctctacatgagggttctatagacgtgaacaacctacagctcgtcattaagggtttctaactcggcggctgagacttattaaatgtcttgcagacacatctctaacaagcactccataagagcctcctccttattgaatacctccgtcgtgttccttcggtcccgcaccgcccggtcgagtgccatagcagcaccttttccaaggacgtgtttggtgtgcattacatatcttctccctcggctcccatgtttctctgaaactcccggtatgaagcctcgttaagacatcatacagtctcaaactct

SEQ ID NO: 636457 - DNA, 110 bp, Homo sapiens
cagtcttcctgcaggatcattaactttgaaccacactgtctacggaggctgccatctgatgagaatactctatcgcccctatcagaattttcagaagttggactaacgca

SEQ ID NO: 636458 - DNA, 504 bp, Homo sapiens
tcaagatggcggttggggggtgctcatttactcagcctgcccctgtctacccctcatgagagggagcatgtgagccaacaagtgcaggaactggagcgagtgcttttgggcactggcaggaaaaaaaactccatttacttggctcactgttctcaaccccttgtgggaggggacgtataggctatgggtatgggatccaactgaccgcttttgggcgcaggtgggagcaaactccatgcggacctgcagcagtgtccaggtagggatgcctgtgatctcggaagcctcagagggtgtgttatgatgctctttcagctctttttttttttttttttttttttttattacatattttttttttttttttttccatctgcggacagcgtaagtgttatcagctcagtggggcttttgcctcatcacgtgggcagttgcccttcagcccatgtgagggcagagggccagtgtgacagccttcctgggtcccctacccagtgcatcctt

SEQ ID NO: 636459 - DNA, 808 bp, Homo sapiens
tgcaggaattcgctcgagtgctaatatttcattgctgttacaatgaaaattcattaccgagttactggttctatgcgaccatggccgggcccctgcgcgccccgctgctcctgctggccatcctggccgtggccctggccgtgagccccgcggccggctccagtcccggcaagccgccgcgcctggtgggaggccccatggacgccagcgtggaggaggagggtgtgcggcgtgcactggactttgccgtctgcgaatacaacaaaaccaacaactacatgtaccacatccgcacgctgcatgtggtgcacaccctcaagcatatcgtatctggggtgaactacttcttggacatggagctgggccgaaccacctataccaaaacccaacccaacttttacaactatcccttccatgaccaaccacatcttacaaggaaagcattctactcttttcatatctacactttccctagacagggcacaatgaccttttctaaatccacctatcacgactcctatggatctataccagacttgcctatacctatcactctctattcacaccctcccacctcctatattccacccctttacatattatcccctaccttaacgaaagcttccccaatatcctctacctctatacacacatataaatcatccacaaacctttattactcacaatgaagtttcaccttcttcttccttctatctctattacctccgtatcatcccttcactcctcctcctcaataaatcttactgtttctataagaacaattctcacccctatcctcctcctctct

SEQ ID NO: 636460 - DNA, 162 bp, Homo sapiens
agatttcggactgatagatgaagtatcatattacgtccactagccaaatcactttatagactccatagaccgaagacctccatcatactaacctgacatcggaggacaaccagataagctacccttataccatcataggacaagtagcatccgtactatact

SEQ ID NO: 636461 - DNA, 157 bp, Homo sapiens
agtgggacgaggggccgaagtgaaggaagaatacgaaggatattatctcttctgttatttttttaagaaacattgtttggggggcgccatctccctgtccctatcactgttagagggctaattttatatcttataaacattttataaaagccaggtc

SEQ ID NO: 636462 - DNA, 171 bp, Homo sapiens
tgtgtcatgagtatagatcagaacaggtttggtcgatggaccttgcactcaagtgaggacgacaggccatgcctttcacgtgcatgcagctcactgtatttcagtcctcaatgtttccgcacagtgcccacctagtaagtctgtccgacaagcctggctagaaggcagtac

SEQ ID NO: 636463 - DNA, 436 bp, Homo sapiens
tttagattgtttacatagttaccttttaaccccagagttagtatcaaaaagctgcatgattatgtcgaggtgtgttttcttagttgctctaaaatcatcctagcctatgtgtaggaatgggtaaaggccccttacacaaaaatggagttaatgatgttagctctttagctgatgcatagttagcaattccccactgtcgcaggctcatgcctacagtgctggtccggttagggaccgtgggtccagtcgttctctcatctgggtgcttccttgctgtaacatggtcaatgtggggcaactggtggaaatgaaactattagacctgacagccatttggtgtacaggaccttatacttacaaaatcgtaaaaaggaccctataacccactcaaaaaggatgtagggacatgtctgtaagatgagtggacctggtaaaa

SEQ ID NO: 636464 - DNA, 913 bp, Homo sapiens
cccccgcgggtatatacaaaccccggtttgttgagcgcagccgcccttcgggaggagacccccccctttgtggtgtgtcccacctacatagcaacgcacgtccggggcggtacgtcatccgccctcccgctttcttttttctccttcggcccggctggatactggtttttctctcagccagtaggcgaggctatgtacacgccggcacgcaagcactagtttgtgggcgcgagtcgtcacaccctggtgtgtgtcctcatactcaactccgcgcgcgtggctccgtcccgcaacgatttacccgagcgtagttttttattccaaactacctgctctccaccgcacgttttggtcttggtcgcactgcgcggggtgtgcgtttttcccatcctctctctgtgttggtcgttgcggcgggagtctgctcccccaactcaccatgtggtgctggttttcttttttcttcctctcctcctcccctccccgcgtgcgtgtgtttgctacttttctgctgtctgacttctcctcccacgccacgcccccccccgccggtctcggttatcctcccaccccgcgccgtcctcctctctttcttcgtcctgtcttttccttctcgcaccgcccggttgttttgtgtgcaacacacgcctctgctcctcttccttgcctcgttcttgttggcttctctcttcctgaatgcccctctgcttcgcctccccccccccgccgatgagtggaggagccgccggctcccctctcttttgttttggggcccctcggctgttggctccgcctctctcttctctccttctctccccccctggctgtcgggggggagacatctccccccctctttttgggggggttttttttttttttgccccctttttaaaattttttttcctccccccca

SEQ ID NO: 636465 - DNA, 2196 bp, Homo sapiens
agttgattgtgagttattatgttgttggtgtattatggttgtgttgggatgttattgtggggtattgggatttgatagttggagtggttggttatttgtggtcattgtggtatgtgtgagtgctgtgttatgttggtggagtttctgttagtgttattgttgtgattgtgatgtagtgtgtggtagtgatgatgtgatgtgtgtagttggtttgttttttaattgtgttgtgttagggtgtgtggtggtgttggtggtggtttggagtgttggttgttgtgttgtttgtttttttgttgtgatggtgtgtgatggttgtgttgctgtgctttttgtgtcgctcttgtggttgctatatgtgtagtcatctatatgcggtcgtaaggtgtgtctagtgctatcgttgtgtactgattgctgctgtacttcgtgttgattgttctctatgtgtgttcggattatgtaggtctgcggtctggcgtctgttttgttgccctgtagttcttgttgtgttggcttgttgctgctattgtttgtggttgttagttgttgttctgtgtcttgtgttagttgtgtttagttcttttgtttttgctagttgtttagttgtgtgcgactcacgcgtcactatgagcgttgggtgtatgcattatcttcgttcgtttcgtcgatattctacgcttgcttgtttgtttatgtctggtagctattctgtactcacgtcgctgtgcatgttggtgtctgtgtgtgtagtgtcttatgtgtatcttcgttactcattgactacgtgtcatgttcgttgttgtgtgtttggtgtgggttcgttctgccgtccagtcctatcgttcgtgtgtgtggtagtgtgggcgttcgtagctatggagttgcagttgtcctctcccctccttgcatcgttttgttgtttgtttgtgttgttccatgtttctgttgtctatctgctgcggttgtgtttgtttttgtttttatttccttatctcttgcgttctccttccgtgttatatggttgttttgtttcgcttgtggtggctgtttcgttatgatttgttgtcgttgtgcggagatgtcctatcggtgggtggtctggggtgttttgtttggttcgtgttgagtactcggttgtgtggtggttgtcctgtgtggtgtttttgtctctgcatcctctgagtggttggtcgtgcattttgttttttttttctatgggtggggggcgctgccgaagttgctcgcgttatcttccatccgctgggtgttgtgggtcggggtactacacgctgctcgttgtttgtgtggtgtgttggggtgggggcgtctcgcctctctcggctttggttgttggtggtgcatggttgctgtctctgcagctgtttttgttttttttgctctcctcgggcgtccctcgtcccgctcggtggggtgttctctcgtcctgcgctcgtatctatgactctctgtcccctctcgcttgtgtctgagtgctattgtactctcttcgttgtttcggctctctttttgtgtgttgtcactcttctttctctcgcacctgctgcgtgtgtttcgcagtgacagagactctcggggggtggtctgctcacgcgtgtgtcgtctctccatcgcgtctttgcccctctcagtgtgagtgttccctactcggcggtctctcccatttattgtttgttttcctttgtcgttacgctgtgtgggtgagaggagagtgtttggtgagtgatatgtagttgtcctgttgttttgttcagcatagatgccctctctcgcgatggtagacacatctctagttcccaccgcacataaataatatatatatatatgagagagagagtgatggtgtcactcactcatataggtatattcttgtcacacgacagatagagataatagatggtgtggtagaagagatagattaacaccgcgcgcgtcggttaggctgtattctgtagtgacacaccaccactctcgtctgttgttatgttcgctctcgtcttattgtggtggttgttgtgtataatagagtgttgttgttgctctgcgcctacagtgtgtttgtgtgaatatatatataataggtaggtgtgtctcccccgtcgtgttatgtatataataataaaataataataatataataatataattataatagatatatataattaatatata

SEQ ID NO: 636466 - DNA, 324 bp, Homo sapiens
tcccagctacttgggaggcgtgggcaggagaattggttgaagcgaagaggcagaggtggcagtgagctgagatcatgccattgcactccagcctgggcaacaagagcgagactgtgtctcaaacacacacacaaaattaaaaagtaaatcttaaaaatttagaggcctggcaggcacggtggctcacacttgtaatcccagcactttgggaggctgaggcgggcggatcacgaggtcaggagattgagaacatcctggctaacatggtgaaacccatctctactataaataaaaaaattagccggacatggtggtgggtgtctg

SEQ ID NO: 636467 - DNA, 264 bp, Homo sapiens
gttctagataagtagctagtctgttgtaacatcagggcagcaattcagatttctggattctgaattcatttttttctgggtcacagtacactgcctttaggatgtgtctttttaaacttctttttcctctaaattataaaatcagtttataccttttggggaaattgcagaaaaagttaaaagttcatgttgtgtattcagtcatatagtctgccttttttccttttttcttttatatttttctttggaaccagatctcctctc

SEQ ID NO: 636468 - DNA, 261 bp, Homo sapiens
agcaaccacccaactatctataaagctaggcatggccatccccttatgagcgggcgcagtgaataataggcttacgctctaagattaaaaatggcctagcctagttcttaccacaaggcgacagctacaccgccttattccccatacgagttatgatcgaaaccattagcccagtcattctaccaataggcctggccggcgtcctaaacgctaacattactggcaggccacctactcatgcacctaattggaagcgccacc

SEQ ID NO: 636469 - DNA, 940 bp, Homo sapiens
tctagcgtgaggcaccgataagacgcatcgctgtgtcacaccagccctgtgtcttacatgctggggagtgagcgttgaagcggcgtaggaggataatgcctacactcctatttcagttgcatataactcgttgatctagatgtgcagagtggtcctatcgcaagtgaatacacgactcgccatcattgggttctatcccagtggtatatagctgcgttgtgcaaggagaacgattggcagggcatcatcatgatgccaaccgaggatcagagagattcgctactgtgaagccttcaaatttagttacacctggaataccgcattagccctactcatatagaccccaagcgatggttccctaataggtagcgagaaccctgcgtgtgtagtgaagacttgcgtgtatgacgaggcggacctttcagatgcacgagaccccaacatagcgtgacttaccaggttacattgcctaccgacggttgctcagggcagaattcggaaagttactgagtactcctgattgagtccgggttagagcatgtggacgcaaacggtgaacatttgtgctaaccgccttaggaggaataacagatgcctgtggtcccataattcctagacacgttccagtattccacacaattacggggttataccgaccctccgattgatttggactcagggacactcccatacttggttgcagccgctgattagacggtatacgaattgtagcaagcgagtaaagaagtgcctacgtgatctgaggtttcagagcctgagtaatttcccacggtcggtatctctatctactttcaacattcctccctgtaacgaatggacgcgagaaataacggcctaatttacaacaaagcgccttacccccgttaccatgatatcgatctcccacttaggtattataacacacctagccaactccaga

SEQ ID NO: 636470 - DNA, 216 bp, Homo sapiens
cgtgatctctgacgtagatttccagttgtaaacagatcccgatcgaaacccaggctggagtgcagtggcgcgatctcagctcactgcaccctccacctcctaggctcaagcgattctcatgccccagcctcatgagtagctgggattacaggtgtgcgccaccacaccctgccattttctgtattcttagtacagacggggtttcgccagtgctgc

SEQ ID NO: 636471 - DNA, 101 bp, Homo sapiens
ctgcggagtcgggctggggtgtgtgaacccgtgctggctctggctgtgcggcttgacctctgtgtctcaggctgggggtctctgcccctgggacccactgc

SEQ ID NO: 636472 - DNA, 528 bp, Homo sapiens
  misc_feature (34)..(34): n is a, c, g, or t
cttttcttttagtcagtgctgtcatatgccatgncaatattgtatttaagtctgttctcacagtgctaataaagacatacctgagactgggtaatttataatggaaggaggtttaattgactcacagtttagcatggctggggaggtttcaggaaacttacaatcatggcagaaggggaagcaaacacatccttctttacatggcagcagcaaggagaagcgctgagcataaggggggaaaatctccttgtgattcatgcctgtaatcccagcactttaggaggttgagttgggtggatcgcttgaggtcaggagtttgagaccagcttggccaacatggtgaaaccccgtctctactaaaaatacaaaaaattagctgggcatggtggcaggcacctgtaatcccagctacttgggaggctgaggcaggagaactgctcgaacctgggaggcggaagttgcagtgagccgagatcacaccattgcactccagcctgggcaacaagagtgaaactccgtctcaaaaag

SEQ ID NO: 636473 - DNA, 267 bp, Homo sapiens
atgttctaggtgcagcagcagggcagtggtgtcatctgtaagcagtggcaggtagagagaaataaagatgcaaaggatatttagaacaaaggattgactagatttactaactgtttggacactgggggctaaaatggaagagggtgaggtagaggaaggatcggggatatctctcaggtcttcggcttgaccagttaggtgactcatggagccacgtcctcagtgggaggagagttctgggagggcaagtaaagagttcagtttggg

SEQ ID NO: 636474 - DNA, 322 bp, Homo sapiens
  misc_feature (2)..(2): n is a, c, g, or t
  misc_feature (35)..(35): n is a, c, g, or t
gncgtgctgcggtcgctctagacggactccccggncacatctgacccagactgctacacagacgtggattcagtgactctaggcagacagcagcagacaggattccaggaaccagtgttggatgaagctaggactgaggagcaagcgagcaagcagcagttcgtggtgaagataggaaaagagtccaggagccagtgcgatttggtgaaggacgctacggccgaccggaacggacgcgctaacgactttggtggtgacacgctacggaaacacggacttccaggacaggacgcgacgcgcaatttggtgatgacacggtacg

SEQ ID NO: 636475 - DNA, 464 bp, Homo sapiens
cccactctggttatcccacctgtcaaagccggctcattgtgataggggttctcagacatcagggactgggatagagatgagcactgagagagatgctctgggactggctccaggcaggtccagtccatgtactgtaaacacatcagaaggaatggagggtgaggcagagaaagaatagggaacaagtaccctggggcccggcaagaacaccataagtgactcaccataagtttctctttcactattaatactctggaatttcccagcctctgtctcatgctcatgttctgatttcaccagaaatcggtcaattgcctaatcctcaaatcaagggggggggggcaaaagaacaggtaatagccagctatgtaacttggacagggactttctttgtattagaaacagttcacgacaatcaacaacaaacgaaattaaggtaagcaattagccgccaaagttgtcta

SEQ ID NO: 636476 - DNA, 167 bp, Homo sapiens
ttttaaaaaaaaaaggctcccatgcctgggcaaaaaaaaaaatggggaacttaataaacccgttgttccgcctccttggaacatgggggcgagtggcggccggggggcccccaggaaatacccccaaaactaacttgttttcccccaaataaagttttcccccccca

SEQ ID NO: 636477 - DNA, 280 bp, Homo sapiens
  misc_feature (37)..(37): n is a, c, g, or t
  misc_feature (118)..(118): n is a, c, g, or t
  misc_feature (165)..(165): n is a, c, g, or t
  misc_feature (248)..(248): n is a, c, g, or t
cagcaatcgtcatgagtgaatgaatttaaaattaggnatatgatagctcagaaggcgggatatatacgaaaatgaatcctgacttttaaaggaagtatattacagacatgagagtccngagaaagaatcataaaagagatcttgatggttaagaaaaaaataganaccttagtgttatctgtggtgtgtgtatttttttaatatcttattttgaagaataacggatcagacaatgatctgggtgcttntgggacccagaaataagttgaggggaggatgt

SEQ ID NO: 636478 - DNA, 854 bp, Homo sapiens
gtatctcctcctcctcctctttcggtttcatttcctcttcctctcctgcctccttctgttccttcttcttcagttcttcctccttcttcatctcctcctcctccttctccttcatctcttgctgaaaagccctcatgcgcttcctctggtccttggagtgaagcctgtgcctgcgtgcctcttggtcttcatcttcactgtagtactcttcatcttcactttcttcctcattgggactcggagcaaaagggaagatgatatttcgaactccagggagcgggataggcttgggaacgcgcacttttctttctatctccacacattcgagaatcagctcatccaggtcggccatttctgttgaccataagagctctttgcggaagaattccgacaggcctttgaggaattggttttggaggcggcagtcatcccaagacaagaattgggccaggaactgaaaagcatctgcatagctgccgagggtacagtggccctgcttgagcttgcgaatggcctttttagccacacgtggggggatggggccacagaattccttacggatttcatccaggaagcgcgggaagttggcatgcaaggggcttccttcctgggtgaccgagatggcccagtccttggcttcgccagtgaaaaaggagatcagaaaggccacccgctcggcgcccccggggaaatgaacctcatggtcggctatgaaggtctctagctgcatcaggaattcagccaggtagactgggtctcctgaaaagggctctatctcaggccgctccagcggtgccagagggggttgcgggggcggatcctttgacgcgggcggaggcagcgccggcggccgc

SEQ ID NO: 636479 - DNA, 288 bp, Homo sapiens
  misc_feature (277)..(277): n is a, c, g, or t
tttcttttttgccggccccagtgttgtcccggattcgcttattccggccctgtagtccgcgaagtgattttccgcttttgcggctcccttctttctatgttcagatcttcggagccacttgccgaccacactcctagcgtaagacccggttgacaatgggagtatgggggggacaactcgggcggggagtgttgcagataattagtcacttaattgcccgaacctaaaccctgaaataaggggggccaagggactttttgccctggaaaacttgggnaaaggtaaaaa

SEQ ID NO: 636480 - DNA, 288 bp, Homo sapiens
tatgtactggcttgcctaggctggggcttgaactaagtaaagaagccaaggtgtgcagatctagatcgcagagaagtcagtctcattctaacacattgcaactactgttagagtccaccccatggagctgttgcagattgtgtatctttgactgaattctatgagtatatgtatgttcagactaaaacaaatgttgctagctacggtcggctgtccggtctcagtaggacattgacagtcgcaagctatcaccctctgcagaccttggacctgagtgccgcatgcatt

SEQ ID NO: 636481 - DNA, 354 bp, Homo sapiens
ccagatcactaccatcacctcaccatcaccaccacaaccactcatctccctaccaccaccattatctcactcaccatcacaatcctcaccactaccaccaccaccatcttcatcctcaccaccatcgtgaccacatcatcaccatcttcatcaccatcctcaccaccatcatccccaacacaaccatcatcactaccatcatcctcactaccaccaccaccgtcaccatcaaccaccatcaccatcaccataatcacaatcaccaacatcatcaccaccatcattctcactaccaccatcaccatcaagtcatcaccaccatcatcatcctcattggtgatcgtggggttgtaa

SEQ ID NO: 636482 - DNA, 781 bp, Homo sapiens
gtaacggcgagggatctgacttgcatttctgcctgtaacacggttcatccccgagttactccgctggagtctgcaggtcacgaatggcgaagggcttgtgacttctgcagggcgagtgactggaaaccagcgcatcacttcagcagggatcctaggtgtgttctctgctggtgattccccaggggaggctccttctgcgctgttgcctaggggcaacccctgtgtcagcctgaagccactcagctgacagggccaaaacgggctggaccaggcagtctctgtcagagacgaagccctgtggctgatcggaaggcagcctgttcctccaggacgtgctgcggcgttcaggccagtctccaatgaagccgttcaatagtattattgagcatctgtcagtggtattcccagtgttacgacagcactgagcttgctggtgttattaataaaagtgcgaagtcaaaataggcaagaacgtcaggtcgtcaggattgagtatgggatgaacattgtccaagagagtgacagaacatattctaggatgaacagaagaagaagaagggcactgggtgcgaagttcctgtgaaatatgccaggaggtgttcaagatcagatagaaggtgctgtgtgctcaaatgtgggccacaagtatcacaagagggtgctttaacgcagtggcttataggggcagaggcttgcccgggctgcagggtcgtgatctcctgacagacagagtcaccttctggaagaggctggcccgagtcagaaatcaggaggtgccttc

SEQ ID NO: 636483 - DNA, 730 bp, Homo sapiens
tttataggatgcgttcttaaatgccatctttaaaattgggccccaggacgtgcataaaattcgttggttcataagccataaaggcttgggacatctgaggattgccattcattgttctaccccgcagatagtcattgaatggtctccactgtcaaaattgaggtgtggggctggggattatgcaattagctgaagccgcgttgtgcataagcgctctgtagatttttccgtcgcaaatttaccagtagagccactctctggagcaagatattggttattgctagcatgaagctggtaagtgaccagtttggcccagcccttcccttatggcgctacagtccctgtctgtcatagtcaaatgtaaagtcagggctgtggccagttttgccatttcactgatctgccttcagcttagcatattaaagctcttgatggagggtgcgatcactctttccataaaaggcttcactcgctaagatcgtcatacccagcaagaaagaaatggaagccccatccccttgggcttgtgatgttattactaggaataatggtgtttattgcaaatgcacggtcctttttccattgcaatgtcattccactggaaattggcctatatgtaaaaaaaaaatgagtatagttttacatttataatgtacgctgactccgtccatatggttgattgtaatgtgcacctgtaatataaaatgtctctgtatatgcaataaattct

SEQ ID NO: 636484 - DNA, 1486 bp, Homo sapiens
  misc_feature (787)..(787): n is a, c, g, or t
  misc_feature (1486)..(1486): n is a, c, g, or t
atgagtatctcttctctactgagattccatagtgcatatggctctattgagaggagtcctaatctattgattccccctaaagtcccattgtcttgtaagcctcgcgactcgacttgcgcatcggagttggtgatcttcggctcggaagtattgctacctatcaaaagaacgttagaggcgtgtcgtcatcgagtcagtgaataacagacgcatttaagaggtacaatatgcatacaatttctccactggaccatatgagctagcttgagagtcgtacctctccgtcttccatgtgtattctatctagccatgatgatgcggcattagattgattcactagtactcacattacgtggacattgagagctaaaacatgaaacctttgacaaatcagacctacatgttggtatgtatgtctgtacggatctacagcgtgaaacaaatatggctgatcgatagtctaactatgaataatctctctattccgagaagcaccacactttgtaaattgcatctcaagctctgggacaggcatcctctcgttcgtcaaactccattctgggctcgacaagggtaagcggcttagcaacttcgccttcgatttgtcaacataattctcatgtgagaccctatggcaagaaagcgataccaattggacattagccgtattaccttgtggaccaatccaaccaaagaacgggaactaggtccaatataaccctaacaatcccctctctccaacgcggtaactttgtgcgataagagcgtactcctgaggatcggcgcntatcgataataaggtagagacctggttggctacgaatggtggatctttttcctataatgtgcacaaaagctcgatcagggagaggaacaccacctttcggtctcgattataagacaccacatcaaccaattttattattatttggagccccatatcggctccggagggaaaaggagaaacatctttcctttgaatcggccgttatgtaattaagaccccaacggtgtgaaaagtttcgcgctttgttatttccattatattggactttacaaactatacgtgggtccattaatcattattggaaccttggcggtaatcttttcaaccaagcgaattaatctgtgtagggtgccccaaaagggtgttggcttagtaaatttaacacggctttcgttacactatgtactttgtgtattggaaccgaaaaaggtcttcaggtagggggaagacattcatccggtcggaactcgaaacgcggagggaattgtgagagtatagtatgttttggagcaacaccccttcaggattggcaatctccccacagggatgttgagtataggacccaagagcccctttcccatggttttcacatttttcggggccggaaaatattgcaacggccttattttcaatatcagggctccctttaggttcccccgtttaagaattcccgcccgtatgaattcccatttacgcacn

SEQ ID NO: 636485 - DNA, 273 bp, Homo sapiens
ctgaggatcccgcatctgctcattgtcagactcctgcatccatttaactcattagcattcccgattacaggtgcgtctctgccattgtctgcctcttccacaactccccttcttctcctattaagtccttggtggtgatattcggagctggtgtctacggctgcgtctgacatggtggggcacgccggtaatccgatgcatggggattaaaaagaaagcgagagttcagggactctggcagatcaagctgccgtagtccgcggcggcggagga

SEQ ID NO: 636486 - DNA, 705 bp, Homo sapiens
  misc_feature (270)..(270): n is a, c, g, or t
ggtcctgatccgtgcgcccgcttggcggcgtcactgacgcttcgctccggtcctcggatcccgagcgcggggaggcagaccggtgtagtgagggtgcccgggagcggccgctgtcaggtcctgctggcgtgccatgtgtacgccggtcggactggctgagggcgggtctggatggccgtcgccgcctcccgccttgggctggggcattcgtcctgtccgctctcgccttgacgccctttgcgagactcctgccagccagccggggctccncggggagcaagtggactatcgtgcctgatcgcgaccgactggaccgtcccctggttccgccgtgacatctgttctggttctcctatctggccaaagacctatcgatagtgccatccggcgatagactggtagtgccctaacggcgcgtccttggttgagacgtcgccgcttctagtcggccgacggtcggaccttgggactaggctgccccgcttccctgcgccgtgcgcttccggcttctgaaccgcgtggaccctcatccccgtactgatgagctgcttgtccccatcctgctgccgtcctggggacacagagccctccgtggtgcccgcgtgattgtgattggagccaaggacctcacttccttccatctgttccctgtccttgccctataagtgatggggcaagcctgcagaccgcccattggtgttcttg

SEQ ID NO: 636487 - DNA, 459 bp, Homo sapiens
cttcaacgcgccgtcagagccgcgcagcaaattcccgtccgcccatatccggccaatgcgggcgatcggtttgctcgacacggcgaccgaaagattggcagaatagctatacgtcgttgtcgcgggccgggtattgctacccccgttgacagtccgcctttcgatcaaatcgctcgcccatataaccgtgccagcaaccctcatcgtaccaaatatcgctggaattgcagttgcataactcgacgtttgcagttccagttcctgcaggcgcggccgtcgacggcgagggccacttccaactatagcgcgatcgagctgctggccaagcatggccccaacagcaccgccgacgggcccgccaatcgccgtgcccaacgcggtcaaaaccagtgtacgcacttcaacctcccattacacgccagcgatcgagaatgtgccagtcgggaaacgcaggcccat

SEQ ID NO: 636488 - DNA, 668 bp, Homo sapiens
aacttaggctatgtataggcctgcgtgttaatcggccgagggtctttgcatgcgtattacctgagtcggtcagcgcctggaggacctcagcagccatgtctgaagccccatagtgaagcctgggactgccttcattcagacccatgcagctgcacgcagccatgtgctgacacattcctgtgagcacatgtgccgcctggacattgattcaccacccatcacatgcccggaacactggcatcatctgtaccattggcccatgcttccctgatcagtggagactgttgaatgtgagatgattaatgtcttggaatgaatgtggctcgtctgaacttctctcatggaactcatgatgtaccatgctggatgaccatcaatgaattgtgctgcacatgccacggaaatgctttgcttcttgaccccatcctctacctggccctgttgcttgttggctctagacactaaatgtgacctgagatccgaactgggctcatcaaggtgcagctggcacttgcagatgtgtgtgagcttgaagacagggacgccactctcaaaatcacgctgtgataacgcctacatggaacagtgtgactgagaacatcctgtggctggactaccaagaacatctgcaatgtggtgcgacgtgggcagcaagatctacgtggatg

SEQ ID NO: 636489 - DNA, 343 bp, Homo sapiens
tatttgctttcctctccactatcccatccgtatgagaaaaagagtgtgtgcactgatgataacaggatcttggatgataggctccatcaactcttgtgctcacacggtatatgcactccgtatcccatattgcaagtccagagccatcaatcattttttctgtgatgttccagctatgttgaccctagcctgcacggatacctgggtctatgagtgcacggtgtttttgagcaccaccatttttcttgtgtttcccttcatttgtattgcatgttcctatggccggattctccttgctgtctaccacatgcactctgcagaagggaggaagaaggcctattcg

SEQ ID NO: 636490 - DNA, 122 bp, Homo sapiens
agaggatctgatggtgatcttccgggttgtgcatctttccgggttgtgcatctttccgggttgtgcatcttccgggttgtgcatccttccgggtgtctgcatccttccgggtttctgcatcc

SEQ ID NO: 636491 - DNA, 954 bp, Homo sapiens
gtatcgttgaggacgtatctcacaatagttaactaagctatctatgaacggagcccactggcagaatcatactatatgtgcaaactccgtagacatatccttagaaatatgactactgtacagggaattattacctctcatctatcgctctactacgtattctatgcaattagctgttggaatgttccatgcggctaggtgcaaattagcgtttgagaaattaggaaagatgaaagggtatttcaaactatgaggaagagatggcagttccgagattggtcccctgattatgcaggggttgcatatgatagtgatagtcatggtaagaaactcgcaatcgttctcacactggcaagatatctccctgtagtcttgataagaccaacttgcaggacgaaaaggcatctaggaatgcccccgtctttagtaccaatatcacgggagcatgcttatacatctaatatgacggtgagtcaaatagtgtagatgagtttcggcattacacgattggctggctgactttacgaataaattctggcctaggggacccccatctttacagaggatttgctgccagggaggcgttcttcaagggagcctctaacaatccaatgaggccaggtgagaatttggccgcggttacaagacttagtgtaacgaatttctatgctccatgagtaggatggatccgatttctgtgggagtcggcactactggcccagtgtggttgatagtattcgtttgcattcgccatcaatgtaccacttgactttctgcacggcaattgcaaaaatccacttgaaagggccatctggaaccataaaaacattccctgtgggccaaacatcctttccacgaaaattggggatcaacacacaggtcagcaaaaaccacgggcggatccaccctggttgtttacaactcttcacatgaaaaccccaaaaaggtccactg

SEQ ID NO: 636492 - DNA, 340 bp, Homo sapiens
aacgtccatgtcacactatctggtaaatggctttacacctgcaaaactgaccctaggttgtagctacccgatatggttggctgcgtccccacccaaattgtcatcttgaatgtagttcccataatccccatgtgtcgtgggagggacccggtaggaggtaatcgaatcatgggggcaggtttttcccatactgttctcgtgatagtgaatacatctcactaaatctgatggttttataaagggcagtttccctgcacgtgctctcttgcctgctgccatggaagacatacctttttgctccttctttgccttccaccatgattctgaggcctctccagcc

SEQ ID NO: 636493 - DNA, 370 bp, Homo sapiens
gagaaaacgaacggcagggaatcactcataatggggagaggtacttcgagattacatgggcacagcgagggaaacatcacacaccagggcctgtcaggaggtggggggcaaagggagagagagcattaggacaaaaacctaatgcatgtgggcttacaaccttgatgacaggttgataggtgcagcaaaccaccacggcacgtgtatacctatgtaacctgcacgttcagcacatgtatcccagaacttaaagtaagataaaaataaaaaataaaaattaaaaaagttaaaaaatactaggtgtggtggtgtacatctatgtttaaagaaagaagacaaaaaacccagatttggttgtagaaaacaatgc

SEQ ID NO: 636494 - DNA, 92 bp, Homo sapiens
agaagaaaaaaaaaggtttggcaggccatctttttttgttcttaaaagtaggcttaccccaataataaagtgctcttaaaccccaaaaaaaa

SEQ ID NO: 636495 - DNA, 395 bp, Homo sapiens
cggcatcgatggaattagtctaacaccttattcattcacttgagcatgattcttcgaccacgggtgtccatgagttgctagtgtattcccacagggaaacgatcacctttagcgtctttagtctcaaatacacaatctagcgtgactggcaccatgaagtttcagcacgtgctcttaacgctcagtgatgtataatccctgcccaacaagctgtcagatcataccttctcatatactgcggtgcgcagcttcataccaaaatctgtattgattctcccttatgaaagcatagatactatttatatacttttctaacaatctcatattgttgtgagaaaaggaagatgcacatgttgtgtgttagttggtagctcactaatgttagtgcattacac

SEQ ID NO: 636496 - DNA, 1044 bp, Homo sapiens
  misc_feature (30)..(30): n is a, c, g, or t
  misc_feature (38)..(38): n is a, c, g, or t
  misc_feature (42)..(42): n is a, c, g, or t
  misc_feature (44)..(44): n is a, c, g, or t
  misc_feature (48)..(48): n is a, c, g, or t
  misc_feature (178)..(178): n is a, c, g, or t
  misc_feature (214)..(214): n is a, c, g, or t
  misc_feature (227)..(228): n is a, c, g, or t
  misc_feature (232)..(233): n is a, c, g, or t
  misc_feature (243)..(245): n is a, c, g, or t
  misc_feature (273)..(274): n is a, c, g, or t
  misc_feature (276)..(276): n is a, c, g, or t
  misc_feature (285)..(285): n is a, c, g, or t
  misc_feature (304)..(304): n is a, c, g, or t
  misc_feature (309)..(309): n is a, c, g, or t
  misc_feature (343)..(343): n is a, c, g, or t
  misc_feature (360)..(361): n is a, c, g, or t
  misc_feature (370)..(370): n is a, c, g, or t
  misc_feature (411)..(411): n is a, c, g, or t
  misc_feature (457)..(457): n is a, c, g, or t
  misc_feature (520)..(520): n is a, c, g, or t
  misc_feature (527)..(527): n is a, c, g, or t
  misc_feature (873)..(873): n is a, c, g, or t
tgttctctttacttgtgaaatcagtggcanccctgatntcanangtanagaaacaagatggtggactttataccctgagtttagggaatgaattggatctgactctgccactgtgaatatacatattcgatccatttaagagggcctgtgcccttatactctacactcattcttaacntttcgcaaacgtttcacacggactaatctttctgancgtaaatatttanngaannaaacgtagtnnngtatcaacctaaatgagtcaaagttcannantattcattncaatcttttcataatgtgncctangaatataatacattgctagtgacatgtacatacngtatatagccggattannggttataangtttgtaccatttattttatgacattttacaatgtaagttngaaactaactgtggtaggagaaagtttcttatggaacgaatacccngtcaaatttaatcaatcttgtgcctcaacatactgttgatgtctaagtatgcctcagtgggtngagaaanatccccattgaagatgtcctgtccacctaaaagagaatgatgctgtgcatatcactgtgatatgtgcaccaatacctactgaatcagaaatgtaagggcattggtgatgttggatataccttcctgtaagcaacactttacgtcttacattttctctgagtgatgtcccacaaaattatcatgacaaatattaccagagcaaagtgtaacgggcaacacttgttcgctcattttacgctgtctctgacataaggagtggctgaatagctgggaaagtaacatctcctggcatcccttcattaacaagctatgcagtatcctatgccagagcagtgcagctctgggngtccgagggagcaatgctgtgggaggctaaatttaatgcgctgaaaactggggctaaagaatgagccaggaagaaagaaccccataaggggggattaacagtttatggccaaggaaggggggcttccgcagaaaaacagggaaaggggcccgaaaaaacaaagggtggccg

SEQ ID NO: 636497 - DNA, 834 bp, Homo sapiens
  misc_feature (310)..(310): n is a, c, g, or t
  misc_feature (317)..(317): n is a, c, g, or t
  misc_feature (663)..(663): n is a, c, g, or t
tgaataacagtccaaaagatattgcagtgtgtcacatgctatgtcatatagtagttgagcctaagattgataactatcatgtgactcacttggacatgtactatatcggtagtatacgccggattaaaggttatgacccgttgggtaccagttcagttctagtgacattccacatggtaatgttgaggaactaactgtaggtaggagaagggatgttcctatatggaactgcagatactccatgctcaagcactcgaactcgtcttgtgcctcaacatactgttgatgtctaagtatgcctcagtgggtngagaaanatccccattgaagatgtcctgtccacctaaaagagaatgatgctgtgcatatcactgtgatatgtgcaccaatacctactgaatcagaaatgtaagggcattggtgatgttggatataccttcctgtaagcaacactttacgtcttacattttctctgagtgatgtcccacaaaattatcatgacaaatattaccagagcaaagtgtaacgggcaacacttgttcgctcattttacgctgtctctgacataaggagtggctgaatagctgggaaagtaacatctcctggcatcccttcattaacaagctatgcagtatcctatgccagagcagtgcagctctgggngtccgagggagcaatgctgtgggaggctaaatttaatgcgctgaaaactggggctaaagaatgagccaggaagaaagaaccccataaggggggattaacagtttatggccaaggaaggggggcttccgcagaaaaacagggaaaggggcccgaaaaaacaaagggtggccg

SEQ ID NO: 636498 - DNA, 105 bp, Homo sapiens
  misc_feature (6)..(6): n is a, c, g, or t
tgagancacgccactgtactccagcctggacaacagagcaagactccgtcaaaacaaacagacaaaaaaaaaggaaacttgaaaatagaccggataggccaggac

SEQ ID NO: 636499 - DNA, 115 bp, Homo sapiens
aaagattgtaacattggatttgtctgggaatcactttgaaagcttctaaggatattgtaataggtctttaagacagtgatagaactaactttaatattggataggatgatttata

SEQ ID NO: 636500 - DNA, 573 bp, Homo sapiens
agcggttcctcagtgaggggggagaggtgtccaacatatcatcatgacggtcacaaatgtgtgggagtctacaatttctgtccaacgcctttccaggtgtgtgaacagctcagccagcagctcctgcaagtgctagatcctgtgagagggtggcacagaactctgccaggagggccaggtgcttgtactataagcttccgcatgcgccagagaaacctcctgctcccaccgactgcagctccttgaaggcctatggggatgcccagagcatacaggcttcccagcagcttcgagagggtaccatgccagaccgaggcaatctgactgttgagcaagacagagacatgttgatgaaatgttgggcatcctgtatagagcaacgcctttatcttactggcttctcagaacagaagtgagagagccggataagtaccattgctgcttgattgctgtccaagtcgtgactgccaccaagtagctccaggagctcctcatgccttgtggccttcttgatgaggtggtccacctgcttctctatataggggggtgattctccaagatctttgaaagaac

SEQ ID NO: 636501 - DNA, 458 bp, Homo sapiens
ggcggggggttcctgcagacccccagtgcccccgagccgtgcaccggagtgtgtggaccttcagggccacccttggccctcgggcctgtcgagacccagtagtgcaggccccgtggacaaggacagaaaggtctgcagggagccacgtggcagacgggcccagcgtcctgcagatgcacctccgtggagccctgctcagcccaggaccctgctaccccgcgaggtcatcactacttgccgagctatgcacacacttgggggccacctcccgcattctgcccttacggacatcatgccgaggggtcttagcccgcggacagctacaactgaacctcgcggaagaatcagccactaagtgcatggaaggccagtcagaatgatgaagagccccatgtaggtctgatagaacagagaaggagctcgcttgagtgagcgccgacaagccagctatgtaacca

SEQ ID NO: 636502 - DNA, 176 bp, Homo sapiens
gctatcgaggacatgcgaaacacctaccgcagtcgccagcacagagtgggcactccatgtaaaattagtttcctcttttccattagcaagtttctggaactacttaagaatactagaagtaccctcaaggtaccacagatcactagcaatcttcccaggcttcctctttgttccac

SEQ ID NO: 636503 - DNA, 389 bp, Homo sapiens
  misc_feature (177)..(177): n is a, c, g, or t
catctctaaggatccccgaatcagaggctaggtatatttctgggtctgcctagagtctggtagaatagtgttatgtcattaactgagagaaggatgagaagttagccgagggcgtctttgattgtgtgtatgggttgaaggtggttttatcggaaactgaagcttacagaggagatngcacttgcaaaggtcctgtaggcagaactgctgtggatggaacagagtttgggaagcaaagaagtggcagctagattaatcataaggggaagaggcagatcgtgtgcagggccatgtagagccaatgcaagaacttttactctgagatgagaaaccagtgtacgggttttgtttctttttgagacagagtcttgctctgttgcctaggctga

SEQ ID NO: 636504 - DNA, 213 bp, Homo sapiens
aggccccctcgagtcgaccgatcgttaagctgatccaacccaataatgcaggatagcacaagccattcaggaagaatctggttcattaaccaaaaaactccatttaggccccacctccaacactggggatagatttaacatgagacttggtgggatcaaacaaacgatatgcaaaccatagcaatgcccaatgctaggcagtattgggtgtga

SEQ ID NO: 636505 - DNA, 119 bp, Homo sapiens
ggcacgagaaaagatctacctagtttaatagacccagaagcttaaaagaaagattgggatctattaaactaggtagatcttttcgtattgatcataataaaagtgaatcattactattg

SEQ ID NO: 636506 - DNA, 316 bp, Homo sapiens
ggcaggacgtatgtgactctgctctgggactgggtctcgaagctacagaggacgcgactatgacgccaaaagcacagcattctggagccagcattcatgtaatttccaacaagcaaggtaatctcataggagataggaaaagctctcactcttacgtaactcctcacatgcagcagtgacagacacaatctctggcttgatattctccacttgctcgcttgaattgtagcttgcaagagaatggccattgaggcgaggccgccagtcggggcacaagtgccccatcaccacggcccaaactgctcctgactcaagc

SEQ ID NO: 636507 - DNA, 764 bp, Homo sapiens
gtctccgcgtggggtgcgcgatataggcgcccttcacctggcggtacggccggagggagcggaggtgacgggagtcgggttctcatggcagagcgggggacaatctggcgcacgaggcgggacgctttcatctcaggatgcctggattccatcgagccgcgcctctatgatgaatttcacaggaccgcgaatccgagacgctggaacgctagcagacgcgtgagggcttcgaaccgaagacggagcgtgctgtgcactgtgcttccggagcgagcagtgaggacgaaggtgctgctggtgagtatgcacgccgtggtacccagaccagatggattgtcccaggaggaggaatggaaccgcgaggaggaagcctggacggtgcgtgccgtgagggaagtttactgaggaggctggagtcagagaggaagagactaggcagacttcgtgggcgatagtttgagaaccaagatcgaaagcacagaagcatatgtttatgttctaacagtcactgaaagtattagaagatagggaagattctgttactatggaaggaagagagagtggttcaagagtagaagatgtatcgaagggttcgtccagtgtcataaaacttgtagcatgcgagagtatctggaaaagctaaagctgggttgtggccccagtcaatggaaattctacagtccattcgcttcgggataataatgccttgtttgtaaacgctgacagacctctgggttggcatctagtgtaagatagagagaatg

SEQ ID NO: 636508 - DNA, 157 bp, Homo sapiens
ttcccccccccccccctttttcccgggggggaaccggattcctgggggaattttgagccctgaaatccccggttcccttgggggggaaaattggttttgggaacagaaagggggccctttcccgggttccccggggcccaaaaaaaggttttttgga

SEQ ID NO: 636509 - DNA, 243 bp, Homo sapiens
tgggttgccttccctggtgtgagggcggggatcctgttgatggcaggtccccggtgctccctcctgtggctggagggaagggttttgcctgacaccacccagctgggtgtaactcatctgctgctctttggtaggatgtctggggagcgcaggggtttttcctgccttcccgactttgcctctctgagggttaaataaaattttgggggggttgcccgaaatgagataataatggagaaagga

SEQ ID NO: 636510 - DNA, 326 bp, Homo sapiens
atgactatcagcttcactgtccgccttgttactaaaggcaatcagatgacactcactattggtcaggggcagtggctcatgcctggaatcccagtactttgggaggccgaggcaggcagattgctcaagcccaggagttcgagacagcctaggaaacacaggaagaccttgtctctaccaaaaatacaaaaattagcagggtatgatggcacgtgcctgtagtcccagctacttgggaggctgaggctcaagaatcacttgaacccgggaggtggagattgcagtgagctgagattgcaccattgcactccagcctgggcaacaag

SEQ ID NO: 636511 - DNA, 109 bp, Homo sapiens
tcctgatacaccctatcactctatacaccccgataccactataccacacttataactgcactacagtataagaaaagcactacctggtggtatagcctggtggtatagt

SEQ ID NO: 636512 - DNA, 1399 bp, Homo sapiens
cattactctagaaagtccttcgatatgaaaaatatggaatggcctcgatgaatatatatgccgtgcattgctgcagtagtatttataggaataaaaaaaagggtttaagaaggcgtgtttgctctagaaaattaccgggtcacagatttagctctcttcagtagtgtcgtctgaacgagggcagcttgaattcatgactctaaatcttgatgatgggtcatctctcactacaaactctcactagacacacggggttcctgcacaagcttggcaccaatcactgtcgtgcccagtcctggacttgcggtagagatgcaacgcttctgacctggagactagcagcactgagagagacaaccaggtcttcgcagtaatccacacgagccccacggagatccaacgggcaggtcggcgaggcgcttgggcaaccgtcacgggttggactcatgaatgccgacacagtacggggaactgcgtctgcagaccgatcccaacgggtgacccgcgagagctagttggcgacttgagacacctcggacccgctggcatctaacggcacctcgacctctcccccacacagtcagtaggcaactgctgtggtgcggctcctgctgaaccgcacgggctcgtctcggaacgcgtcagcgacccggtacgtggcacacgcgggacagccgtaagcgaaaacttccctacacgcgtctccatggacacccaagggtacccgcccataagagaagttgccccccgtcaagacgggcgccatcactcccccccttgggaaccactggcgacttacccgacgccctccgtcccgcctggcggcggaacaacacgacacccttggccacagacaagcgccccccacaaaggcacgatggggccccccccgctacacccaggcggcgcaaaaacctctaccccgcacgcttagaagacctcccacctcgggcacctcagtcgcctagccacacggggtctcaccccgcaaggcccagacgcacgcccccttcccacaacgcccccacccggcaaacaccaggcttgccgaggtcaactcctcacaccacgcagcggccaccgcacacaacctccaacccccgtctcccccccccccagccgcaacccgcaccccgaccctcccacccaggccgccacgacattccccgccagcaacccgcagcccaacccctgcctcccccccacgcctcgcgcgctcccgcctcctcactcgtcaacaaccgccccgccccctcgcaggcacggcttcccacacactcgccgccccttccccccccctcgcatcccacctcgcccccggtccaccacgacctccccccgcaccccccacggcccccaacagccccccccacacagccaccgcgccccgcccccggcc

SEQ ID NO: 636513 - DNA, 325 bp, Homo sapiens
agctgtaatcctcagagggtacagtatccttatagaggtctcacaagaatcttttcttatctacgtcgcgacatggaacccagcaacaagaccttaataagaaagacagaagagtaggaactcctcaaagtacaaaaaagaaaaaagaaagcagaagagccacatgaaacgcagaatacctgatttcaaagagatcagaccggataactcctgacaacaacatcgagactagaaaacagacaggcactgtctttgggaagacagacaagacatttgagactctggagttgaggaacatatggagacgggacacactggctctaaa

SEQ ID NO: 636514 - DNA, 458 bp, Homo sapiens
caaacgatatcaatccacccttccacatatcacgccccacatactatgtctttgtctcttaccctacactaatctttttgtataaatacatcatcgcaataactaactaactataacagacaaaaaaaaccctgtgtgctgcccggcaggtctggcaccctctcggcggccgcatccttgttcggtatgctgcgtctctcaataccctccatgttactatttctcctggttaagtgacactacatgtaaagatcgagactttcactgctttatatacgtctcggtcaaattagaaatcataacccgaacccgacactttaacacaagactcttaattctacgtccactgatcagtgggatagaatataggcacgggggcgctgtccttgtgcaagtcgccgagcaatgtctagtgcttgcccattggtagagcatggatcgtcccccctaattatgtc

SEQ ID NO: 636515 - DNA, 325 bp, Homo sapiens
gagctgtagtgggattttgactaatccactgcactccagttcccgggtgacagcagcatagaccctatctcgttacaaatacaaatcagactttactccatatgccacttttggttctttatgatgacagtctgacatttatagagcctatatgtgcaaagcgcagtgctcggatatctcgttccacttctcgttgaagtgcaagtcaagtctatccttatccttcttttacagacttaggagactgaggattacagagatcaagttccctgtcctaggtcatactgtttttcttgttcaaaaacccaagcccacggtcaaccca

SEQ ID NO: 636516 - DNA, 1011 bp, Homo sapiens
tgatgtgtggactaggctaggtcaggctggtttagatgtcagctgccacgtagttatcgagcgcttctacacgccttgtgggcatcattcggcaacagcgggctgctcgtaagcctggtggaaagcctggcctctgggtgcctggggctggcgcgggtggccggcaattcggcggagaaaggccgactctggcggtgtgacaggcgcaaatccaagggtggcggcaagatgaatgaggagatctccagcgactctgagtagtcgagagcctagcctccaaggaagcctgaggaggaggaggaggaggagctggaggaaactgcactaggaaaagaagctgcgcttggtcgagttcatacctagaggcacgctccgtcatcaagaggaggagaaggctgaggcccgttgcatttgagtgagggaccaggtggcggtggtcgcctcaaggaggatgtcgctttgaggcaagagtgggcaaggcatgcaggacatcttggtgggcaaagaggacgatccaagccccagtccttcagtgtgacattcgctgttcttacggggggtcgaccaaggctcttttattcacgattgttggagtacgctcacgccggccgagtgactctacgtcgcaatcttccgtctgcgttgcccaaagagaactgcaggccatcaatctaagggtggcacgcgctagtatgaatttttggaccgggaaacggcctggcacttgttgagtttcctcttccgtaggcccaacatggaagggggtttgcccggaggggtgtaaaaaaagtctctccggcttggggccatacaaaggccagagggccgcaacaggtttcccgtactgttgccaatttgggttccgagagttccttcaccgttcccggaagcgggggcgagaaagttaaaccctttttggcgcattctttgggggttgggacccccggacaagggtaaaaagagcctaccgtttccctcaatttttttgggcgaagtgggccctcacagaag

SEQ ID NO: 636517 - DNA, 688 bp, Homo sapiens
gacggcaggcaggtgtggcgctgccctgggcgggcttgacccccaacccaagtgagcggcctgctcactcctcagctgcaggagccagacgtgtggagtcccaagctagaaggcccaaccctgtgtctcttcaatctcccctgggaaagggtggccccccccgaagggctgcaaaccaccgaggattggcctgggttgggcaaacatccctggggcattggacaccacggcgcaggcggggtgggtcaaccaagggttgaaaacgcaaggcaaaggtctcccccccaacttttcaaaaagcgcaccaaggaaaccccctttgaaaagtttgcccaagaaaggaacacccccttcgttaaccgaaaaagggcccccaatgtttgcaccaccgcgggcgggcaacttccgcggcggagggaaacaccaaaaaagctggaaatgcgccaaaaggggggccctttaattttccagaatttcccagaaacttttgggttttggcgcttttaccaacaagacccaagagacgggcaaagcggcaagaatggcgccaaaaaaccacaacaccgggcccaaaagtcgctgcggtcgcaccatcaggcgccaacaggactaattttcgggggaccccaaaaggagggtttcccccttttttcccacaagtgggggccccttcccaaaggttatatcg

SEQ ID NO: 636518 - DNA, 226 bp, Homo sapiens
  misc_feature (20)..(20): n is a, c, g, or t
  misc_feature (144)..(144): n is a, c, g, or t
  misc_feature (196)..(196): n is a, c, g, or t
  misc_feature (220)..(220): n is a, c, g, or t
atctagaggatccctgacgnagtgcatggtcaagatactacattgtctaaagttaggggaaaaaagtaaaaaggctgtgagttctgtgcaagagctcatttgtagacttgcaaaatctaactaattttatttttaatgcttgtngttagagcagtgctcaaaattacagaagcttcaaattgttgtgttttcacanaaatttgctacatatgttgacatngaatgt

SEQ ID NO: 636519 - DNA, 378 bp, Homo sapiens
tactgagatgaagcacgggaaaaggagactggcgacaagatcgaaccaggagacaccgggaggtgtgagctctagctcgaaaataatatggtcacaaggcaaatcaataaagaagagggaatgaagaaagactacaggcactgaggagagatcaacaggagagctagctgatgtctgatagaaataaggatgagggtatcccataaactgaatcggaagagaaataatagctgaaagccgtgcccgaagtctggggaaagatataaatacacactattatgaaaaggtcagaggtctccaataagattcaatctaaattatatgaagacatataatcaaacttcaagacaggattctgatgggagcaagactggcgca

SEQ ID NO: 636520 - DNA, 163 bp, Homo sapiens
ccggtactaaagcaacccgactgcactctgtgtactcgcagcttcctacctgctttgtccactctcttgttactgactcctcccaatttgctgctcattccctgacctgtcagcaccagctcccccaagtctgtcacttccatttagtccctgcctttcactg

SEQ ID NO: 636521 - DNA, 345 bp, Homo sapiens
  misc_feature (4)..(4): n is a, c, g, or t
  misc_feature (78)..(81): n is a, c, g, or t
  misc_feature (87)..(88): n is a, c, g, or t
  misc_feature (101)..(101): n is a, c, g, or t
  misc_feature (133)..(133): n is a, c, g, or t
  misc_feature (169)..(170): n is a, c, g, or t
  misc_feature (197)..(197): n is a, c, g, or t
  misc_feature (199)..(200): n is a, c, g, or t
  misc_feature (298)..(298): n is a, c, g, or t
aganccacgagcagcaactaccatgggtgagaggatctgggggggggtgtgacccttgaggtcagaagaggcctcgannnnttaggnntaacagggttggnagctgcactaaagcctggggcagctccctttncaaaaggacactgcccagcaacagcaagggcacggnntggtcaccatcccaggtcatcggggantnntaaagtgtgctcccaggtaagcagggtcaaaccacccccaagagcctcacttttccctggtggctctgccactgaactgactcttagaaaccggaaanggatgttttttttagccagaaaaccggagggaattttgataggcaca

SEQ ID NO: 636522 - DNA, 293 bp, Homo sapiens
gccagcacttaatgcaggctgaagctgaccctgggtggactcctgctctctgccagcccctttctcaccccttggtcccacggcccctgtggctctctcccctctgctagaatctcgctgagggattggtgggtgagggggtggtcacgcactggtgtggagatctggtgccccctggaggccggacaggaagtggccagtggcggacaaggtctttgagaactcggtggcatcccgctcctgatggcctgggtcccaccgcccctcccccagccttcctgacagcagaggag

SEQ ID NO: 636523 - DNA, 438 bp, Homo sapiens
actctagagtatcccctgtattgccggtgctggcctgtagattgagtcctgattcaagctttgcctgatttcagtgttatccactcctgggttgcaatgtgaaggaggcaataaattcccttctttgcttcagtcaatttgaattgggtgttctgtcaatggcaactgaaatgttccaaccccaatattgaatttttttttaaacaaggtctcgccctgttgcccaagctggagtgcagttgtgtcatcttggctcaccacagcctctgcctcccggattcaagagattttcctgtctcagcctcccgagtagctgggaccacaggtgctcgccgccacacctggctaatttttgtgtttttagtaatgatgaggttttgccgtattggccaggctggtctcgaactcctgacctcaagtgatctgcctgccttggct

SEQ ID NO: 636524 - DNA, 375 bp, Homo sapiens
ttttggagatggagtttcgctcttgttgtaggcactcaggctggagtgcagtggcacgatctcagctcaccgcaacctctgcctcccgggttcaagcaattctcctgcctcagcctcccgcatagctaggactacaggcatgcgccaccatgcccagccaattttgtatttttaatagagataggttttcgccatgttggtcaggctggtctcgaactcctaacttcaggtgatccacccgtctcagccccccaaagtgctgggattacaggcacgagccactgtgcccggccgccttttatgtctgtcacagatgtgtgagcaaagttttatattctactactgggtagcctgtggactacagcgtgttagttc

SEQ ID NO: 636525 - DNA, 212 bp, Homo sapiens
agcatggctgctttagtgactcttctcttcacagatgtccggaggctgcactgcagcgcagccgcttttgggcgggcggccacgtggcgactacagcaggggactggctgccaacaccctccggctacggggccccttaccgagctgcccagactggtcatatgcggatggccgccctgctcctccaatgaaaggccagcttcgaagaaaag

SEQ ID NO: 636526 - DNA, 264 bp, Homo sapiens
aacgtaacacaggtacctatacgtaacacaggacctagacgctacagtgtaggaatttgaagatagatagaacaccgaccttggattactccggttctgaactcagtctcacgtatggactttaatctgttgaacaacacgaacactttaataggcggctgcaccatcggagatgtccgtgatccaatcatcgagagtcgtaaacccgtatagttgatatgcgactctagcaataggattgcgctcgttatccctacgggtaac

SEQ ID NO: 636527 - DNA, 103 bp, Homo sapiens
gccatctccagcaacgttgcagatatacggtgacacctggccttgaccgggcggctcgaacctggcggcctgggaccagcgtcttcttcctcaacagcccgtt

SEQ ID NO: 636528 - DNA, 649 bp, Homo sapiens
  misc_feature (36)..(37): n is a, c, g, or t
ggggaggggaagacgaacgagggcacgagtacaccnnaaggaacagcaaataataatgctttttatttagaacatgcagaaaagatatgcttttgaattataatacacaaatcatattggtctatttaataataacatattaataactcaacattagataagtatgagcattatgtgacaggcaatgcaactgttacagagtatggagaatagcagatatatttgcacagggaaacataggaaactttccgtaatggaggtcgaatggtaaatagatgttaagggaagggaaaatgggagatgacaggtgagaaaaggcattacagatagtgaaagatggataatgccccagaggaaagagagctgcagggactgcacagcagcagccaggccatttgctctttttcagacaggaatgaagcacagctggtagaagggcgggacagaggcaaatccattgacaactggagtgggggtaagggtttttgggtcaaccagagattttagggtaaaggtttggaaaagggagggcaggaataaaaaaagtttcatggcggggaagggtttttccaaaaaaaaaagggttttctgttgagaaagggaatgaaagatttaattttcttaaaaatgggaactttattcaaaaagg

SEQ ID NO: 636529 - DNA, 157 bp, Homo sapiens
gctagcagtagcatcagcaggctggggtggagcagggcatgttagtttagcggctgactctcaaccccatgggtagtgtttggtgaaggttgagggacctggactgctaggtggggggcatctggagtggtttagtcagctgtgaggatgcggctgg

SEQ ID NO: 636530 - DNA, 271 bp, Homo sapiens
ccctttaaaaagggtttgcctttttttttaaaaaaatttggggcccccccccccccccgcccggaaggtttgggggaaaggttttttcctttccccccggggcccaagggccccccctttcctggttaaagccttttccccccccccctttttttttgggtggggcaatggttttccctgccccccccccggccctgttttttttttttccccctttttttaacccctttttgtttgttttttttttcccgttaaagggttttttccggga

SEQ ID NO: 636531 - DNA, 531 bp, Homo sapiens
ggctgcaggaactcggcacgagctaggcagtgggggggggtcggagaaatgccaggactaagggacgttctaagaagagccggccccacctcgaaagacaggggggcgagacgggggaggccgcggaggcagagggaacgcaggctccaacggacgagcagcaggaaaacgtgacctcacccatggacgcgcataaacgaggccgccaccacgccaaacaaaccacgcgcgcgcacaatcagtacggaaccaacacgcccgacggcgcacgagcatgccgggccgccacacaccccaccgaccccaaaacgcacggcacggaaacaaacgcgggccctttacatatctcgccggggaaaaacaggagagggcgccctgccaagagaaaaccacgcaagacagaacgccgaacaacaaggaaccggacccacggacagaggcgacagaacaccacggccgaggagctggacgctaggccaagaccacatgccaaccccggggggcgcgaggaccccgcggggagggccaccc

SEQ ID NO: 636532 - DNA, 734 bp, Homo sapiens
aaacagccatggtgcgtataccccccagtgacctacactgccaggtccctaccctggccctgggggcacacagcacagtcctggtcccttcagtgagctgcaccatggtgacagtgcttgcatgtggagagatctttgagtgggatgcgcctgtgcatgactgtgtgtgtccccactgccagcagtgccatcagcaccaagatctcctacaaagattgggcttgatgaattatctgtgctgggtttcttctgcagcttcatgggatgtgatctgggctgctgcctgatcccctgcctcatcaatgatgttcaagtgatgtgacgcacacatgccccagctgcggagtcgctacatctacccgtatcggatgctgcctgtgctaactggattctgggactctgggactcccccggcttgtcggtctggccccctgtgctttgctcccttgcgctcagtggtccacctttcccgctcccacttggggcttgggacgcctgtgccaccatcccctagaagtcctgtcctcttcaccctgtccctatcttgcgcctgtttcacttcttctggctcgcacttctcgccgggcgactctgtgtgcccaggggtcgtggtgtggctgggtgcttgcacctggtgcttgtgtgttgctggctgcttgtgtgtctgacggggagatctctgcaggtggcctgctgggcctgttctctctgccgccgtgcggtcgcccatctcc

SEQ ID NO: 636533 - DNA, 726 bp, Homo sapiens
ttcctgggacgtccggttgacgcgcgtgtgctgcagagaccatgtgtggcgacggggcagaggctgatggcagcatccaggtgacagtggaatgaaccgggtacaggagcccagtgtggctggaccgtgtgtgccagcatgttctctgagtcaggtccacctgcagacatggtgtccgcacgcctagtgcctcacagcaaggaggagctacccgacacatcaaggactgtctgcgacgcagcagaagaagggagtgaggaccctcacggcggctgctgtcagcggggctcagaccgatcctctccaagctggagccccagattgcatcaggcctgcgaatacgccctacagggggctggatcaagttggatggagaagctccccatcctgactaggagcccacggagaaggtcctggctggacaccaatggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtacgtgaccggcggcgtcaatcagtcatgggctcccgcttgggccagatggtgctgacgtggggtcgacacggtgctggggacgtcggaggagtgagcggacaaccacctgccccttacggatgccgacatgacccgcatcgccacatccactggatggg

SEQ ID NO: 636534 - DNA, 512 bp, Homo sapiens
  misc_feature (16)..(16): n is a, c, g, or t
  misc_feature (47)..(47): n is a, c, g, or t
aacccctggctggaancctcacctgaagcaacctgttggaagggtcnaggggaatggcttcctgaagctaaaccctggcaggaaactgggctaacagcatggaaagctgcaggcagtggggcagaggctcccctaagaggctccctgtctccccacggagacaaagttgtcccagccccggctcctaaatagccgatacagaaggcaaaggcagggattcatcactgtgtggccttaactgcggtggggtctgcagcactcaaatgagtgcattaaagtgtgtgggttacgtggctgccagcagtacacccccgaactgttgccaccaaaggctgggcatttacagctgatcctctgtacttcagcacacacaggctccctctctccagccctcctgcctctcagcacaatctgggagtggagtgaaatgcgctgctgctctgccttcctgtcacatatgggagaaccacccctggcatttggatctttagactccaaggaggggaaccaca

SEQ ID NO: 636535 - DNA, 1160 bp, Homo sapiens
  misc_feature (531)..(531): n is a, c, g, or t
tctaattttttcagttgagctgctgttttcttccatgcaatatgtgttatacctcaattgtgtgtgttttagaaaaagcgtgggtgagagtgtgcccctccttacattaaattaagcaatgtgcaggtgttttgtgcatgtgcaaaattataaaaaatttaaattgtgctccgtgattctattttgtgtaaatgtggaagaaacaatctcattattctttctcataacccggataatgtggagggaagacatagtgtgcttgtggtgcattttgtgatatattattgtgagagttctcatatttttctccaccaatgtgtctcatatactttttgtgacgccagtgtgtgggtattctctctcatataagtatatctcccatagtgtcacatgtgttacacattccagaaatgtggcataaatataatatacgcgtggtgtgtattaaaaggtttgtgtgggtgttgtgacacagcaaacacacagatgtgggaataattaaacctgtgcaaatgtgtgggtgctaccacnaaaaaaaatgcaaaaacaaaaaaacaaaaaaaaaaaaaaaaaaaaaaaaaaaacaaaacacaacaacaaaaaaaaaaaaaaaaacaaaaaacaaaacaacaaaaaaacaacaaaaaaacagaaaaaaaaaaaagggagagagaggagagaagaaaaaaaaaaaatatataaacagagagaagaacacagaagaaaagacagagtaccgtaaaacgtgcaatgatataaaaaaacagagagaaggacacaataaaagaagagagagcagtactaactaagaacaacaacgagaacgagggagagacaagaaaagagacagaaaagcagggcggaccgagggaaaaaagaaaaacacagacgaacagcagatagatcagacgagaagaggagaaacccaaactcaacaacatatgagggtggggagcggaaaaaaataaaggaaacagaccaaaacaacccggaccaagaaaaacaagaaacaaacgagagacggagagaggataagaccacacaaaacaaaagacaagaaagcggaaagggagtatagaaaaacaagacaacgatctatgaggagtgacgaagcacagacacaggaggaacaaaaggatataatagaaaacatttacgcg

SEQ ID NO: 636536 - DNA, 286 bp, Homo sapiens
  misc_feature (36)..(36): n is a, c, g, or t
  misc_feature (88)..(88): n is a, c, g, or t
gcacccaccccgccgttgcgctgagcatgcgcgacntagctccctgagcatgcgcggggactccttgaagcccgggagctggcgtcgnaaccagtggaggtggctatggctgctctctgcaagctctgcctcctgggttcacgccattctcctgcctcggcctcccgagtagctgggactacaggtgcccaccaccacgcctggctaattttttgtatttttagtagagacggggtttcaccgtattaggctggtctcgaactcctgatctcaagtgatttgcccg

SEQ ID NO: 636537 - DNA, 162 bp, Homo sapiens
tcattgagcaccaggtggttcctgacttgcacagtcgtactcccactcctccagctttgtacgctggggctggcgttgccctcaacgaccagtttgtcaagctcatttcctggtatgagccaactaatttggctactgcgactgggtggtggacctcatggc

SEQ ID NO: 636538 - DNA, 795 bp, Homo sapiens
ggaaaattatgctggcgcaaagtctagtgatccaccttctcctagtgttcttccaaagcctcctactcactggatggcaagcactgttgaaaattccaaggcaaaagcagggagctgatggcagtacacttagaaacgctcctcagagttcaaacttagatttcagatttcagtatgtgtgtgaaacataattttctcccatatccctggtactcttgagaaccattggtacaagacaatgtgaaatttgccttgtgtgcaacatagccaattggcaaagatgttagtttagaaaattacatacaaacagcttgtattatatctctatatttccgctaaatacgtgtataccatgtattatgtgtatattcgttcatacttgcagaggtatattatacgtgacggctatgacagtatgtatttctgccctgcccacattgcagcgtgtctcgtcatataatacacgtggataaattctccctgtgtgctaaggcacatggaagaccgatttgatttgcacaaggtactgagatttaagtccaagaagacagctgtcatatctccaggtgaccgatctaacatgtgaacagtttgactaactgcacatactgaagtttaagactctgtgggcacaatcacatgctagcctgaggtttgtcactctaacattgatttgtagctctgcaagttactgaacaactcctattcccattttgctagactccaattccggctcgcaatatatccattccacgcttatgcctctaatgtaatggcaccaaattgctgtctcaa

SEQ ID NO: 636539 - DNA, 212 bp, Homo sapiens
ggaggggtaacggtggctggcgactattttcaggtacatccctctcatccacattccgatactcttcattggcagcaaatatctttgtcttcaaatcctattttgttggcttctaggaaaccagagcacatcttgtagtttcttcttactcgctgtagagccagaggaagatgcaatatatacacggatcaccatcctgaagaacagcatgg

SEQ ID NO: 636540 - DNA, 423 bp, Homo sapiens
ccgccagctaggcaagttgcaactccagtggtagcccctcagtgcgcccttcacggtcaatggttaagacctctatgtctatatgagcatggtaaaggatggtgcctggtgcggtctgtgtacatacagcggggtttcattccatggaagcagtgcacacggtagtcaatacggccagctccatgctagcccgcgacttcgttcaggttcctatagagctccaagcaggtgtgttgccatgtgtcctatccgtgcccttgagtcactttcacagttgactcttggcagcagactctctctcgagaatgccaggggtgctgacacctttgaggtagtaatgggtcagcgtatagagctcagaaggagccaggctcgagtggttgtccaacattccagcctcgtagttgatgtgcatgatgttcg

SEQ ID NO: 636541 - DNA, 442 bp, Homo sapiens
tctacatggatcccccctcgaaacccagtattgataatttatacttactattagccctttacagttttcttaaccttcctcttttacttgcacgctccatatatttatcgtcatacgcgttgtttcatcactaaagtatcctgtgattttaaacagtaatgccattggtttattgataagagcacgattttcacgtagcaagcacagaggctgttagtgagagttttcttcatcggctgctttcatcttggcacatagccctcgttctcctgccgtttcttgggcaaaactgctggcctcacctgtcacaatgtttcagtgtttccctgtggtttaatgtgaagtgtatccataaagctgatagtactacagaaaaaggaatgaagataaagataagaaactaatcataattttaccagatcgcagttttgattgtacatag

SEQ ID NO: 636542 - DNA, 877 bp, Homo sapiens
  misc_feature (60)..(60): n is a, c, g, or t
  misc_feature (144)..(144): n is a, c, g, or t
  misc_feature (154)..(154): n is a, c, g, or t
  misc_feature (171)..(171): n is a, c, g, or t
  misc_feature (248)..(248): n is a, c, g, or t
  misc_feature (281)..(281): n is a, c, g, or t
  misc_feature (298)..(298): n is a, c, g, or t
  misc_feature (317)..(317): n is a, c, g, or t
  misc_feature (319)..(319): n is a, c, g, or t
  misc_feature (357)..(357): n is a, c, g, or t
  misc_feature (521)..(523): n is a, c, g, or t
  misc_feature (533)..(533): n is a, c, g, or t
  misc_feature (659)..(659): n is a, c, g, or t
  misc_feature (661)..(661): n is a, c, g, or t
  misc_feature (679)..(679): n is a, c, g, or t
  misc_feature (705)..(705): n is a, c, g, or t
  misc_feature (731)..(731): n is a, c, g, or t
  misc_feature (736)..(736): n is a, c, g, or t
  misc_feature (748)..(749): n is a, c, g, or t
  misc_feature (762)..(762): n is a, c, g, or t
  misc_feature (777)..(777): n is a, c, g, or t
  misc_feature (783)..(784): n is a, c, g, or t
  misc_feature (790)..(791): n is a, c, g, or t
  misc_feature (794)..(794): n is a, c, g, or t
  misc_feature (807)..(807): n is a, c, g, or t
  misc_feature (862)..(862): n is a, c, g, or t
tttcatataattttcacttgtcacatataaatttcacctgtcattgtcacaaaatattantttgatttttttaatcattaaaaaaagtaaaaaccactctcacagcccttacattaaaaacgaggtgggccagatttggctgcnggtgggagtntgcagaccccagttctngaggggtaaactaatggtttaatgaccacagctgctgctcacacatcaagacagacagacatgggccgggcgttgtnactcatgcctgttatctcagcactttgggagantgaggcgggtggttcanttgatgtcaggtgttcganancagcctggccaacatggtgttaccccgtccctactganaatacaaaatattagctgggcgtggtggcatgtgcctgctatctcagctactggggaggctgagacaggagaactgcttgaacctgggaggtggaggttgcagtgagccgtgatcccaccactgcactccagtctgggcgacacagcgagactcccactcccannnaccccccccngacaggcagggtcagaagtgtgagtcctggattccaaggtggcaggtgtaatcagggagctaagaattcattatttttctcattcttggtccagttacctacagaaatggctcctgtaattacaanancaggaggtagggccaggncctgggggagaggagaaggggctggnagtgcaggagtgagagtcccagggantggcncactccctgttnnggtgggagttganacaagtgcaggcgcngaatcnnctctgnncgnttcaggtacacanactaactactactacacaactaactgacggacagacaacggggacactggggacnaactgtagaccgaac

SEQ ID NO: 636543 - DNA, 187 bp, Homo sapiens
ttttagacagggcttcacccggtcactcagtcttgaatgcagcggcgggatctcagctcactgcaacctccacccccagggctcaagggatcctcccacttcagcctcctgagtagctcagaccacaggcatgcatcaccacaccagggttttgtcttgttctatttttattagagacagggtctca

SEQ ID NO: 636544 - DNA, 593 bp, Homo sapiens
  misc_feature (13)..(13): n is a, c, g, or t
cggctgacattcnatgcaagtatgctgagctgaaggaaaagattgatcgacgttctggtagatagatggaagatggccgtacattcttgaagtctggtgatgctgccattgatgatatggttccggcaagcccatgtgtgtgagagcttctcagactatccacctatgggtcgctctgctgttcgtgatatgaatcagacagttacggtgggtgtcatcaaagcagtgaacaagaaggctgctggagctggcaaggtcgccaagtctgtccagaaagctcagaaggctgaatgaatattatccctaatacctgccaccccactcttaatcagtggtggaagaacggtctcagacctgtttgtttcaatcggccgtttaagtttagtagtaaaagactggttaatgatagcaatgcatcgttagtccttcagaaggaaaggagaatgttttgtgggccactttggttttcttttttgcgtgtggcagtcttaagttattagtttttaaaatcagtccgttttaatggaagcaacttgcccaaaaatttgtcacagaattttgagtcccattcaaaaagttagatgagaaaaaaa

SEQ ID NO: 636545 - DNA, 919 bp, Homo sapiens
  misc_feature (13)..(13): n is a, c, g, or t
  misc_feature (45)..(45): n is a, c, g, or t
gctccagtcagcnatggcagtgacggcgttggcggcgcggacgtngcttggcgtgtggggcgtgaggaccatgcaagcccgaggcttcggctcggatcagtccgagaatgtcgaccggggcgcgggctccatccgggaagccggtaggggccttcggaaagagagagcaggctgaagaggaacgatatttccggtgatggctcaccgggtaccctagtccagacctggatctcccaatggccttccagatccttaaactgtcaatcgccccgacccggttcctagctggtgccttgggcggccccatcgccgcaatagaattccctggtgcccaatccagtatacgcctaacccttgatgtgccgaactcgttgccacgtagtagggcactcccagtttacctgcgacaactagtgttcaggccaccgcaaaccgttttccaccgcgcgggtctccgaataacaaaccctacggcttcaactccttcgctttatcagttaccagtctcgccgctgtggcagttcgtgctcagggtcgtgcgaagagcatgccccagatttcttcgtcacagtgtctagatccgacccgcgccaaacgtctgagctccccagcctgaggtctcctcggtccctataccgcgacctgttgaggcccccgtcttacggctcgtcctttccttcgcccagtgacgcccgttaggcttttgcggatgccctgcattgcatttcacgggctttctcagtggggtagtcctaagagcccccgcgaatttccggcaacaggagttgagcgactgattggggacgcttggttccctgggaagctaacattaattaggttgggaacaccattacttcttacacagggctttctaggcactgtagctacaaggcgcagtgcctagtacccttgtagaatc

SEQ ID NO: 636546 - DNA, 719 bp, Homo sapiens
  misc_feature (13)..(13): n is a, c, g, or t
  misc_feature (45)..(45): n is a, c, g, or t
gctccagtcagcnatggcagtgacggcgttggcggcgcggacgtngcttggcgtgtggggcgtgaggaccatgcaagcccgaggcttcggctcggatcagtccgagaatgtcgaccggggcgcgggctccatccgggaagccggtaggggccttcggaaagagagagcaggctgaagaggaacgatatttccgagcacagagctagagaacaactggtcagctttgaaaagaagcagccatgaagaagaaatcgttcatcattaagaaggagattgatgcgtctgcagaaagaaagttgagtcgccataagcagcaagatcaccaatgctaagtcatgatgattaggtgcacaccgtgttgccatagcaatgggcacatgtcattgcccagcttctgtgtagacgatggttctggtttaagtaatatttgtctgtgtgctagctaacagatttatgatagattgtcatccggtggactacaatggatacggattaaacctctagtagagtgatgtattgtccgcgggggtcgggataagaggaggggtcctgacgtgggcaacgtgggacaaaggttgcttcacgggaagcacaagtgtttctgttggtcccagaggggagaaaagactatcgcgaggatcgcatatttggggaaggcgaaatcatttcggactgaggcgtggttcccgggtttataagtgggtgaagaaaaggcgaag

SEQ ID NO: 636547 - DNA, 440 bp, Homo sapiens
atcctgagctggtattctcataggataatgaaggtgttatcacagaactagtgtttctttggaataagcagtttctgaaatgtaagtagtcgaggcttcatatgtctcagaatgagttatatacttttctctgtagcttcatccaatacacttatgtagtggcataatatacctatgttttggcttaaaatatctgtgccagagggtatatctgaaattaagaaatttggccaggcatgatggctcatgcctgtaatcccagcactttgagaggccaaggcaggtggatcacctgaggtcaggagttaaagatcagcctgggcaacatggtgaaacctcacctccaccaaaaatacaaaaattagccgggtgtggtggtacacacctgtaattgcagctacttggggggactgaggcacgagaatcacttgaacctggga

SEQ ID NO: 636548 - DNA, 373 bp, Homo sapiens
tgctgggattacaggcgtgagcaaccacgcccagcccatattttctaatcatggttgtcacttcattctctgctcttccccagccccttaaaaacctggccatgcctcaggcattaagtgatctcaggtgtacagtatataatctatagatagatccatatccctgaacttgttctaactgaccccagatctcacagttgggttcccctctcacacatttcacttatctcatcaaactcaaccaaattgctccccttggttagaccagtggcaccacagttttttataacctttggacttgagagacactttaacttctctgttccctttattctctatatgtgtcagtcaccagagacctattataggctta

SEQ ID NO: 636549 - DNA, 375 bp, Homo sapiens
gaatattctgttgttgggtggcgtgtctatattccgttgttgggtggattgttctatattctgttgttgggtggattgttctgtattccgttgttggtgtagtgttctaaaatacttgtggttggtgtagtgttctatattctgttgttggtgcagtgttctatattctgttgttggtgcagtgttctatattctgttgttgggtggcgtgttctatattccgttgttgggtggattgttctatattccgttgtagggtggattgttctatattctgttgttgggtggattgttctatattctgttgtcggtgtggtgttctatattctgttgttggtggagtgttctacatactgttgttgggtggcatgttct

SEQ ID NO: 636550 - DNA, 198 bp, Homo sapiens
gtcgacagtccattccattcgatgccattccatttgattctattccattagtctccattcaattccattaatctccattccattccattctactccaactgattccattccattctattcctttccattccatttcattccattccattccattccattccattccattccattcgtgtccattccactccagtccat

SEQ ID NO: 636551 - DNA, 495 bp, Homo sapiens
cactggtatttcctggagtgaaatatttagcttttacctacgctagctcttattcttgagtagataatactaaggatgatagtatgtgtgtctagttctgactttctactgactcatacttgcgaaatcaggtctttatttatttttttcttgagacaggtctcgctctgtcaagcccgggctggagtgcagtggcgtgatctcggctcactgcagcctctgcttcctgggttcaagtgattctcgtgcctcagcctctcgagtatctaggattacaggtgcatgccaccacgcctgattaatttttgtatttttagtagattcgtggtttcgccatgttggccaggctggtctcaaactcctggcctcaggtgatccgtccgctttggtctcccaaagtgctgggattataggcatgaaccaacacaaccttgccaaaaaagccaggttcttttaatttatttcacttgttcccaattttatctaacttaaatt

SEQ ID NO: 636552 - DNA, 298 bp, Homo sapiens
  misc_feature (191)..(191): n is a, c, g, or t
aagttcccctcttaccccacaaaaggaagtctaagcttcccgagccctgcctgtagggcaccctttcacatagtgcactggtcccaccttccccagcttccctcttctgctcttcccagcacccaatcctatccaagctcgtgttcacatctgaaatatgaaagtcctggctgccgggtacagtggctcanacctgtaatcccagcactttggcgctgaggcgggcagatcacctgaggtccggagttcgagaccagcctggccaataaggtgaaaccccatttctactaaaaataca

SEQ ID NO: 636553 - DNA, 1218 bp, Homo sapiens
  misc_feature (570)..(570): n is a, c, g, or t
ggtcccgccccggcgcagcgcgcgcaggctgcggagccagcggtggtgacgcgaacaacgattccgggtgatgactgctgacgagcagattcggcatggtgacgcggagctgcggcctgactcccgatgtgcgctctgtgccagccacccgacctgatgcgatccgtcggcagagtcgtttgcctcggaccgggtgtttggtaaggtcccgtgcgtccagcgcgcccaagggcgcatcacgccactggacgacccggtcactcctgctcgaatgttatcgaaagctaactggcatgaatcctttgtcagagtattagccggaaggacattgagtcgaatctcttgttgccatttgccgagcccgaggggtgatcaaaagcaatttgctcgacgggccacccgggggtggcctctttgaggttaaccccttaactggggacataccaagaggactttcgggttaaacggtgccttattatattcctgattgaaaggcgaaaacgaacatctctttattgccggaacagctgtaaatcagaaagggtaaagccccgaccaactggaaccggnggccccagggggacctgaggtggccattccccttaccgaggtcccgtcatcacccccaatgcccctttccggcttcctctcggacccccgccccccctttccaccctgttcctcattgtaacgttaacccgccctattttaccgttccagttggagaaacccttattggaaacattttttcccgtgaaaccaagttaaccgaaaacggggggcgcggggaaaaatgtgggcccaaaggagcaaagttacttttgtggacttcaatttttggcacactttgtcatttgttggcaccggccaggaaggaagagagaatacaacatcaacgaccaacgaggtgtgaaaactcgggcacctttggttggtcaacacacttttcccatgaacacacccagacctgatgaaggacacaccacaagagggcggggggtacacattgaaacggctgaacaacagattggggaaaaagacttggggcgaaaacttctgattaagaacccccttttgaaaaggtttgtgaaacactaaggggggaagagggggaaagggaaccagctttgaaaggccagtttttcccgaaaagcgcacctgaaggcttaggcgcaaaggaggggtgaaaacaccgctttttataaaaacttgggatag

SEQ ID NO: 636554 - DNA, 606 bp, Homo sapiens
accaggattcacgggtccaagaatcaaggggtggaagaggaaggggccccactcactatcaccctaagtgatcccctagcaaaatttctgtttcaggtccccccgacattatgtctgcttgtctaaaaggtctaagtcccaaaagaaggacccctgccaccaggaaacacaaggacaattccattaaactggaagttaagattgccacctggacactttgggcttctcctaactttaagtcaagaggctaagagaggagttacagtgttggctggggcgattgacctggagtatcaagatgaaatcagtctactactccacaacagaggtggttttgtaagtttttcgaggggtgcttgactgtgatacgttggagactctggggttccaaagaaaaacaagacagaatctccctgccatcaccgagctcgcatcccagaaaaatgctggacttgtggttctcacacatttccaggttcaactggctgccgccttcctatcagcacccgccagaatccgaacagctaaaagttggagagagagggaacgttacaatgtaaacaattaataaaagctaatttggccatgctcttcccaggaaaaaaa

SEQ ID NO: 636555 - DNA, 906 bp, Homo sapiens
  misc_feature (54)..(54): n is a, c, g, or t
  misc_feature (62)..(62): n is a, c, g, or t
  misc_feature (89)..(89): n is a, c, g, or t
  misc_feature (123)..(129): n is a, c, g, or t
  misc_feature (132)..(133): n is a, c, g, or t
  misc_feature (150)..(150): n is a, c, g, or t
  misc_feature (168)..(168): n is a, c, g, or t
  misc_feature (174)..(174): n is a, c, g, or t
  misc_feature (183)..(183): n is a, c, g, or t
  misc_feature (192)..(192): n is a, c, g, or t
  misc_feature (235)..(235): n is a, c, g, or t
  misc_feature (251)..(251): n is a, c, g, or t
  misc_feature (258)..(258): n is a, c, g, or t
  misc_feature (316)..(316): n is a, c, g, or t
  misc_feature (322)..(322): n is a, c, g, or t
  misc_feature (382)..(382): n is a, c, g, or t
  misc_feature (385)..(385): n is a, c, g, or t
  misc_feature (389)..(389): n is a, c, g, or t
  misc_feature (419)..(419): n is a, c, g, or t
  misc_feature (433)..(433): n is a, c, g, or t
  misc_feature (524)..(524): n is a, c, g, or t
  misc_feature (820)..(820): n is a, c, g, or t
  misc_feature (832)..(832): n is a, c, g, or t
  misc_feature (898)..(898): n is a, c, g, or t
gacccgcacccccccccccgggccgccccccgccattttttcccgcgtctcttnccccaccncgacaggccccgcagaggcatggaagnggcgggaaaaacacaactttgtctttgaaagggnnnnnnnacnncacaccaaacactgccnctgcagcaggcgggagangcggangggcggccnggggggcancctggcctgggaccccccgaaccttgaagactccccccccccngccccccccggaaacnggggggngggcgttagtgggggtcccttgtagggaatttgcagagggggaatcctgaaaggcttncccacncccccctgacccgttgtcaggccgggatgcccggggccccgggaggagacgccgcccatncgnccancttgagggggactaatcatggagattctcncagggccggctgcnatcccagattttctaatcggagaaggagagaaatcaacttccatcgactccagtttgaaactgaactttttattgtgctgaaagctgtttnttgtgatgatctcatactaaatagatggagaaaaggtattgaattaaatcaaaaaaactgacttccccccaggccatcccaactgaaagtgtaagaaggctctgaatcagtgaaatgttcttactgggtttgcaaacggcatttcacatgaattcagcagttcccatagcgtcctgtgagtcgcacggccctgctcctccctagcgctgaagccaagtgaactcaacaccccactgccatttacatcactggctcttacaactgcaactgtcactcagcacatggccactgcgggngttaaaggtgtnaaattaagacctgacaacaggagccactaacgcaccagctttgaaaatccggggattccggacggnacagcctg

SEQ ID NO: 636556 - DNA, 697 bp, Homo sapiens
ggccatcacagttgactctgaggcaggagccaggctatgtacaccctctctcacaaagacctacaagggaggactgtcccaaatttacagatccagagatccagagaaaggaaatggcactttaagatcacacagctaaactaagaaacagacaaacctggaagtcagggctttaggccccacccttctttctatagtttttttttttttctaaatccaaggatgttcctttctctccccactccccaataatgggctgcatatgatttccaaggtttaaaacttgtaaacatgaggtggacagaaggttggggaacagggcaatgccaagctgtgggcagtaaagaattttaaatagcaagagtgtcctgacaagctcttttaagatgatggggtgaggaaaaggctgtgtacgtcacaggtcgccctgccagtagggcaaacgcaggagagccaggtctaccaggaccagagggtgcccgaggcccaccgggcttcaagggacacacaggcgattctggtgcacccggtccccggggaaagtctggtgccagggggctccgtggtcaggaagggtaccaggaaacgatggtgacactgggacccactggggccacagggtccccaaggaccagggggcccaccgggcaagaatggatcaccgggatctccaggaaagcctggccctcaggaaccc

SEQ ID NO: 636557 - DNA, 299 bp, Homo sapiens
tcttatttttattatagtaaaatatacataaaataaaatgtattattttaactgctttaaaagggtaaggcagtggcattaagtacatttacaaggttgggcaagattgtgaaccactgtctgttgcagaacgtttgttactacatccagtggaaattgtgtagtgcggggtagctcttattcctccgtgtaccctctgctcctgggaactacagatctgttttctgggcgcggggaacatgccgctttaaataatatttcatataaatgaaatcagacaataaaaaggtattttgtga

SEQ ID NO: 636558 - DNA, 1459 bp, Homo sapiens
  misc_feature (518)..(518): n is a, c, g, or t
  misc_feature (1426)..(1426): n is a, c, g, or t
gggccagcgtgggaatcctcacccgcgactgaaggcggctggtatctgtgcgagcctgtgtgctcttttcgagaccgcatgtgagtcgggaggagatccagcttggctggcagccgcctcggttctggtgcctgggattcgatgctcgagacgaacggagggatgctgtctggcatgactggtgtggccgaagcggagtaacctgcagtaaccctgactcgtacggctggctcggaacagccattcgagcctacgattgacgccagcttgcggccgctgcgggactcggtggtaccagcgcgggtgtagaaggccgaactccgacctacgatacttgctgctcgctgcacgtcccgggcccatgggcgcggggctttctggatgccttggcggccccacggtgcccacccctggagtgggaccccgagcaagggtttccttgttgccacttttccgcgcattgcgagactaccgaagtcacgtcgcaagttctcgcgaaagggaagcagaggtatgcntaccaaagcaaattgcgactgttgacgcgcccagggaatccataccgacgtacctatcctttaaggcacataggttccccgaggaaggaaaagtagttcttgtgaacgccattcggccacttgtgaagaagtcccttccttctaagttgggtacgttcccaaccgccactacaggactatttcctcctttatcccgttgtccttccttgatttgttgccaaacctattcccgaacggggcccattcgcgttcgcacagacgttcgcgtatttacttgtcgtttaggctcttctcgcgggtatgtacgtactgtcccccctgggttcccgcttcttcccccgggtgtgtatccctttatatcacagtccaggagtcccttggtgcctaggtgtttgtgcccggtggccggggcacttaaggcgacgaaaccgttttcccgcaagagcgttcgagagagcgcgtatacctattgcattgtggcttgttttaacacagcggccataggggcaattggtttttgggccattccacaaaagttgcgcgcaagagaagcggcttgtctgtgttccctttggaggcgcaaaagagcgcctattagttttggagaccgcttggagatgtggcccctccctttgtttgaccttgcttttaagttaatattgtgagccgtcgcgttctcaagctaacacgtacaaggacagggttccctttcccagttacggagggcgcaaagtgggcgccacatttctagaacgacgcgacaccgtttgtcctcttttggcgtttggggcccacaggcaaggaaaagaggccacatcccttaaggtttccaaagagaggaagaggcttttgtcgttacagagcccctagggctacaacatatacaccaattgttgttggtcgtgggnttatatatccaagggggggctctagaggacacg

SEQ ID NO: 636559 - DNA, 304 bp, Homo sapiens
  misc_feature (301)..(302): n is a, c, g, or t
ctctagcaggatcccgtgatgttatcgcccaacactttgggaggcgaggtgggcagatcacgaggtcaggagatcgacaccatcctggctaacacggtgaaaccccgtctccactaaaaatacaaaataattagccaggtgtggtggcagacgcctgtggtcccagctactcgggaggctgaggcagaagtgcttgagcccgggaagcagaggttgcagtgagccaagattgtgttcctccctttcctgatctcttgtctttgccgtctagtctttggttatttggtgttggaggataacnnat

SEQ ID NO: 636560 - DNA, 1725 bp, Homo sapiens
  misc_feature (1232)..(1232): n is a, c, g, or t
  misc_feature (1471)..(1471): n is a, c, g, or t
cgtgctagtcgtgacttgtcgttgtatgattgagtacgtcggcaccatatcaatgcataccgcgtcatctgcttagttgtgcgggtggattgaatattttccgctcagattgtgttgccttcgttctttgtggagcaacataagtgagctttgtgtaccaaaacggcgggttggtccgcgtctgattttcccgcgtgattatgttttacaccaacatgcgtctctgaacatatgtggcgcgggtaaataattgttggagaccgcaccagcttttctatcaagaggtgtagtttccccgctatgtcctccaaaaagggtgttaattcagtgggggacacacaagggtatgaaaaggggcgtaaccccttcaaagcgtttaatagttcctcatcagaatagggggggagaactccatcacttgttgaagaccggacaacacccgtggtgccctgtgtgccaagagggaatatttcgcccaaggttatttttcccccggaagttctgtcccacaaagtgtagtttcgcagagaaagggccgccacattgttactctaacgaacggggataatgttatcttcccatagctgccgtcgtttataatattccaccacaacaggtgtttgtgcatacaataggctatacataacaagagataatgggaaggacaaaggggttttcctttctgctcaacaaccctgtggttgttacccgcaagaaggcccacaagattttgggtgtgggcggtgaacacacaaagtgaccgcggcccgggtttatcccccccggggggttgggtttataaaaacttttgctcgcccaaaaatatggcccctcatgagtaagtgttatttcccctaaggctgtggagagagaaattggtgggccccttcccgagaaaaaaccgtcggtttgaagagaccccccccgggccgctcatatataaccccttttcacgtgtctacgacaacacgcttgtatgggaaaaatacctcggcggagtgccaaccgccactttaatccccccctcccgggggagacccacatttctttggagttctagatcgcgtctacacttgtgagacgctccaacacaacaggggcgccaacacagaaagggctggggttttgttcctccctggagaagcacagacttgtggccctaataaatgcgccgcttatatttaacctgtgtgtgagaccttggagaccctcttggggtctcctcacacatncgagaggtttctcctcttatcggagaagagatacaccaccccaccggagaaattttggtgtcacagtgtgcccacacactgtcacatacgccacatatagtctgagatatatcacggcacacatgggtataagaaatcctccacacagaacacattttatactgagatggccttatacttctaaagagaagaaaagagaagcttgtcggagaagccccacgagacacccacggagaagngtgaagagatctttctgagcacacacgaataataagaagaaaattaatgaggagattatcggaggcacgcgcaaagagttgagtcagagaaagctgtggagactcacacaattttacccaaaaatcacaagctaattcctcaggtcacaggggtaacctgcgaatctgtgtttgctctgacgaaatggaaatttaatcctcaccaaattggtgttttaaaagttttaagaacctaattaaatagctgactacca

SEQ ID NO: 636561 - DNA, 110 bp, Homo sapiens
atggctcgaaaaggggggtcatcgtccacatcctcagtctcacctttcgcttccagcagaggagtgcccactcctataagcactctcacatttggatcagtcaaggttgc

SEQ ID NO: 636562 - DNA, 513 bp, Homo sapiens
gccaagatcatgtagaagctgacgatcccgagttccgaagacctgtatggccgacctcattggcggatccgaaggtcctacgcgtcgtcgccctgtctggtgggtacccccgtgatggggccaacaagaagctggcacgcaacaagggactcattggcgagcttctctcgtgcttttggcgagggactgaacgtcgcacagtcgcagcaggagttcgatcagactctgcgctccttccatcgactcgatttacgccgcctcggtgtcctgacccttcgacagacgggcccgctgggaaacttgcgggcccgttgtcatgcgtgagctttcgtcggccttgtacagttcgagggtgattcctgaacttgtcgcgtttgatctagacgacccgttggccccttcgaaaactcggtcttccccaggagatggcccgcatcgttgctcgcttgcttgatcggacgagtgtgtgtgtcatctctggtggccagttcggtcagttccggacttcggtcg

SEQ ID NO: 636563 - DNA, 292 bp, Homo sapiens
atgtcgaggatcccctaggctgcggaagacgggaacacccagagggactcatgccaggacgactccgtagagcccctggggtgcaagttgaacggcacctggctgcaggcggacgagctcagctgccgcgagggctgtgcccagcccaaccggcctggcatctacacccgtatcacctactacttgaactgaatccaccactatgtccccaaaaagccgtgagtcaggcctggcttgaccacctgcatcactggaggaccaacccgtgctgtccaaaacaccactgcttcct

SEQ ID NO: 636564 - DNA, 217 bp, Homo sapiens
gttcagtttggttgccatatggtgtgtgcctcccaatccctggctcctggtatgtaggcggatacatgggagttgggcccacatccctatccagcatggtgccgggattggaaggggggaaaggcgttgccgttcgggggctccttcggcgaataacagcttgaatgactttgaggaacaaccaggacaggcacagcccactgacatcttcacatcg

SEQ ID NO: 636565 - DNA, 449 bp, Homo sapiens
  misc_feature (3)..(3): n is a, c, g, or t
ccnctagcacttccttaccattcctattttcctctctgagatacagtttttattctaatcctggctcacagactaatgtatgcatctggtttcctcattgacatctggctaacttaagtctgccaggttcataaggcatgaaccctaattcccagactttctccatctgccacttcctgtgtggccctttgtttacttgatataaaatgaattaaagtagttcatttctacctttgagtattgattagacattgattaagcattgtcctctgatttgaaattaaatactttaggaaatcaaatctgctttgtgaaagtataaacattttcatttacttattcatggttgattgcatgtgcctgacattgtaaaaattaagtgtatactaacccattctttggtttctgggtgtattaaagtgtgaaggaatggtgagatactagtggca

SEQ ID NO: 636566 - DNA, 483 bp, Homo sapiens
  misc_feature (290)..(290): n is a, c, g, or t
  misc_feature (296)..(296): n is a, c, g, or t
  misc_feature (312)..(312): n is a, c, g, or t
  misc_feature (346)..(346): n is a, c, g, or t
  misc_feature (354)..(354): n is a, c, g, or t
  misc_feature (374)..(374): n is a, c, g, or t
  misc_feature (384)..(384): n is a, c, g, or t
agccagagagtggggctcgtttgccggttgctccagcccggcgcccagccatcttccctgagccagccggcgggtggtgggcatgcctgcctcaccttcatcagagggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggcaanacgggnatcagggaaggggggnaattttggcaaaaggcagaatatgggaatggggnaggtaggncccacccgttaataaacgtnatagacatgncgtcaaaaaccggaagtattttctgtacatgtttggttaattttttttgtacatgatttttgtatgtttccttttcaataaaatcagataaaaacagtg

SEQ ID NO: 636567 - DNA, 117 bp, Homo sapiens
ataaaaactcctcagtatatagaaagagggagagagagaaaaaaaggaaaagatgagaagagaaaggaaaccccccaaagaaacggaggaagggaggaaattgtgtcctatttatct

SEQ ID NO: 636568 - DNA, 657 bp, Homo sapiens
ggaggctgttgcaggagaaacgctcgaacctgcgaggcagaggttgcagtgagctgagattgagccactgcacttcagcctgggtaacagagcgagaccccgttgtaagaaaaaagaagatgtcaatggtcatgggggaagcagggaaggaattctcaagcaatatgaatgtgtgtgcaattcaaaacatgtatttatcccagccctgcccactagctccctcactagaaacaatcatttcaagagttgtttggactattttttgtcatcctctcagaaagaatatgctaggcattttcatttgtaaaatggaactgttactttcctcataagataatgtttagaataaattgagtcagtaaatgtaaaatacaaggtgagataaagtacttaataaaagttattcactttcccaactcagaataggtagcctaagagtgtggttacacttgagctattgaaagctggctttcagagcccctcacatacgtgggaaggggcaagcaatgtgttcaatgcgcatgtgttttggtaaatctgcgtaaggcctggtgtttgatgtctgtgtcccttcccaattcatgttgaaacttaatctcactgcatagtatttagaggtggggccttttagaaagtttgtcgcggctctgctcttgg

SEQ ID NO: 636569 - DNA, 240 bp, Homo sapiens
acggaatataggtaataaaggtctggggagatggtgaccaatacgtgtacggcggctgcatgctctggaagcctggactctaagctggagcacatggaagagctcttcggtatctgagcataatgctccccatctcctgctatctctgcaacagaaacaacaagagcgaatgcagggaaattgctattttatttgtcttccatgaccttggctgtaatccagttatgccgtatcggatgt

SEQ ID NO: 636570 - DNA, 496 bp, Homo sapiens
ctataatgcgttcacatatgagagaccatgtggtcctggcttacggttcctgcatagggggctctaggataatgacctgcagtgccatccaggtggatgcgagcacagtgatcttgtacctttatatggctgtgtagtatgctatggtgtatatgtgtcagattgtctttatccagtctaccatcgcatgggcattacaggtagagtgcaagttatgctatagtgaatagtactgcagtgaacatatatgtgcatgtctttatggtagcaacaatttatattcctttggacatatacccagtcatgagattgctggcttgaatggtcgcatgtttcaagttcttttagaaatcacccaactgctttccacaatggctgaactaatttattttcccactagcagtgtatacgcattcccctttctctgcaacctcgccagcatctgtaatttatgggcatttaaataacagccattctgattagtgtgatggcataa

SEQ ID NO: 636571 - DNA, 215 bp, Homo sapiens
gcatagacaagtggtcaccacggccagtcgggacaagctcaatcacttagtcttgtttgacgaaagctacctatataaactctgtaaggaagttcccaactattaacttataccccagctgtggtctctgagagactgaagattcgaggctcccttgcctgggcagcccttcaggagctccttagtaaaggacttatcgaactgggtttcgaggg

SEQ ID NO: 636572 - DNA, 132 bp, Homo sapiens
ctagaggatcccctctttgctcccagattccaggagctttaccagtctctactgtcatggcccctggcttggccaatcgtcttcagagtcgtccagatgaggaaagtaacagttagagctcctctgatgaag

SEQ ID NO: 636573 - DNA, 1049 bp, Homo sapiens
gatatgccaaattgatgcgctgccagcagtccggattcggttaatggaatggctcgagtaggaactgatgatgtgtggaaagctgagagctttgggggttattctgccaagaaacagtatgttggttagcaacacagtaccctggcttcacttagtatctcgaatgttcgctctgcctctgaatctggatttagatatgcagcatgtagtgtggctgaggctgttagtgtttccagtatggtacttcatacttccaagactagaaaatggacgtgttagacaaagctgagtgaaaggtgtgtgcacgtggaacctcatagggcttgatgtgcgtgggcgtttctagacattgtatgaccatagtgtcgccattataggcatttcctcttttaggtcaacttagtatctgtccttggggtctggactcaaccagtgtggatatcgaggagtctccgaaattctaggcaggtgtagcggaggactatctatcgcagggtctgggttagatgcagtcttggaggacaccgttatctaatcgtcgtaggggatcccggggtacagacatggtgtccgtatagaagcatgacacgttggaaggacaggaacggattggactagtataatccctcgggaactaaaggggccatcgggggagacgaacagatggatcagccaatgcgggggtcagattagcgtgatacatgggtggcgctaacccgctaggatggcgcgaccaagaacagagctcgggtgacactccctgacacggagaggggaaacccgcctacaggatgacctagaggcattaatgaggcaacaacgaggacgcggagaaggtaaagcagaggttagacggcggacacgacttacctagtaggaactgtcatgtgtgagacaagggtggactgccagcggaggcggaagaactgtgatttgcgagacgacgaatcgctgagaaaacataaagaagcgccggaaaaacacacaggaacaaagaacgcaacgagcaacaagacagaatggataggacgcgaacaccacacatccac

SEQ ID NO: 636574 - DNA, 300 bp, Homo sapiens
atctatgcaggagtaagtaaaaccatccagaatcaagcagcaccacatagtcacatcaaagatcaaggtgaatttttggatcactgcctgtggaaatctatcctcatcagtcattgcatttttcccctgcctataccctgtgctcctttttctttactgtgttattcagtcacttccctttctgtgaaaggttgcttagcttttttttttgacatttgttgttctttatataaaaataacagattggatagatgtgtacatttggtgtttgaaattctctgaaaatcccattaggaaacc

SEQ ID NO: 636575 - DNA, 236 bp, Homo sapiens
ccccccccatttggggggtggttttccctcccaggggtagtttttctccccgggataaaggggcccaatttgcccccccaaaaacctcatggctgggggcctccaaaagctggccgtttcccccccctcaggggggttaggccgtaaaatccttttagccgggggggcaaagatttcagtgagcccaaattgcatggctcccctctagcctggggggccgggtgagactgtttcca

SEQ ID NO: 636576 - DNA, 341 bp, Homo sapiens
cagcttgtggaccgcctgggtgttggcaccaatctgcagatagccttcattctgattgtactctggccagtggggcagcccttccccattggggttgacattgcgagcaaagttggcccagaaaaatggggccccaaagacggagaagagctcatccccgtggtctcctatcaccgtattgggtttcatgtatgatgagaagcttggacggtactgaaactcaacatagtaggtgggtgctccagcatatgcgcggtctcggtctataactatagatcgctctctatctctctctctctctctctctctctctctctctctctactctctctctctctctc

SEQ ID NO: 636577 - DNA, 194 bp, Homo sapiens
tgtcacccaaactcgtcgcccttcaaggtaaggtcgactcgttcaagaaaaaccttgagcagaccgggctgggcaagctggatatcagggggctgttcaagggcggcagcctgatcaccccgtttctggacgggatcaaagcctgcgatgcgttcaagggcaaactggccgaggtcggcgattccagcgcgccg

SEQ ID NO: 636578 - DNA, 803 bp, Homo sapiens
ctggcgtgtattcctgagccttggtgtctggcggtttccgaggcgttggtgtctgtgcggtttccgatgcgttggtgtctggtcggtttcacgcaccgttggtttctggcggtttcctgaacggtggttgtttggcacgcgcctgccctacctcgttgactatctggttggcttgcccgatgcccggagtgtaccctagtacgaacgaaagcagaacgtaatagactgattttgatgtgtagcgagcatgtccaactccgacgtgtgtgatagaaagaacacgctaggtggacaacgaagcactgaaagacaaggccggtgggggaattatccaaagaacggggtcccaagcggtcacatcgtcatagccggacacacagtacagagccatcaagccaatgagtcttttcatatgctgctgaaagctgcctaaatagctgaccatgagcgaggcaccgagaagtccgcgtgagagtgcgtgaaggctctgaaagggcgtgtaacggtaaccgggacctgaaccgccatgccgtggagctcttcacttgtggccgcttcaatggactggatggtatccgatgatcatggaacagagagtacagtgtggcattggaggcccgtcagataactgataacttatccttaagaacatggcacagggttgctgataggaccgtggactgtgagagctgtctacccattgtgtaggccctctaatgagagcctggcctctgctgtgagtgaattctgacacggaaactttactaccaagagtgcaaaataggacgatggttggaaaaagc

SEQ ID NO: 636579 - DNA, 316 bp, Homo sapiens
tcccctaaattgcaaggtgaggccgggtgtaaggttttccctgagactagaatatgtgaatgcatgtttgagaattttaaagcacgatggtcagaaccagaagctatattttgcatatgggggctcagccatccatggagagcccatgtgtcctctggacatagttagtcaatagaagtgggtgttaagtagtataaaagaaaacttgtgatctgtgtagtttatgtatcaccgtcatggtaaatttagcaggaagtgcggcgcaggtatgatttgttttttgtgcaccagtgagacagtaaagatgctattaaca

SEQ ID NO: 636580 - DNA, 589 bp, Homo sapiens
gaatatttccaccattatgtaatatttgataggtaaaaaaaaaaaaaaaaaaaaaaaaaaaaaaaaaaaaaaaaaggggggaaaaaaaaaaaaaaacccgccggggggacaaaaaacaaacggagacacggatgtgggaaagggggcccaaaggggggaaaaggcgtggaccgccggaataacacaccgacccccgcacgggggaacaacggggccagggggggaacaacctctggtgaaaagaacccacctcatggggggggagagcacaccatcgtgcgggaaaaacacccccaagaagaagaaattaaaaccaccctgatgggggaaaattatgacacaagtcgtcggaaagagagtctaatacaggggtggtaaaaacagagatgagacaatatatggcaatagccagagcagttgaaaaaagttagtgggcgcctaaggggagtattgtagaattatcggcaacgattctattatcacccgggggagcacctatcgagtatacaaaggagaggacaatagagaaagaaacataaaatataacaacaatagacaactaagaacaacaagacatatagaaaaagaa

SEQ ID NO: 636581 - DNA, 153 bp, Homo sapiens
ttgtgatctacagatgcttaagcatcctaaccagccctagccgggcttatggctcacgcctctaatcccagcactttgggaggctgagacggtactgttgcctggggttgggaattcgagtccctactaaaaatacaaaaattagcggggcgt

SEQ ID NO: 636582 - DNA, 275 bp, Homo sapiens
cacgagggggaagttgaaacaatgaagataaaaattcattttctttcagatgagccacacttgatgcttttattactaacataattgaatcgttgaaccgcacagagaaaaattacctcctttgttgattttatcatatgtgaattagaaactaatgggttctttgcaatcctttggcttacctgcaccggttcctgctctcatgtgccttcctggatcaggtcggccaaatgcacttgactttataactcttgggaatgatgattagaccctac

SEQ ID NO: 636583 - DNA, 1146 bp, Homo sapiens
gaaacgtgaagaaggtgaagatggctggtggccagggccggggtcttgggagtccagtggctgcaaaggggcatcccggaacgtgatgccgctgggcgcacggacagcctcccacatgaccaaggcacatgttcccggggccctcatcctcaggaccccagcaagcaacgggccgccgccgccaaagcaagtcatcaatcatgcgtgtggacagcatcacgcaaccttacccggcatgatggcaatggggtatggcagaatacccgaagctcccatgaccgactcacagcatgagcgagatccatggatatagcatgggaccagccgggcctgaggttgaactggggatgaaccgatgcactggaacctagacactgtacaacaggaaccgtgtggacatacatcccccagactggtatacttgggcatgtcatgtgtatgcaagatcattcgagatttcctgggttgcatgatatcatgtgctgaggtgggcgaaagtgtaccctggttctatcagccatgtgggaccaaaagcagtatccttacaatacttctggtacctggaacgaggcggtgatcactccaaaagaacccaacgcgggtggctcactatgagcactgacggaggattcgtggcggctttggggtcttctaactaagggactccctcaaatcactagaaactttaaccttccattgaacttccttattcacacttcagtggaggaggtaaccacacacacaacaagacaacacctcaacaccactctcgccaacaaaagcgcacaagcgaaagcgctaaacacacccacacgggcaggacccgggggcaccaaaagcagagcaaaaggggcaacgacgcacaccaaaaggaaccccgtgcaacagacacaggcgttggtaccacaacacaacacggcggggagccacagcaggctaacacgacgccgacggagcagtcgcagcaacgggataaacaacgcacacgcgattactacaccagcagcggcgtcacgcccgcagaccgcacgtagagagacgaccgcggcacgcaaggacagagtagcagtacacgaagaggccagcgcccacgagcgacacacacagacgaagaaggaacgaacagactcagcccccacgccgacg

SEQ ID NO: 636584 - DNA, 1011 bp, Homo sapiens
gtccatcgcgctggtctctctcgctggtcgtgtgccattttcgttccccatcagtcatcttgcctgattgcggtactcttgtccttacagcagtgcatacttcttcaagggcccaatgacgtacattgtttcgggggtttggattccacatcatgggtggttgttgttcccccgctgtagctgcaatgtccactgtggaccttgttatccgtgtgtctctggctgctggtgctccggtatgtcgtcgctcataggtttcgttctcactgttgtgtccgtgaccattgtgatacgtaatgctcttagtgtggccttcaactttgtatatttcgcgtatggccttgtgtccttaccccagcggcttgcgttccgcgccatagtcattgttgtagctctgccagtgttccctgatggcgtgtgggtgtgtctgagtcgggctgtcttgcttggccccactgtcgcccggcgtttgtgacattctcacgagtggcatttcgccgtgtgcttgggcctgcgtgtgagtcgtttgtgatcagccccattcttccaacatgatgccttaggtctaagttgcctggtgaatgtgctgtctgcgtgcggagtgggccttcaggctgattcgggcaccaccctcaacccctgttctgctggtaacagttgctgttactgaccgtggctggcgctcccttaaaccctgacttctaagccagtcaatattcagtgtgtatttattacttgctcctatgtggggtggggagggaacctctcgggtctgcacatctggcccttccgctaacaggttcctgttgcgttgactgtgaagagaattgagccacgtgggggactcctccacgtccccctaacccagactttggagcgggtgggagttgtaagacaaatcaaaatacggatgacaaagaggatatagccgtgtataccccagggagaggaggcgcagagttctgatgggagaggtacaggttgggttctctgcctaccatgctgtttaac

SEQ ID NO: 636585 - DNA, 188 bp, Homo sapiens
aggaacggctaccttgtgcaggctgatgggcaccgtgtccagtccccagatggcacgctgctcatttacacttgcgggccagggatgagggctcctacacgtgcagtgcctaccaggggagccaggcagtcagccgcagcacccgaggtgaagggtggtctcaccagctaccccaccgccccagccca

SEQ ID NO: 636586 - DNA, 769 bp, Homo sapiens
cccaccggagaaactctgaggaacatgaatagtcgccaggtcttggcggctctttctctcccaaggcgagaggagatcgttgggtttcaagggcccctgggggctattttctcggccggcccttgcggagagagttcttgcacttaccaacaaccaaggcagggatatgataggcggtcgagtggcatataactccttgagaacaaaggaaattatcttttgatacccatgcatgggttcagtgagttgcgaaacctcatgggatttgacaaaagcgacaagcagaaacaactggtatcagcgtgaaatgctttatcaaattgtcagctcgggatagtatctataaagagatggtcgggtcaatgctcaacatggaagataacagtgacaaacaaggtaatggctcatgtggatgctatcggggaaagaccatgggtgcatcctagagaaaaagtgaatttgcaaatctgagagcagagaagtgagaagatgaaaattgaattagaccaagctggagcaagcaactaatgggatgaatatgcagtcgagatcagagcagataataaactggatatcaacgttagagaagggagggagagtaacagatatgtgttacagatcaggaaacagcaatttatggaaacaactacagaagtttaccaaaaaaaggattctcaacacaaaaagtattatttcagagacccagtataaaattgagctgaaattggttccttaaaacatgtgggatttaaaaatgagacaatcgtac

SEQ ID NO: 636587 - DNA, 468 bp, Homo sapiens
atcgcttgggtgcatgcatgtgtgcaatcgctaccctaccctaccagccacgtgctttggtaaccatgtgacactgggcaagtcatggagccctgtgtgggcctctggaacgaagcagggtgagaaactccggtgcatagagttgttgtaagactgaggtgaggttctgtgtacccagcgcccaccagagcctgtcacagtgggagctgagtcacaagggactctgcttgctggtggtgtggttagtgccacctgctaggcttggccaggcaagaacgtcagtcaaggttaggtattcttgcatgatggtgcctacaccagctggcagcagaaacctgacgcaactccatagctgcaaatggagatccagggaaggctccacggaccatagagggctgtgtcgggagcagtgagtctgacattcctaatgacctaggacaatgacgtgtgtgttcaccacatgcatgc

SEQ ID NO: 636588 - DNA, 152 bp, Homo sapiens
aggaattggcggccgctttttttttaaaagtgccaagctttatttaggctgtaatggttacagatacacacactaccctatatcgtgcttccatgcagtccctagcgcatagtacttcagcgatattgtctctctgcattgactggctgcag

SEQ ID NO: 636589 - DNA, 328 bp, Homo sapiens
tactgaccacccctacatgccccagttacccaccccacgtgcccctggacatgaagtggtcacgtttcatccacggctctttcccacccttcgacagtggctgtgcaatgttttaagttcacaagttcatgctcctccccacactgagttcggatgttcctcccccaccaacctatgcctgggaactggtccgtgtgtaccgggcttctcggaggattcactgtacattcgttttcaggtggtcttgtggttgtcgctcggaaaatggttattttatatgatttgtcatggaatttgttataataaatcattcttctatcccttggca

SEQ ID NO: 636590 - DNA, 376 bp, Homo sapiens
catgataccagaacatagatggaaaaaattgtggttccagacttatatttgtagtagactacagtaccctgaggactctgataataccacttcctaccttatatttatttactagtctagggataatcgtgactgctgctgtctctaatttctatgtaacattacctttatagctcctctatcacttatataaccagtttcttgctaaaatttccttatgatatgaatacctgaaatcatttctattttcctggagggacgttgagtcatacaggtacaatgatcactgaattatattcagtatacttgtatatatagtacatattttacgttacatacaaaaaagttagaattataacttttatatcagctatta

SEQ ID NO: 636591 - DNA, 87 bp, Homo sapiens
  misc_feature (52)..(52): n is a, c, g, or t
ggggtgcaggacagatttgagaagaaggcaaaatgatgctggggagcagagntgtaatgctgctgttgctgctgccctggacagctc

SEQ ID NO: 636592 - DNA, 167 bp, Homo sapiens
ggtcagagtgtgggatacgagtagtgatcaacccggttttcggccggagggacccaagcttgacccgtcctagggtcaagccacaggcttgccccttcggtcaatttggttctccggccttccctctgatggaagtttaaagcaaccaagggcacacatgtgtgtgt

SEQ ID NO: 636593 - DNA, 110 bp, Homo sapiens
gtcttgtcgtcttaataataccaatcgtgcttgaagtaatcaggcacagactcaattgtaacattctcacccaggccttgccaaacgatggtgttgttgtctgacttatc

SEQ ID NO: 636594 - DNA, 158 bp, Homo sapiens
tacacagataaatatactagtccccacgaccaacctcagtacggatacgaactagatcctgtaacagacaagaatctaacaaaagaaggacagagatgaacgataaacggcaccgagacaaaggccaaacatacgtctatggaatttaggatacctct

SEQ ID NO: 636595 - DNA, 129 bp, Homo sapiens
agagaactctatactattgtattacacgacacggctactgctgacaaaacctgattgcaaatggaaacagctatgatcttagcacttgtgctgcctgcaggcgcgcttcagtaccggcgcccaagggta

SEQ ID NO: 636596 - DNA, 476 bp, Homo sapiens
ttcaacaacccttcatgctaaaaactctcaataaattaggtattgatgggacgtatttcaaaataataagagctatctatgagaaacccacagccaatatcatactgaatgggcaaaaactggaagcattccctttgaaaactggcaagaagggcgtgcttggcttgaggaaggatcacgaaagcagaaaggattccgtgagagggaagacacacaaaagctgtgcagaagacagtggtgatggctgcacagcaatggaaacgcacatcacgacatggaattggacgcttagagatggttaaaatggtaaattttacattatgtatatttcacgacaatgaaacaaaaaggctatactgggtcgtattggaatctaaggcaaaaggaaaaactagtaataccaatcctgtctgtagttaaagtcttgatattttattcaaggattttttgcataaatttagatttttaaaacaaaa

SEQ ID NO: 636597 - DNA, 422 bp, Homo sapiens
  misc_feature (22)..(22): n is a, c, g, or t
  misc_feature (65)..(65): n is a, c, g, or t
  misc_feature (83)..(83): n is a, c, g, or t
  misc_feature (100)..(100): n is a, c, g, or t
  misc_feature (125)..(126): n is a, c, g, or t
  misc_feature (129)..(129): n is a, c, g, or t
  misc_feature (133)..(133): n is a, c, g, or t
  misc_feature (150)..(150): n is a, c, g, or t
  misc_feature (153)..(153): n is a, c, g, or t
  misc_feature (181)..(181): n is a, c, g, or t
  misc_feature (189)..(189): n is a, c, g, or t
  misc_feature (197)..(197): n is a, c, g, or t
  misc_feature (208)..(208): n is a, c, g, or t
  misc_feature (224)..(224): n is a, c, g, or t
  misc_feature (238)..(238): n is a, c, g, or t
  misc_feature (254)..(254): n is a, c, g, or t
  misc_feature (267)..(267): n is a, c, g, or t
  misc_feature (271)..(271): n is a, c, g, or t
  misc_feature (278)..(278): n is a, c, g, or t
  misc_feature (297)..(297): n is a, c, g, or t
  misc_feature (299)..(300): n is a, c, g, or t
  misc_feature (306)..(306): n is a, c, g, or t
  misc_feature (310)..(310): n is a, c, g, or t
  misc_feature (314)..(314): n is a, c, g, or t
  misc_feature (327)..(327): n is a, c, g, or t
  misc_feature (340)..(340): n is a, c, g, or t
  misc_feature (378)..(378): n is a, c, g, or t
  misc_feature (395)..(395): n is a, c, g, or t
  misc_feature (399)..(399): n is a, c, g, or t
  misc_feature (407)..(407): n is a, c, g, or t
  misc_feature (409)..(409): n is a, c, g, or t
  misc_feature (412)..(412): n is a, c, g, or t
gggacgggccacgtcccctggncctctcctctattcgcctgtgaactccatccacacgtaaaggncctctgggtctgactgtnccctccacaggcatggngctgggaaaaggaaacaggcatatnnggntttncagattttaaaccgganacnctcacagtcacaaatccaccatgagacncgggagantggctganctgtctcccanaccctaacaccttccnccttctcaaaatgnaggctgccctttcacngggaggctctgantgcnggatggngctgactcaggctgggganannggcganaggngganatggaaaatccgncaattcaaagtanaaatatttcaaacacatgtgaaaaccatttggcaagangaaaagaggtatctggnatgntttcatgncnganatgaaaaaga

SEQ ID NO: 636598 - DNA, 328 bp, Homo sapiens
  misc_feature (328)..(328): n is a, c, g, or t
tagctcattcctgagtatccccgaatattggtgagcctactgaaagcactgctaaggctgcaaccaaagaacgtactggcgttaaatctggtatggaagctttagatccaaacaaagaagttgatggtgtaaccgaagagaccaagtaatgtctaatgttttcgtctttgatcctgctgctttcaaggctgcatttccgcagttttcaaagttcacggatgaacagctaacacagttttttgaagaagttgaaaatactgttttagataatactgaaagctcttgcatcggtttaaaagatcgaaagaaattcttttatcttttggtn

SEQ ID NO: 636599 - DNA, 114 bp, Homo sapiens
agggttttgcccccccccccttttttttttgggtttattttgattgatttttttttttggttttgggaaaaccccccctttgggggggggaaaaaaaaacaggtaattttttta

SEQ ID NO: 636600 - DNA, 902 bp, Homo sapiens
  misc_feature (678)..(678): n is a, c, g, or t
  misc_feature (682)..(682): n is a, c, g, or t
  misc_feature (689)..(689): n is a, c, g, or t
  misc_feature (705)..(705): n is a, c, g, or t
cgctgaatttacggtcagcatcctgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccaggttgcagagtatgagtgaccngacnggctatncaatagcctgtggtcnggcacggtaggccgccgcaagggggacaggccagctggcgagaaaaccgcgtcgggaacaaaggccggaggcataacccacggaagggcgccgggggctgcgcgcaaccacacttctgggcccctcagagcggaacccgcggcgctcccaacacgcggcgcccggcggccgtcaacacgggcggcgaccacagcgga

SEQ ID NO: 636601 - DNA, 547 bp, Homo sapiens
  misc_feature (497)..(497): n is a, c, g, or t
  misc_feature (502)..(502): n is a, c, g, or t
ggctccatgcagtgacactgatgacaattcagacgcaggctcaggggtgccgaggtaggaatggctgggaacaaaggacatttctcaaagttcccctgaagacatgccatctctaaaaaccttttttctccccgactctacccccacctctgttcctagagccctcggcgggcgagtccagaaacattatggcccagacggatgatgtgtctatggattatttggccccgcctcaggagcgcaggaagtcactaccatttatattctaaaacagacctatctatgtccataggacttctgatgtgtccagataggaatcctcatgagagatcatcatgcttggtgccctgaaccagtgtggctcggggttctcaggaggaacaggcaagagcagcttcattctaagcctttccagtgacctcagccttgcttctcttctacaacagtaaggctcctctgtcagaggaggtcgtcttgtgtgggcttcatggcatganataanccttcccctcagggtgttcctatatataggtgggcacacaaaata

SEQ ID NO: 636602 - DNA, 131 bp, Homo sapiens
cacaatcctaggcctacccgccgcagtactgatcattctatttccccctcttattgatcccaaccatcccaactattctataaacctagccatgggccatgccccttatggagcggtgtcgaagtgatgta

SEQ ID NO: 636603 - DNA, 1009 bp, Homo sapiens
  misc_feature (785)..(785): n is a, c, g, or t
  misc_feature (789)..(789): n is a, c, g, or t
  misc_feature (796)..(796): n is a, c, g, or t
  misc_feature (812)..(812): n is a, c, g, or t
cgctgaatttacggtcagcatcctgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccaggttgcagagtatgagtgaccngacnggctatncaatagcctgtggtcnggcacggtaggccgccgcaagggggacaggccagctggcgagaaaaccgcgtcgggaacaaaggccggaggcataacccacggaagggcgccgggggctgcgcgcaaccacacttctgggcccctcagagcggaacccgcggcgctcccaacacgcggcgcccggcggccgtcaacacgggcggcgaccacagcgga

SEQ ID NO: 636604 - DNA, 550 bp, Homo sapiens
ctagaggatcccgtctgagcaagcgtggaaagtacacgagggttggcaggaggcaatgtgtcaactgcaaaattcttagtagaaggcagagatgttcgcatcctgaagtataaaaaaggaggttcaggtcatagaaaaacagcgtgctgttgttgaatttgaggtcaatgaagacgatgtcgatgcccattgatatagagatggcattgaaatcaatttccaagttcaagaacgacacaattatgtagtggaaagaagaatccaccgaagtgtttatctctgagaccagacagagcgaggcaggagaataccccttgggggcaggaaggaacaggagtcctgtcactctctatgtcaatgctcctgacccgccccaagttctgcaggagctccagccgtgtcactgtgcagtctggcaagcctgcccgtttctgtgccatgatatcggaaaaaccacagcccaaattttcctgggtacaaggaagagcagttgctttccactgggcctcaagtgcaaatttctgcgtgaggggcaagagtccgcgctttt

SEQ ID NO: 636605 - DNA, 508 bp, Homo sapiens
  misc_feature (508)..(508): n is a, c, g, or t
taaagttcaaatatgattcataaaaaatcgagcgtataactttctctgaaaaaatatgttgactctgtataaaccacagttattgggggagaaaggcttgtatgttaaatcaccctatttttgattctgaaaatgatcttaatagaatgtcccggccacagtctgattataaagatacatctgcccaaaatggctgagaatacaatacaacatgaaatgcaaaacctgtacagttgagggcatgcacaagaaaatctccaaatacccaaagcgggaacaaggaacgtttggctggaattcgaagttatttaagcgtctttgtctctgcctacatgtggcaagatgcgtgtgaactcaatgtaattgaaattcccctttttatcaatatgtgcttgtctgtacagctcatgcactttctcatctgtaaacccgagccccatggttgttagtagttatctcaagccaacttgctgtatggtgccagttgcttcttcatgaaagcaagaan

SEQ ID NO: 636606 - DNA, 124 bp, Homo sapiens
  misc_feature (14)..(14): n is a, c, g, or t
aatcgggctcggtncaatcttagctattaaatacgttaaaaacttaacgctagcatatcttagtaacctatagactatattttttaagtagttgtattaatctctatcttagcggtgagggcgt

SEQ ID NO: 636607 - DNA, 2464 bp, Homo sapiens
  misc_feature (1372)..(1372): n is a, c, g, or t
aattagtacaatgttatgttttttagagaacactactaaatgctaaataagcctattttttacactacactatcaaaataatttttgccttcgaatttttttaagtcaagttgaggttatttttgtaagaaacccaacctattttttttgcagcctaaaatcccatttaaggttaggggttggtccttatgccagcaagatttaaccaactgtaaagatagtagtctttgcatacatttaagtaattaaggcatttattgctgggagaataggagtagcaaaaatatggttttaaattggtgctttattaggtgacttccttttaggcgatggcaggtcatgaaataggtacactaataattttctatcaaccttaaaaagtgtcaaagcatctttgtagggtgactctaaactgctaattaagggttaataagtaattatcattggttgcttttcaatataattgcaaacaaattaaaaacacagttaaactaatatgtttataagcttgagttttcttcctaccatatcactctcatatatcagtgatgaaatgtcagattttgagcagtagctctttgacagtgtccttttatacccagtcttttctgcattgaatgctttgtgccttttcgatgtgttgtagttgcttagagttgattctgctggctagattgtactgattaatagatttttatttttatttttttttggttatgggtgttatgattgtgttgcctgctggttgggcaactttttttttttaggttgctttatgtttatataggcaaattggcactaagtgttagtgtgaatatttgtttttatgatttatatatcattttaaaaatctctgttgtggcctttatagttactgtgaagccactcttgggcctgtctctatatgcttattagaggaatctgacaagtaaaataaaatgagtagtgtgtctgcatctgtgtctctgtttctctgtcttttaaataaccagtaaccataactacacagccctgcactgaatgaccttatttcagtttgcctaaaactgaacaagaggtgatggtttgagatgagtttctcattaggagcagcaacatcccaaccaatatataatgagttgatcaactcaggaaaaattaggactttaaagaaggttgtatttggatattctaagattcagtgccaaatttaaaatgcctagaaatgtattctacaagtagcatttctaaaactttaagtagtgttatagtaaatgctacttgctgttagagtgaataatggataatgtgagaataattttctaaacgacttctagaaactagacagttcttccttatatcctacccttttccacatttctctaatgtgggnttttttgtttgtttgtttgttttgagggtagagggaatcccctccttatttcctctaaaattgtttttacttaagataccttttccctataatcttagcatgctttctgctctttctctttggaagtagcattaataagatagatgtaataggattaagatgtgtggaagatgagaaaaagaaggtttttgtagagagagtgcttatgttttgtttactcatgtttcaacttgctgtgtatgatcataaatctatgatcttgagaaaaatcctaaaacaatttaaatttagcctatgcagccaattacataaagagaaattaaggattatattcagaggagaaattaaggattatatttagagcacagaggttatacaaagaatataaccttgtttggtcaaattcttaggtaaagaaaagtaatcaatgcttgcattgctgttggagattctaaaagatgtattgaatgaagaggatgtacacatctcattgttactgcgtatttttttgcttggtattcctgcttgcattaaagctggacaatgtactgtgatgtaattacaaaatttttattccttctaacgattgaactcttcttatccctattgataaaactgtattacaattgatgagtgtggctgccagaaaataatacaaaactgggcatttagctgttccacattgtgtagtaaatgttttgattatggggatttacagtgtatattaaagtagaaatgcttttgcacttgttttcagtctcaaataataatttttgtttttaattaaggatactttaaaagcaatgacagaaaaatctaaaatatcagaattaattattgtgaactgtgtgtaaaatatcttgtgagttttatacatactttggttgtctgatgtttcctaagtataaatgtctttatagaaaatttcagttctctgtgaagagtaggaagtgtactgtatattgaactagttctttgtgttactttgatatttaaaataaatataaagttctttggtcctaatacagcatatctaggttttattgaaccacattttcacaggatgggaatgcagtactctgaaaccaagta

SEQ ID NO: 636608 - DNA, 1663 bp, Homo sapiens
  misc_feature (1)..(1): n is a, c, g, or t
  misc_feature (3)..(3): n is a, c, g, or t
ntnggatgtcataagtgcttcgctgaagggggtgggtcgtgtctgtattgtgtcatgtctgtgtgcgctattatttattgctcggtcgttttgctcgtagccagctttagtgaagtgcccccttcggtgttttacagattttagaggggcaccctcctttgccggtttttctggtgtgcccccctcctttacggccatgtttcgtggtgtagcccaatgttgtctcctttcaccctgaacttgtttctcccgtgggaggccgtgttccccatcctgagtgggtggccccccaaatataacaccaaacctggccatatcgtgttccccacctctgtagaaaaacttttttactaattgggtagtctcccccttctatatttttaactgtaaatagcccttcttgcaccatgggtctccacgtcctcccacaaaaaaattttcgtcttttctaattacaaggacagcctttttaaccccttcctccgcgaacaatttctttaacatactcccatattcaattacttgttgcacccttgtctaacaaatcttctgtggacgtttacacacacccttgggtgtctgcaagtgttctcccaaggattaaaaattggctttttactaaagaacttctcccctttttccccttaacagggtcataggaaaggttccctcgtacaatctggaccataatatctctcttgtgttacctcgttgaatatatttaaaatcaaatattataaattcctctttgctcccctacaacgaaaaataaaaaaaaaaaaaaaaaaaaaaggcggccgctcgcgatctagaacggattatattcagaggagaaattaaggattatatttagagcacagaggttatgcagccaattacataaagagaaattaaggattatattcagaggagaaattaaggattatatttagagcacagaggttatacaaagaatataaccttgtttggtcaaattcttaggtaaagaaaagtaatcaatgcttgcattgctgttggagattctaaaagatgtattgaatgaagaggatgtacacatctcattgttactgcgtatttttttgcttggtattcctgcttgcattaaagctggacaatgtactgtgatgtaattacaaaatttttattccttctaacgattgaactcttcttatccctattgataaaactgtattacaattgatgagtgtggctgccagaaaataatacaaaactgggcatttagctgttccacattgtgtagtaaatgttttgattatggggatttacagtgtatattaaagtagaaatgcttttgcacttgttttcagtctcaaataataatttttgtttttaattaaggatactttaaaagcaatgacagaaaaatctaaaatatcagaattaattattgtgaactgtgtgtaaaatatcttgtgagttttatacatactttggttgtctgatgtttcctaagtataaatgtctttatagaaaatttcagttctctgtgaagagtaggaagtgtactgtatattgaactagttctttgtgttactttgatatttaaaataaatataaagttctttggtcctaatacagcatatctaggttttattgaaccacattttcacaggatgggaatgcagtactctgaaaccaagta

SEQ ID NO: 636609 - DNA, 379 bp, Homo sapiens
agcccagcaggctggtccatactggcttgggctggacagagctgaagcccacgtggtgcctggccttgcttaaccgagagaacaaagtggaagagacgctgtggtagtcagtttctaggcatggatcttaagaaactgacaacttctatgtcctatctcttgggctgctcatgctcccagccactctgctgtgaggaagaccacgtggtcacacatagaggccgtatgccagggtcctgctcacagcccagccttgcacatgagtgggccgtcttgggctggcccaacagccaccacgcacgcagagcaggcggttcttctcaccgggccctgcccaacctgtagattccgcatcaaacaataattggctttaaacaaa

SEQ ID NO: 636610 - DNA, 266 bp, Homo sapiens
gccccaattgtctgtatcgcgtatatgcaaccgactaaccaaaacacaccaacgaccctgcgttgtaggccattgcaccactttctttatctggcaaagagaacgttctgttctcacagtggagctgtcagaaactacaacagtagatgtaagttcacgctgccccggtggacctagctgccacaccagtcagattgttcacttctgtggtaaaaaaagatgatatgttagactgggattgacttcatcatcatctttatccagtc

SEQ ID NO: 636611 - DNA, 253 bp, Homo sapiens
gcaggtgctatatgctgggggtgggagaactggaaaatattgggggcagagtcccaggtgggacaggaaagtttgaagctggcactactggcaggaagacagagttgcactgtatgcacagtggatgagcagctgccggtactccaggtgcaggtgccgctccactagcacgtgcagtgagacttggtcagtgaccaggccctgcctgcgcatcagcagctccaggtcctctggcttcacagtcttgcggcca

SEQ ID NO: 636612 - DNA, 905 bp, Homo sapiens
  misc_feature (472)..(472): n is a, c, g, or t
gtgtgaacgggctgtctccgtcctcctccccagccatggggttcacgtccgcggcttttgctacatgctgtggctgctgatcagtgcgagtcatcattcttcgccatttgctgcacttataggcactctgaatgagctgaaggactgcttacaaggaactcctatagaccaggtgtaataccctgaattcccttgtaactacccatgagtacctcatccacgccttgtctctctggtgtcattgtagcttctgtggcatgcagagtggcttacagcttgggtctcaattattgcccctcttggcgtaatcaataattttgggcaggttattatgagtagcaccccagtgatggagctgggcctcatagacttcgtaattaacccctgtaataagccagttcgatgaagttgcaggactagtttcgtaggcagtaataggtccaggcacagggacagcgcactgcggtggcanataatttacgctatataaatcctttcgtagcattttgtatattaaattaccgaaaatatattgggcaatgaactcttattgttaagggttggacgctcctctaggagagcacatcgactatcaggaacgaaaatttgggtccccatgtgcaaaggttgcattgtcccagaaaagctcaaccaaaattgcaagcgggatctctaattccagacgaagaatcgctggtcacaaggaagtatgcccttgtgggcaaattcttgattcaacattgcttttagaaagactgaactcctttaatttcttcacatcttgtttccaccatttttgcgctctggcgggacaggacctgtttgcctatttgtatactccccataccggcattcacaatcggaatacggatttcccttatctttacaaatggttcgcccgcgaa

SEQ ID NO: 636613 - DNA, 246 bp, Homo sapiens
  misc_feature (55)..(55): n is a, c, g, or t
  misc_feature (104)..(104): n is a, c, g, or t
  misc_feature (146)..(146): n is a, c, g, or t
  misc_feature (149)..(149): n is a, c, g, or t
  misc_feature (172)..(172): n is a, c, g, or t
  misc_feature (230)..(230): n is a, c, g, or t
agactattcagggcctgggtgctgcctcagcccagtttgtgtctcggctgctccntgtgctgttgagcaccgcccaagaggcagaccccgaggtgcgaaaatgncatcttcgggatgggcgtgttggcagagcatgggggccactnttnccaggaacacttccccaagctgntggggctcctttttcccctttatagcgcgggagcacaatgatcgtgtccgtgacaaanatcttttggggcaatt

SEQ ID NO: 636614 - DNA, 910 bp, Homo sapiens
gggctccgctcctcccgcctgggcgcccgaccgagtgacagccagccggcccggtggcggagaggaagtgcggtccggccaagcccgtccccgccgacgcggtccccgggtcgggtgacagcgtgcggcccgcgaacgcagcggcgggggacaggcggccgggcagagccgaggcgacagggaaggccccgaggaaggccgcgggggaaaaaattgctggatgaccttggggtaactactgcgtcgtcggaaacggcggcgcccgagagccgggcggaagggaggcacccggggggccggcctttccggggcccacagagggaaagcggacaatgggcaggccatagaaagaaccagcaccgagggtcttccgggaggccaaccttggggcgggggaaagcatatttggtgggccccacggggataagcgggtgggccccaaatagtgtggggcgcttggactcttagagggacccttgggggacccacagtgcacacatgcagcacgattggcgtgtcaaggcgagcggcaccagcggcgacatgggatggagtgaggataacggagccagccattgtgcgccatctgggtatgaacagtgggttgcccccaggggagccctgtgaaggagccaatccgcgaaaatgtgcggcgacacgagagcacgcagaaggaacacgggctgtggacagaaagctgggaatgctggacacacacaaggtgcacggacaccgggtaaagggcgcgcaaaaagggccaaggacaggaactcgggaggaagttgcaaccagggccggaggtgcacaagttgagcaccaccgagtacaacccgcggggaatcgggaggggctgcgggaaggcaccaggggagggcccaggacgagggggaaaaggtggccccatggttac

SEQ ID NO: 636615 - DNA, 252 bp, Homo sapiens
tgcctcctctcctgaaaagctctcataattggcctactcatcccgcccactcttggtcactctcacttggtctttccttccaagtcatcaagtgatttccagagccactgcatggaccttcctgagatggtggcaagctgcgtcagtacacacattaagccagcatttaaaaaggcactgccagccgagcgtggtacctcatacctgtaatcccagcactttgggaggccaaggcgggcggatcactcgagg

SEQ ID NO: 636616 - DNA, 497 bp, Homo sapiens
aaagagctacaacacttccctccggaacgactctcaagccaagatgagagtaaaatttgatacattactcgtatcggcattgatcatagcataatgacagtgcaagcgatacaagggcgataagtacaatgttatgacttcgctccggtcgtgacacatgtaacacttactctgttacctaggttgtatagtaagatcatagccagtctactgggggaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgatgatgggactaattgatatcgcaccagtttacaaagacagtcttatcatccgagaatacaccatctttttctctggataattatttcttacatcatgcttgattcctacattttgttgggtctcaacattggct

SEQ ID NO: 636617 - DNA, 1028 bp, Homo sapiens
  misc_feature (418)..(418): n is a, c, g, or t
tactttaaaagccaaattattttttaaaagatcatgcttataataggtaaattacacattaaggaaacatcaaaataaagttagatgaataaaaaggcacacctcgaaaaattgtgagcgcagaaaggacagtctcttttgggtttgtgttcctaagtggtcggaagaaaaaagaagagagatatattaaaactcatgtgtttctcaagtgtgaaaggttctcgtggtcagtgtgaagttagttagccaagtgggcttcttttctccgcggtgttccaagagccagggctcttccgtggcggcgtgacttcgtgaaggagggtgttcagactcctcttgccagtgtttatagggcgaatacattcagaggcgcgaagcgtgccacgtggcgagagagaattggccagaggaactcacnccagtgtgtggtctccacccaaatgtggagaacctagagaactcacaatagataggtgcataagaagtttctcccgagaagcgctctgtgtgttataactcttgtgcggctctgtgagtcatctctgtgggatgtggaaagctcttctcacacagagtgtatgtgaatgtgttcttgtgggacacatctctctcccctgtgtggcattctgtggtaacagtgtgtcgcctgagacaatattctctctcatagaagagtgtctccctgcagagattaaaggagtgtggttctaacactcatccccgaggagcctgtgtgatgtgtcccacccgtctgttaaagcagcactttgttattatgtcccccccaccaaccccagaggggaaatattgtccactctaattatcccccacaggagaacaactgttgttgtgggggctacaaaaaaaaatcgtgcgggattaacacacccccttttagtgttgtggagtgtttgccaaacgggaggatcttctacacgggccccccagcaggggtggtcggccactcctttgatggaacagtagaggtaggagaattatagagtaggccgatttctggttggaagaag

SEQ ID NO: 636618 - DNA, 203 bp, Homo sapiens
actagcgatcgttattgaccaggctgagatggaccaggctgtatgggcacggtggagacataaagtggcatggcctgcgccatatttcttgtaggatgctagtggctgtgccgtgttgcgcggctgggtgttgtctagagggcacagcgtcaaggcagggcagtcccctgtggaatcatggagtggcccagtgtcaggtggga

SEQ ID NO: 636619 - DNA, 123 bp, Homo sapiens
ggactatcactggactcctgcgtgtgaaaaacacactacagcataccgaccatgatatccaccgttgatttgaggccataacgacgcagccaatattgccgacgaatgacggggccgagttcg

SEQ ID NO: 636620 - DNA, 281 bp, Homo sapiens
tccttgaggatacccgtctggatgcaagtgtcagaaactaaggaatgttccaccaaaaatgaataacgaggtcaggcgtgtagctcatgcatgtaatcccatgcactttgggaggccaaggagggcggatcacctgaggtcgggggttaaagaccaggctgccaacgtgatgaaaccccgtctctactgaaaatacaaaaattagccgggtgtggtggcgtgtgcctatagtcccagctactcgggaggctgaggcaggagaatggcgtgaacctgggagt

SEQ ID NO: 636621 - DNA, 892 bp, Homo sapiens
  misc_feature (9)..(9): n is a, c, g, or t
  misc_feature (11)..(12): n is a, c, g, or t
  misc_feature (53)..(53): n is a, c, g, or t
  misc_feature (178)..(178): n is a, c, g, or t
ttttttttntnnaatttatcatcacacccccaccccccctctttatgaaaatngctatcacacgcgggacgggctacgcgttgggaggccggcgcgctcgcggcggtgtattctgtttaaatacactgtactatttacatacaggctgcggtggtgacagaacctagaccccccgcgngggagagagagaggaggcgccgacaaaaggaggtccgagaggaaataaacaccacaacacacaaacgaaggcagaaacaagacaccaagaacagacgcaagaaggggagaggagaaagagaagaagaatgaggagagagactaacaatcaccttcctgacagggggaagagggggatgtaggacggtggacgtcgcgctatttgatacaagagtaagtgaaagcgaaaagcaaaaagaagtaaaacgaagtccaccccgcaccacgtgacaaaaagagcaatatacataagaccacaccaacgtgtcgtgctaccgggcgtaaagaaacagacagagtagtgtattaaccgcgacagatcaggcgaatagacagaggagtagcaaagcaccatatagagtaatggcagcgacggtcgggctgcagcggaggagcgggaccgggtggcgcacgaggacgacggtgagaggacgcggggggtaggagaggttgtgtgtggtagtacggcggggctgtaaacgcaggaagggaagtagagggcagaagagctaaggactaacaatcctcggacgctgaagactcgtcagcggagccgcaagacgacgacgcggcagaggcactaagacaccactggacactatgcacaaatacaaccgccggtgccaggcgctccgagtcgtccgtagatctacggcgtttctaggtagggttcaat

SEQ ID NO: 636622 - DNA, 106 bp, Homo sapiens
tgagtgaaaacaaacgacagagacagcagctccaagccctcagtgagcctcagcccaggctgcaggcagcaggcctgccacacacagaggtgccgatgaatagcga

SEQ ID NO: 636623 - DNA, 271 bp, Homo sapiens
aatggaacgaacaaacaagcagaaatggaacgaacatggcatccaagtaatccatgacctatttgtatacggtcgatctggagataaaaccattcgcatctgggatgtgagagactacaacatgcattgccactagtgaacactaaagggagagaacatataataatcagctgcgagtcctgactgggcagaccatctgctgtaagcaacaaggaatgatgtggctgaccctttatctgactgccaacgacacaccgcttccatattcgga

SEQ ID NO: 636624 - DNA, 109 bp, Homo sapiens
ttaggactccccttctttaatgcatcgacattacagtataagtgacctggttatgacatcattcctttaaagtgaaaagattgccgggaaatgtgttcgggataccgag

SEQ ID NO: 636625 - DNA, 524 bp, Homo sapiens
  misc_feature (421)..(421): n is a, c, g, or t
ctcccccccgagggttaataaaaattcccttccccaaagccatcaaaaatgggccaaagggccttttcctttcccctgggaccaaaatttaggggcctcagtccctccccgccaagcccgggccaattttgtttttcctttttcccccgggcctgttttgtttttgaggtttgggtcccccgttcattccaagggtgggggtcactaaagctgcctttcccttttaaaggtgggcgggccctggttttacaaggaagcttttcccccagctgggggggcaggaacttaatttaaaggggggggcctggggcaggtgttgccccacccccaaatgccctgattggggtccccccacatttgggggagccttccctggcaggggcccttgggggttttcattttccattcccctccctggggntaaagggtggggttaggggatgaaaagggagggctgccccccctggtttgggggttgaggaaaaagagtttgttgatttaaaaaaaaaatttgtcctttttta

SEQ ID NO: 636626 - DNA, 310 bp, Homo sapiens
  misc_feature (286)..(286): n is a, c, g, or t
ctgggatgcgcttgggctccctgagtctcgccctgtcgcccaggctagagtgcagtgacgcgatcttggctcactgcaacctccacctcctgggttcaagcgattctcctgccttagccttctgagtagctgggattacaggcgtgcaccaccacgcctggctgatttttgtataaaataaaattatttaagtaggtaatacatgtctatgctaatcccaccattctccctacagtctattctcatagagacaagggacataatatgcataaacaagcttatggtntgtctttcttccactcctactttt

SEQ ID NO: 636627 - DNA, 269 bp, Homo sapiens
gtactgttagaccagctaaatccctaacttggatctgaagtgcattagtcatgaccttgtacccattcccggaatttcagccgcacgtgggtttggtctagtgagtgaaaacacaagaacagagagatccagctgaaaaagagtgatcctcaatatcctaactaactggtcctcaactcaagcagagtttcttcactctggcactgtgatcatgaaacttagtagaggggattgtgtgtattgtatacaaatttaatacaaagtcttac

SEQ ID NO: 636628 - DNA, 143 bp, Homo sapiens
cgagatctccgtgtctctgcgctcagaatgttgatgactatatgaattgtggctttgtcgcacagagatgccggactactctggcgttaaaccacacggttctcattactgtatttattagctgtgcattctctgtctcctct

SEQ ID NO: 636629 - DNA, 489 bp, Homo sapiens
  misc_feature (489)..(489): n is a, c, g, or t
taaggtttgagggggaatgctggaaatggtaatgggtatggaaacttttcatataagtaatgctagggtgagtggtaggaagtttttccataggaggtgtttgattgggccgtaccggaatcgggggtatgctgtcaaattcataaaaacgggaggttaaaattgggtctgtgcgtgaacaaaatatgtggtgtaagagtccagggcgaggagttgcgctcattatgttgtccctaggaagattgtatgtgggtacgaaggggttgttgatcataataacggtttggggtatatcgcggcttctagaaaaaatcgggcgaagcgggccttgacggcgtcatcacgatagttcgacacgcctggcaaaactacgtttcgataattccccttccggcaagagccccaacggggtgtacggggagggtctccgctagtatgtggagacaacctacccatcttcggcccaggtcattaagccacgagtactcn

SEQ ID NO: 636630 - DNA, 301 bp, Homo sapiens
ggtgaacctagaggttccaggagatatcgtggatcgacgtcttcacaagtactcctgatacaggggaatttccatgccgtctacagggatgcactgaagaaattgctagagaccgcagtgtactcagtatatcaggaaaaagggtgcagacgtctggttcacagagttggatatcaacactgatggtgcagttaacttccaggagttcctcattctggtgataaagatgggcgtggcagcccacaaaaaaagccatgaagaaagccacaaagagtagctgagttactgggcccagatgatc

SEQ ID NO: 636631 - DNA, 1070 bp, Homo sapiens
  misc_feature (261)..(261): n is a, c, g, or t
  misc_feature (361)..(361): n is a, c, g, or t
  misc_feature (401)..(401): n is a, c, g, or t
  misc_feature (618)..(618): n is a, c, g, or t
  misc_feature (643)..(643): n is a, c, g, or t
  misc_feature (669)..(669): n is a, c, g, or t
  misc_feature (710)..(710): n is a, c, g, or t
tgagcggcgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaangggcgagactgtaaagcgaatccgggagcagagcagtgcccggatcaccatctccgagggctcctgccctgaacgcatcaccaccatcaccgggtctacnagcagctgtcttccatgcagtctccatgattgctttcaanctggatgaggacctttgtgctgctcctgcaaatggtggaaatgtctccaggcctccagtgaccctgcgccttgtcatccctgccagtcgagttgtggctcactgattgggaaggctggcaccaagatcaaggagatccgagagactacgggtgcccaggtacaggtggcaggggacctgctccccaactccacagagcgagctgttacggtatctgngggtgcctgatgccatcatcctgtntgtgcgccagatctgcgctgttatcntggagtcccacccaaaggagcactatcccctaccatcgagnctctcctaggtactgtccttctctctttcaaccaggactactctgtccaggtctcagtatagtggctgtgaccccaatagaggtcaccaagctccagcagctctcaatgccatgaggtcccctttgccacacccagcgtggtgcccaggactggatcccgtgacacagaccagctcacaggagttcttggttcccaacgatttgcttggctgtgtgatcgggcgccagaggacatccacagatacagcgagatccggcagatgtcaaggggcacatatcaagatcgggaaaccaagcagagggcgccggagagcggcctgtcaccatcactggctctccggtctccatcggcctgcccca

SEQ ID NO: 636632 - DNA, 362 bp, Homo sapiens
  misc_feature (362)..(362): n is a, c, g, or t
tgtcatcgcttgaagtctgaagaggcctgggttgcgggaggagtggtctgttgaggctgccgttgcgtgccggccctcctcagatccgccttttggagcacacctgctttgctttgttgcctgtgcaaatgttggacaagcagacacactcacactcgtccccgagcttagcacagagctggagcgcccatttcgggaattttccgttggggaatctccacttctggggttaacctgtacggcctccgtgtctatcagtgaggcatctctgacggtttcttctacggcttttcagttcccttccctgctgttctattccctttgagtgtaaagactcacaggtgacctgctatcgagatagn

SEQ ID NO: 636633 - DNA, 274 bp, Homo sapiens
aggcatatttgcctgcataagtgaggggatggctgaccctgctcctgcaacccagcctcagccacggaaacaatgaggagaccccagtcctggagtagcagctctgcttccctgcctgcctaacattttttccaagttcaccttggataccagtaaggggcgggggacactgcaggacagggtggctacaactgtgagtttgtaatatcttttcttttctttttttttttctaaaaaaaaatactatgaaaatgcaagagagactatggaaaca

SEQ ID NO: 636634 - DNA, 344 bp, Homo sapiens
  misc_feature (79)..(79): n is a, c, g, or t
  misc_feature (81)..(81): n is a, c, g, or t
  misc_feature (91)..(91): n is a, c, g, or t
  misc_feature (153)..(153): n is a, c, g, or t
  misc_feature (157)..(157): n is a, c, g, or t
  misc_feature (263)..(263): n is a, c, g, or t
tcacattaacacggaacaccttctcgccttcaaagtgctcaccaccatgatgagcactttgaagggagaaggtgttccntntaaaccgctncgaacgatcgaaaatcacattaacataatcccgccgagttggccagcacgacccagattganttcncccccgccagattctgtcacacaaatcaaacctcacagtacagttgacttccgtgttaaagcagaagatactgtcactgtggagaatgttctaaagcagaatgaantacaatacaaggtactgataagcaacctcgagaaatgtggtggagggtcagtttgataagccgggttcgtggaacaggaca

SEQ ID NO: 636635 - DNA, 1155 bp, Homo sapiens
  misc_feature (346)..(346): n is a, c, g, or t
  misc_feature (446)..(446): n is a, c, g, or t
  misc_feature (486)..(486): n is a, c, g, or t
  misc_feature (703)..(703): n is a, c, g, or t
  misc_feature (728)..(728): n is a, c, g, or t
  misc_feature (754)..(754): n is a, c, g, or t
  misc_feature (795)..(795): n is a, c, g, or t
tgagcggcgcctctcccggggacaatgtgggactgagcggcccagccgccgtgccgccgccgccgccgccgcaggacagccccagcgagcctctggagtccctgtggcagaactcaaatggaaggaggagcagctgcagcccaggggagcatgggtgtcacctccgttggatagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaangggcgagactgtaaagcgaatccgggagcagagcagtgcccggatcaccatctccgagggctcctgccctgaacgcatcaccaccatcaccgggtctacnagcagctgtcttccatgcagtctccatgattgctttcaanctggatgaggacctttgtgctgctcctgcaaatggtggaaatgtctccaggcctccagtgaccctgcgccttgtcatccctgccagtcgagttgtggctcactgattgggaaggctggcaccaagatcaaggagatccgagagactacgggtgcccaggtacaggtggcaggggacctgctccccaactccacagagcgagctgttacggtatctgngggtgcctgatgccatcatcctgtntgtgcgccagatctgcgctgttatcntggagtcccacccaaaggagcactatcccctaccatcgagnctctcctaggtactgtccttctctctttcaaccaggactactctgtccaggtctcagtatagtggctgtgaccccaatagaggtcaccaagctccagcagctctcaatgccatgaggtcccctttgccacacccagcgtggtgcccaggactggatcccgtgacacagaccagctcacaggagttcttggttcccaacgatttgcttggctgtgtgatcgggcgccagaggacatccacagatacagcgagatccggcagatgtcaaggggcacatatcaagatcgggaaaccaagcagagggcgccggagagcggcctgtcaccatcactggctctccggtctccatcggcctgcccca

SEQ ID NO: 636636 - DNA, 1189 bp, Homo sapiens
  misc_feature (261)..(261): n is a, c, g, or t
  misc_feature (361)..(361): n is a, c, g, or t
  misc_feature (737)..(737): n is a, c, g, or t
  misc_feature (762)..(762): n is a, c, g, or t
  misc_feature (788)..(788): n is a, c, g, or t
  misc_feature (829)..(829): n is a, c, g, or t
tgagcggcgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaangggcgagactgtaaagcgaatccgggagcagagcagtgcccggatcaccatctccgagggctcctgccctgaacgcatcaccaccatcaccgggtctacnagcagctgtcttccatgcagtctccaatgagtttgccgtttttccaaaaacctttgggaaattgaaggggaaccccctttttttgcttggcccgttgggccctttccccccttttggggtccctaaagcgaaaaaaagttttgtggggggggcattgtgggcgggggacaacacaaaaatacaaacttttgtggggttttctttcccaggcctccagtgaccctgcgccttgtcatccctgccagtcgagttgtggctcactgattgggaaggctggcaccaagatcaaggagatccgagagactacgggtgcccaggtacaggtggcaggggacctgctccccaactccacagagcgagctgttacggtatctgngggtgcctgatgccatcatcctgtntgtgcgccagatctgcgctgttatcntggagtcccacccaaaggagcactatcccctaccatcgagnctctcctaggtactgtccttctctctttcaaccaggactactctgtccaggtctcagtatagtggctgtgaccccaatagaggtcaccaagctccagcagctctcaatgccatgaggtcccctttgccacacccagcgtggtgcccaggactggatcccgtgacacagaccagctcacaggagttcttggttcccaacgatttgcttggctgtgtgatcgggcgccagaggacatccacagatacagcgagatccggcagatgtcaaggggcacatatcaagatcgggaaaccaagcagagggcgccggagagcggcctgtcaccatcactggctctccggtctccatcggcctgcccca

SEQ ID NO: 636637 - DNA, 360 bp, Homo sapiens
  misc_feature (360)..(360): n is a, c, g, or t
agctggccacggagcatgcctgtggcgcagtcaggtgacaggtcatcaccctgaacctccacgggctgtatttacagtcagacaggtattcagaaagtggtgtctcagaacatctggacttgggctaaaaatcatataaaaagacacaaggccccttccccaataacttctaattaggtagcacagaatccagtctacagcttacgtcaccaggtttagcacacatgcgtgtttttttccccccggtattttccacacccgttgagcaacttttctccaagggcacactgaggagcaactagaatgcacagaactggcagttctttatttcccacatggtcacgatgaaggaaacgatan

SEQ ID NO: 636638 - DNA, 121 bp, Homo sapiens
gagggtagtcagctgaggcccggtcatctgccgcgcggagttattgcgccagcgggcaagtgttcgtcggcgtaacgccgttatacagcgcagtacagaactctcgtgccgcaccatggtt

SEQ ID NO: 636639 - DNA, 598 bp, Homo sapiens
gtcagcctcagatcacctcctgcaagaatccctctggtggaagagatgaacctctaaaaggagtcagaaagaatggcctcatcttcaacaacctatcctttaacagttaatcagatttctccctctgcttacacataggtttaacatgaccactgagtacgaagtaatttgtagctctgctggttaccagaaaaacaagtcccagcaactttaatcagcaacacagtcttcagaagggataattgaaattctcgaaactaaaactcagtttatttcctagtgaaagaaaggatgagccaaaagatgagtcacagcttagaaaatattttaactccaggacaatggtttgaatctatctatgctttatgaaacacaagttgttaacacctggcagctaaggaagagctggagtccaaacagctctggtcttcctttgggataaggtctgaattgatatatggagaaactaacattaccacttacaaccctccttaaccagtttttcaggtaagggtaagatttgtatagtatttgcttttttgagacaggttgttgctttgtcaccgaggatggagtggagcaatcatggttcactgca

SEQ ID NO: 636640 - DNA, 159 bp, Homo sapiens
  misc_feature (51)..(51): n is a, c, g, or t
  misc_feature (122)..(122): n is a, c, g, or t
gtactcgccactttccatgtggcatctcttgtatgcaaactagattgtgcnctcctagagggcagagtccactctgatcacgttgtggtgtcttccttacccttctggcgccttaatacagnccttgcacacagacacaataaatggcagttgaataac

SEQ ID NO: 636641 - DNA, 104 bp, Homo sapiens
ggcgtctagaggatccgatcagagcatacccctacgggaacagcagtgataacctttagcaataaacgaaagtgaccaaccctggggttagtatagcttagtta

SEQ ID NO: 636642 - DNA, 346 bp, Homo sapiens
tcgttgaacacacggggtgatgtactcgagtgtccatagcgcaggtgaaatgagggtagcgagagtgactgcccatctcctacgtggtagcgctgatcctctagtaaaacatctcgaatgaagtacttggcccgggtcacgcgtgggtcctctccgggctcgggagtagcatcctcaggagtagtgtagcgagcaaattctggaaagtagtcctcaatcttcgatttcccagcaaggactttctcagcgagcagatcttgcctgttgaggaacaggatcacagagatgtgcgcagccatctgttgttccagatgctcttgaagaggttcagagcctcctgcaggcg

SEQ ID NO: 636643 - DNA, 991 bp, Homo sapiens
gctccatcatgaagtgtgacgtgcacagtccgagatacgacactggtatctgccaagcatcggtgactgtcggtgtggaacacaccatgtatccgaggacattgctgacaggatgcataaggagatcaccgtcctggtgcccagcaacatgaagatcaaggatcatacgaacaccccagatcgcaagtactcgcgatgttggcatctggctggcatcccatccgtgggctcgacttgtcgcaaccattccgagccagaatgtggcatctagccaaagccagggagctacgacgagttcgggctcccgtcctatcggtcgcaccgcacaatgcatttcataaacaggtaacttctagcagcatgcgtagccatcttgctgccattggagttaagtatgcagacatagaaacatttgccccgtggcaaatgcgatgatcaccttcatgcctagcctcaccgaaaactggaatataggccttcgatagccgaaattgtgcctctgcaatgcttttgtatctggatatcagcactggattgtagaagcttgttggctgattcccgaccttgtatagagagtcaactgtgccccttggtatgttgtttttataccctggtcactatatgttggagtcaagctttagtaacgtgtggcttggccacttcgtgctgcttgggtgaatgaactgtgctgtgttggaaaggaagaagctctgagcacctgtggaaggagatcttgtcgttgggacaatgctgatctgcatacggtcgtagggcattaacgctgtcatggtctgcagtgtaccggggctcgacacataacacgggtggcaagcacgcagatgggttcggaatgcgcaggctgccagggttggaaactccccgacgcggatcgacacctgttcactcaaaggcctggccaaaagagcgagaggggcccccatcgaaaagaaccctcttgtttggcccgggcagggtccaccaaaaagaggcc

SEQ ID NO: 636644 - DNA, 238 bp, Homo sapiens
caaaaaaaaaaccccccacataaaaacccctgcaccccctgttccattggggaattttaatgtttttcctttatccttgtaaaccccaggcccattttataacttttttggacggagctgttccctgtagggccatctgtctttaagtagggataaattcctcttaacccaaaaagaaccccagatagttttcccccccagcccagcgtcttgttgtttaaataaacttcttgtttta

SEQ ID NO: 636645 - DNA, 100 bp, Homo sapiens
gagaacgagagcgggaaagagagagagagagagaacgagagcgagaacaaaaaacgggaccgagaagaagatgaagaagatgcatacgaacgaaaaaaaa

SEQ ID NO: 636646 - DNA, 365 bp, Homo sapiens
tgaaagtacactattctggtctgagcatgtcaagatcccacaaagagaacagcacgaaccaagcagatggtcagatgttgcagtttctgtatgaatcgcggaaagatgctcttgaagcaagcccgaagaggaggggcatggggagggtctaatgaccatgtagcagatagtcgtttgtcccttttagccagtcagggagcacaatcatattgggatgaccgctcccaactgtccctcccagaccttgtacacaacactcttccaattcttcttccatgggcgtggtgggcttgcaggggaagtgtcagtacccgcacctcctcctcttctttcctgggggcactggggcatgttttgcttccttc

SEQ ID NO: 636647 - DNA, 102 bp, Homo sapiens
ggaacttcatcgctgctcgtggactccatggtctggcaacacggcctccctgtaccatctctgggggtccgagattgatgacaaatggtgatcactactggc

SEQ ID NO: 636648 - DNA, 188 bp, Homo sapiens
ctctcgggccactggcccaagtgcgcaaaccgggggcagagaagcctcaccacagcagcggcagtctgagttggggcgcccagctgccaccaccagcttggccccgcgcctccacacgtccgtgtgcgggcagtcccagcattccctgccctgcggttggccgtggggcattcttctcggctccgagt

SEQ ID NO: 636649 - DNA, 503 bp, Homo sapiens
tatctgcactccagcacgaggtttaagcgctggtatcaagtcgtcaccatgccacgtgttgccctgcgttagacccgtcgtctacgctgcggacttcaggcgttgtccaggcgcgtgttgctgagccgtgtccgcccaggctttccttactgcagccaaccgaacaaactcacagctagataccgcaatgtcacggctgctttgcaggcgattgggcctgccgcatggattcacgcaggatgcgccgagtccaggtagtacaggctgacggggtcgacccggttggaatacggcaggttctcgccgggtttgcaaatagtgctgctgcatgccccgtttgctggataacgtgatacgcctcctcataggcggcgccatccagcgtttcgaatgacctccttggccaccagtttgagcacgcgcctccaaggtgtttattggtgtgaatgccatttggcagtgccaacaggcgggaacaaaggggtcccgcagctccgaaatcg

SEQ ID NO: 636650 - DNA, 186 bp, Homo sapiens
atacccccgatacagcgacagtccaaggccacctttgatgccatttctaatgacctacagctacctgacccccgatacagcgaccacccccgatacagcgaacagccaaggccacctttgatgccatttctaatacctacagctacctgacccccgatacagcgaccacccccgatacagcgaggt

SEQ ID NO: 636651 - DNA, 106 bp, Homo sapiens
tctcccctccccccctttcaccatttcccctcggaggcgcttccccgggcaggggcagagccggtctcaccccgggtctacggccgcgggcgcaatggacaggatg

SEQ ID NO: 636652 - DNA, 196 bp, Homo sapiens
  misc_feature (67)..(67): n is a, c, g, or t
  misc_feature (114)..(114): n is a, c, g, or t
  misc_feature (144)..(144): n is a, c, g, or t
  misc_feature (151)..(151): n is a, c, g, or t
agaaaatggtctattaggatcttttattggatttcaactgatatttataagcccatactcctaagancaggattactcctggacttaaggctctgccagtgttttgtatttggnccttggccttaaccagctgtgtataacccngccagtncttaggatcctcaaatagcagcaaggacacagaagtctttccacc

SEQ ID NO: 636653 - DNA, 917 bp, Homo sapiens
cgtgtcgccgcttttgtctcctcttcctctcttctccttttctcacttgtccttttcctttctcttctacgcctgtgtttcttttcttctcctctcctctcttttctcatgtcttttgtcgctttcttttttaattctcttaactttgtctctgttatatccctctctgtcgtcctctctcttctgtgctcgcctccttgtctctccctcttggttcttctctctctcctgggtcacgttcggtgtactgccgtcttccctcttcgttcgcgttttacccttgttcgtccttgtcgtcttctcctttctctcttttgcttctttcatcttcttcgctcctctcctttttttgtttttcccttttgtctttctgtttttctgggtgctttcttctcatctagtgactcttctgatcctttgtatctccttctggttcctttttctgtccttttgtctttttctctccttctcttgtaacctttgtctttttttctttttgctgttctgtcctcttctgttcgctcgtctttatctctttttccatcgctcttcgatactctgcttccgtacgtcctctttagttacttaccgtagctcagttactctcgacgtgcaggctgctctgcggggatctccgatccgagcagtggactagtaagacttcactgcagtcgattctgcggatcttgctaagtagtgtttacagagctaagatctgtgtgcatgtgtgtgtttgtgtatatatacatatctagggctagtaccttagtttcacacccgggagctgggagcacataacctgtaacagtggtctttctcttattttttcataaagatagaaaaatcgcgcacgtcgcgcgtcccccccccacccccgtttttaaaatacgccttactggtgccagggtaaaaatttt

SEQ ID NO: 636654 - DNA, 247 bp, Homo sapiens
agaacaaaggtgtcgtgaaaactacccctaaaagccaaatgggaaaggaaaggctatattcaacattgtcgtcattggcacgtagattcgggcaagtcccccctactggccatctgatctataaatgcggtggctcgccaaaagaacccttgtaaaatttgagaaggaggctcctgagatgggaaagggtcctcaaggatgcctcgggcttggttaaactctaaggtcgaaggctgaacgccggatt

SEQ ID NO: 636655 - DNA, 621 bp, Homo sapiens
ctaatctcgaggacatgtacactgaataagtgtactgatacaatattgatatgcatatctgcatcaatgtgaaactctcatttgtataagtaactcaacattattagtgtatacatttcatcaaagactgcactgacagatataatcacatgctctacgctatctatcgagctcagcttccccttgcctatttagcctctatagagaatcgattttcaatggtctggatgggatcatctatactctcgctggcctctggcgctattgaacttgactttctggatcgacgacatgctgtatgaacacaagtgctagtacatcctggctgcctactgtcattcattcaaacgaatgcttagcttaacagtatgatggcaaagtgtactcactagtaatgcatgaccttcaacgttcatttccaggaatctgaacatgtgaaccatgaaacttgacgaactgattgctactcttatttgatcgcagtatgagaccatgctaggtttaaggctgatggcagtcagaagctttcaaggatatgacccataacgaacccatgatgcatataacgttttgtggggatcaggtgccctcatgcgctcagtgacctttggagcccctgtt

SEQ ID NO: 636656 - DNA, 698 bp, Homo sapiens
  misc_feature (293)..(293): n is a, c, g, or t
ggaagagttcagtcccgcttaccatgagccgggtgatccccaaccctacggagcagttgtccgcctctacctgaagctacgaccaccgtggactgacctgtccatgctgggtgatggccggggacgaacaggcccgtctgggcgaccaacttgtctatcgactgcaggctggttgcggacactgacctgtctgaccggagcgcatctctgcatctgtcgatggtctgctgagcagactcagaggtcgttggcttctcgactggtgccctggtcccgggtcacttcccgtcgtntatcaccgcacgcgcctcagggtgccttctcggacgctttggatgaatgaacgacggtcagccggtggagttttgtcctggttggtgactaatgacaaacgtggccgggttggagagtagtcctccaccagttggcatgattgctatgagaccgagatgtcgcaacaaggacgtgcagttgccgggcattaggcatgcccgtgattcgtggggaccagcactccctggcaagtggagaattgaaactagctcgaacatcgcttcgctccggagggaggcattgatagcaagagttggggaccaaggggacgcttggggggatcgattccgcaaaaccattcagtccctggggaatgagggaaagctggaatgaatgaagaaggaattttgggagtgaaattgtag

SEQ ID NO: 636657 - DNA, 1367 bp, Homo sapiens
atgtggtggtctgtagtgtatcgcatgattgttggtggttgcactctgttatactctgtgacgggtcatccttgatggtcattggatcggtctcctgtaaggtcggtattactacaacagtcttgtgcttgttatactgctttgctttgttcctacaggttgtacctaatttgcggggtgtatggtgctggttccttgtggcccacgagtggggattctgggtgttttacaaacccgcgtgattttggggtgtgcaacccctttggtggcgccgggtcaaccgtgtctctgcgggagggaaaattctggctgcggaaaggccgcccgtgacctgttgggagtggagaggctctgtcccgggggacccaatgggtgcttctcaaaagctccaagagaggatggttctgttgcaacggagtgttttcgtcggggggcaaacgggtggctggggcgacagccacgagatggggcccgccccgcatggggagagcacactggggtgttctaacgtgggctacacgggtgtaattatcccctggggaccactgcccaggggcccatatttagcgtctcgggcttatggcccccctggtatttgggagtgtgccaacaccgcggctcagcacattggcactggcaaaattcttgtctgagcctcgatagggaaaaaggatttgattctccccttttctgcgtatataaaggctgggaaagattggcccctagaaatttcttgataagtctctcggtgaatgcgtgcccactctggttgaataatggttctcttggcaaaggccccactgggtcgtcgcttgacgacacttttctcaagactatttctcacaccctttggggtctggcattatgccgtgttgtctggtgaatattgaggaccactgagcacgtgtgtcggtgtggtgtcactatcacagtagccacaggtggagccacacagagaagagcctgtctggagagctggccacaagggtcacccacagttctggcccacgaaaggctcacgaagggtataatggatagttagtccctaaaatcctgccacaccccacctctcttatatccacgtggtggaaagaaccggtttcacgagacctgtcttgtttcacattggccactcttaagtttagttagtgaaaagaatgggtggtaatgatgaacacatggcatcgtgaacaaccttcaagaaggaaaggagaatagttttgtggaaccacactttggtgttttcttattttgcgtgtgggcagttttaagttattagctttttgaaatcagtactttttaatgggaacaacttgacccaaaatttgtcacagaattttgagacccccccaaaaagttaaaagaga

SEQ ID NO: 636658 - DNA, 447 bp, Homo sapiens
tccttggagagcacacttgttattatgcctgccccagctttgccttccaccatgagtaaaagcttcccaagtcctccccagaagcagatgctggcgctatgcttctggtacagcctgaaaaaccttgagccaattaaacctcagtgagctcaagatgtctttgttgaaacagaacctcccgaagttacagtattggttttggggctccacacagagaacacatcacggaagctataattgagggagacaaagctgtcaggacgacaccaagagagttagaaagcccaagagtggagcattcttcaccatgattccacctgacacttggctgaaagcattttgcactaatttgctttgtgcccgttcagacaatctaaaaagaaaggatggggggacaacaagtgtctattacacagaataaatcagtctggcaaatgaatacatttt

SEQ ID NO: 636659 - DNA, 231 bp, Homo sapiens
aggcattcataactttcagacatctgacattgattcacaaatgagaaaaaaaatctgaggcataagatgtgaggtgaggtgaggtgaggcatttcagtttttggaaatatggttactgttattgagggagttaatgtcattgagggagctcaagtcattgagggaggactgggtcggatgctgggaaaaggctaggggcatatttaggaagtccaattgaagttatgggca

SEQ ID NO: 636660 - DNA, 1020 bp, Homo sapiens
catgagccctaataggggcccttctgaggcctcctaatgacctccggactagccctgtgattctcactctccactgccataaggctcctcatactaggcctactagccagcacactaaccatatgccaatgatggcgcggtgtaatacagataaagctgataccaagggacaccacacacactaacctgtccaaaaaacggctcgtatcgaatagcgggagtaattcctgattgtatgtaaccttcaagaatgttattgattactgtcgtcatgggataggatatctggaggccatattattaccacattcgcacgatctagacccacatattccggcccaattgtaggcaagggacagcttggagcgcctcatatcagagaccatctacccgcgacgtgaaagtccgcctagaatagtcgcacactcctagaagcactgtccgttattagctcgtcgatcattggagttactcaaatcgacctccgtgagactcactcaataagatcatagacctagaaaatgaatgcgtagaatgcatgatactttcaggcgacgtgtttagtgtacaatgttctttactggggtctctaattttacccctcctagcaaggccctcagagtacttcgtagtctcccttcaccaatttccgaacgggcatctacggctcagccatgtctggtatgccatcatggctttcactggtggttccacgtcattatttggtcaagtttcctcatgatctgcttcatccgcaaagtaaatatttcactttacattccaaaggatcactgttggttcgaaagccggcggctgatactgggatttgtagatgggggttgagtaattctgtatgtgtccactctattggtgggggtttaaaaaaagaaaaaaaaagagaaataagaaaaaaaaaccggggggcttttgggggggggaaagaagaaaaggggagtgtaatgttccaccttggtagagagagggaaagggggcccaaggggggataaaacgcagttcaga

SEQ ID NO: 636661 - DNA, 308 bp, Homo sapiens
  misc_feature (211)..(211): n is a, c, g, or t
  misc_feature (253)..(253): n is a, c, g, or t
  misc_feature (285)..(285): n is a, c, g, or t
attcgtctaaagattgacagtagttagcggtaacaaagcattttaaaaattgaatatgaagagttttcaaaatgcaaacgtttagccttttcagaggcagatcactggcttcctgttgccaaatagaaacagaaataattacccaagaatctaaaagagcttcctatacttaggatttattttccttttaagatgggtaaaagaagtattnaaaatgtgaagagtagctgtaggtatctagaatttacagttngttaaattttttttaactctaagcatacacangatagatgtacattaattatttt

SEQ ID NO: 636662 - DNA, 291 bp, Homo sapiens
atggcccgggagccacgacacgggccggccctcggcgctagaggtccccgcggacccggaaggcggcggacgggctccggcagatgtacgccgccgggccgaagcaggagccggccgggaggggcgccgggagagcgacgggcttctgcatttggcagtgctattctttttgagggggagcgagggggtgcaaggaagcgggaaagccgcgccgagtcgcccggggaccctccggggtgaaccatgttgaagtcctgtccaacggggaagcagctcccacctggtgaacta

SEQ ID NO: 636663 - DNA, 385 bp, Homo sapiens
  misc_feature (123)..(123): n is a, c, g, or t
gctattatgtaacattttttgtggaaatttccagcctgtgcaataaaaataagaaacagaaaggaagcagtataactttggaggaaagagtaaattgtcggcagggcgcagtggctcacaccntgtaatcccagcactttgggaagccaaggcaggtggatcacctgaggtcaggagttcgagaccagcctggccaacatggtgaaaccccatctctactaaaaatacaaaaaattacccgagcatggtgacaggcttctgtaatcccagctactcgggaggctgaggcaggagaatcacttgaacccaggaggtggaggttgcagtgaaccaagatggcacccttgcactccatcctaggcaacaagagtgaaactccatttca

SEQ ID NO: 636664 - DNA, 556 bp, Homo sapiens
  misc_feature (552)..(552): n is a, c, g, or t
atcacgtggtctgactccgagctcaggtgatccacctgccgcggctcccaaagtgctgggattacaggtgtgagccacctcaccgggcctctttttttagttagtatttaatttaaacgtatggtgattttaattctgaagagcaagttgtaggttggctagtcctaatcacctatctgatggctacttggattcccgttactacacgtactacacatacaaaacctttggatcatccggtgtacgtactactggtcccgtacgctttaaaaactctggctgtcaggaggggctccttactgttctttctttctatgtaaaatatttacacaacctattcggtaatacgtgacgtaacaggggaccattacacctggtttctgataaatgccttatgataaattacgacataccttttttcttaacctagaatacattagagaacgaaaaagacaaagatgacaaatactctcccaaaaaatggtaaacttcggcgcttgtccacagcaccatttcagacaaatccatctcctgaaatggtatccaaactgnatct

SEQ ID NO: 636665 - DNA, 389 bp, Homo sapiens
cttcccctttttttttgaaaaaaaataatttaaatttgccttttttttttttaactgaggtgaaatgagaatgaaggggtttccccgggtttttatctctctccacttcccgcccttaaccatatgaaaaaaaaacttttgttttttctgagatgaggatatgttttagatgccccgttggataatgtggggaaaagacctttaagcttttcctggtccccctgtgatgtggtcaaaagcttgaaatttaacccctttcccttgggttttaaactgaaagccggctttgctttgggttaaaaatatgaaaaggggtttgatactgttttagaccttatggagagattttattttttgtaataaaaaatttgctgccgttttaaaactga

SEQ ID NO: 636666 - DNA, 103 bp, Homo sapiens
catgagcttcaccgactcgctccaccattctccaccaacgaccggtccctggtgctctgtccagtgctgcccatggctacggctgcccgtgcctggtcagcac

SEQ ID NO: 636667 - DNA, 87 bp, Homo sapiens
aggagctccgccccaccctctacagccttcctcaggcccctgtctctggtccccagcctcagtgcctcttggcccagggcagcgcag

SEQ ID NO: 636668 - DNA, 490 bp, Homo sapiens
ccgcccgagggtaagtctttacctaaaccttacccactggaaaggtttcccgggaaccggaatttaaagggaaccctttggaaattcccggcatttccgcgaacctgtagttaccccaaaatttttacccgcacatgcccactgtctgaattccccagttggaaaggttggctaaaatgttacaagccaggagcctgccttttccggaaggccgaatctttcgcgaaatagggcaaatggcctgaccggatggttttttggaaggatggtatggctgcccggatgcttcggaatcccggtttttttccggaccgttttgaagtttttaaagccattgttaacagtttttttaattaaatctttttaaagaaatgcaaacgcaaaacctcggctacccgcgaattggtaaccaaagacaactgaaaaaagcctgcgaacaatattgggcagggaaaattgatctggctgaacttaacctggttgcccgaaa

SEQ ID NO: 636669 - DNA, 205 bp, Homo sapiens
cttacgaagaggaaagacagaaagtaaacataataagttttgtggaagaagaaaaataaaacaggaaaagagggagaaagggcccaggtgccacggcccacgccagtcatccacaattttgggaggaggccgcggcaggcagttcacttaggtcaggatttcgaaaccagcttgcccaccggtgaacaatgtgttttcttaaaaa

SEQ ID NO: 636670 - DNA, 327 bp, Homo sapiens
gaaagcctggcccacatagtgagacccatcccttaagaaaaaagcgtctaggccgggcgcagtggctcacgcctgtaatcccagcactttgggaggccaaggcgggcagatcacgaggtcaggatatcgagaccatcctggctaacacggtgaaacgccgtctctattaaaaatacaattagctgggcgtggtggccggtgcctgtagtcccagctacgcaggaggctgaggcaggagaatggcatgaacccgggaagcggagcttgcagtgagccgagatcgcgccgttgcactccagcctgggcgacagagcaagactccgtgtc

SEQ ID NO: 636671 - DNA, 262 bp, Homo sapiens
  misc_feature (14)..(14): n is a, c, g, or t
  misc_feature (25)..(25): n is a, c, g, or t
  misc_feature (54)..(54): n is a, c, g, or t
  misc_feature (62)..(62): n is a, c, g, or t
gttttcacaacccnttgcagtaganactaattctcattttacagatgagaaaantgtggagnttcagagagatcttgtgactggttatataagtgttaaaacttaggttgatgtgatttataattccccatgcttaactcctatgctataaaattatgaatgttgtttttcaaattttatagcatggagctgtgtttagtttattttgtgctcaaaactggcccagagactataaatatagaatgaatgaataaatgaacga

SEQ ID NO: 636672 - DNA, 448 bp, Homo sapiens
gactgactgattccagatgtccggactgattcgggtgtcagtggtagacctggggaaaggtgacaggtgctctggatggagccttctgattttacctcagcgtcctgtcaggttaggtatgtgtaagtaaatctagcttatggggtaattgttttttctttatttgtgtgagtatgtgtgtgtggaggtcagagaacaactcatttctacagtgttgatcctagcgatcaaaatcaggttgtcaggctggaccacaggtgccttttactactgaggtatcttgccagccccactggttttaagtgacgtataattacatatgttatgtagtacaatataatgtgttgtgatacgtgtatactatgaaatgatctgatagttcacctcaaatattttattactttgttgaacttttctagctgtttctaaaatacccagtatattatca

SEQ ID NO: 636673 - DNA, 115 bp, Homo sapiens
tcgagctcgtaccctcaggagaggctctgttgcccttttagcaaggctggaaatgggatatgggcagtggacgtcttctctgacttcaccctagactttctggctccaaatgggg

SEQ ID NO: 636674 - DNA, 115 bp, Homo sapiens
tgtgtgtgtgcgtgagtctgggcgtgtgatgtgtgcagtgtgtgtgatgtttgcagagtgtgtgtgtgtctgggcatgtgtgggtatgagtgtatgtgtatggggcatttctcct

SEQ ID NO: 636675 - DNA, 86 bp, Homo sapiens
tcatcctctctctctttgctctcttgtctcctatccccgtccctttttgtatcatttaataaagaaatggtcgcgcttctgttttt

SEQ ID NO: 636676 - DNA, 149 bp, Homo sapiens
tgccacgaggtgatgatgaagagggggagggggaggaagaatatggaggaaaaccaaaaccccaagcacccattaaacaagtcctggcaggactcacaggaacaaactaggtccctgggggggttctactcgggggggggattttgctg

SEQ ID NO: 636677 - DNA, 1401 bp, Homo sapiens
agcgggtgggtgggcgcgcggggctgtaggatccacccgcctcgggatccacggagctgggtccccgccgcgccccgcggaccccacggcccttccgctccgctcggcctccaccaccctggcctcgagctgcagccgttccaaggacaacggccatccctgtggctgggccgccggctacgcaatgctgtctctcttgctgatcctctcaggcctgggccggctgacctccgcgggcccacgccacttattccatcaaaattgaggggaaaccatacacttcctgcttgaaaaacagtcatttttacacccacatttcctggtgtatttatacaacaaatcaggaacattgtatgcagattcttcattttcaaagggtcattgcttttaccaaggatatgctgcagacattccaaaatcagttgtggcactacgcacctgttctggactcagaggattactgcagttagataatatcagttatggtattgaaccattggaatcttcacctacatataagcatgtagtttatcgaattaaaaatgatgctattggtcattcctcctttcaagaaaattatcctgtggctcaatatatagatcagtcctacaggattcttgtcaaatcagacataaattcaggtgccatgctatcgaaaagaactctgaaaatacaaatcattatggataaagccatgtatgcttatatgggctccacggtggcagttgcagttgagaaagttttccaaatctttggtcttatcaacactatgttttcccagcttaatatgacagttatgctgtcttccttggagatctggtcagatcacaataagatttcaacaagtggtcatgctgatgaaatactacagcgatttttgccttggaaaacaaaatttttgtttcaaaggtctcctgatatgacatacttattaatttataggaaccattctacttatgtgggagcaacatatcacggaatggcatgcgatccaaagtttgcaacaggaattgctctgtatccaaagaaaatcactgcagaggccttttcagttgttatggcacagttgcttggaattaatctgggattgacatatgatgatatctacaattgttactgtccaggaactacatgcataatgaatcctgatgcgatacgatcccatggtcttaaatggaataaaatgaagagattttggagcaaagtgggaacagtaagcagcagatctatctcagaagacagcagtagtaacagcagccagtcacagagttaaagtaaccaagtgataaaatcaaagccatcggatgaagaaaggatattaccaagaaactcacgattaacttaaaactttcaacttcacagaaaaaaataaatcatatgactaaaagcataaaaaaaaaa

SEQ ID NO: 636678 - DNA, 467 bp, Homo sapiens
taattattggagagcaacacaccctgtatcagggttctccgcgagttgtggtgctcttcacttgatttgggatcttgccattgacttggcaaaatttctcaaagtgagaaactctgccttgtcctagaatcagttgaatgaatcattctttaattttgtgctaatagcctgatgtgctaattcagatgaatgaaagctgatcctaaacttaattcttgattgtggttgcttctcttcttcccacctgtggaagcataagaacactgctacaaaagaatggatagggaagaggagttgaaattcaaatctatttggcatatctatttaaaggttcaatggaaatgatcatgaacctaatggtcaaagtgagtagaagagatgtattggtagtcttgtattagccatgttatagaatgaccatgagttatttagaacaggctttattcattttgcgcaaaatatttgca

SEQ ID NO: 636679 - DNA, 446 bp, Homo sapiens
catttccattgtcaatgtgatcctggttatgctcctccagattgtgagccagcaatgtcatcaccaggaggaagtatcaatgatggattttggcttacagtagaaaaaagtgtacccttgcttccaaaacgacgtgctgctcctaaaaacaatggtcttttgatcagtttctacattttttcacctttgctcattttaattgctattgttagtcttaaatggaataaaatgaagagattttggagcaaagtgggaacagtaagcagcagatctatctcagaagacagcagtagtaacagcagccagtcacagagttaaagtaaccaagtgataaaatcaaagccatcggatgaagaaaggatattaccaagaaactcacgattaacttaaaactttcaacttcacagaaaaaaataaatcatatgactaaaagcataaaaaaaaaa

SEQ ID NO: 636680 - DNA, 233 bp, Homo sapiens
tctctctgtgggcgtactcccaggatgagtgtacagagcaggacagccaggtacagctacctacagcctcagctagtcaccctggacgctggagcaaatgcagactacgagaatacacaaagtctacgcctgctaattcaccgcatcaggccctgagctcgcccgtcacaaagagcttcaacaggggagagtgttagagggagaagtgcccccaccccccacagagagagcgt

SEQ ID NO: 636681 - DNA, 499 bp, Homo sapiens
tgtcgccttaactacagtaagcatttagaataaaagccaaaatagaattattgctgccttctgaaacttgagatgttagctctctattaagctgttctgtgctagccctgagcagctcactggtaaagcagagctgcctacttgtatcaagattttctagtcactgcataaaggaaacgcctaagagttgccgtattgctttctgagaaacaaattgctatatatttcatgtaaaagttgttatactaaatagaataaattttggagtctctttttcactctagtgggtaatatctaatttggcatttgagtcctaacattatgtaactttagctaggttggggtcgttttagaatgtttccctagtcatcttaatttgttccattttctgactctgtcctataaacaaaaatggcaatgacactttatgattttttctttcttagcttgtgcctatcctattattttatgtgatattattaaatgtataaaaatgtga

SEQ ID NO: 636682 - DNA, 634 bp, Homo sapiens
ggcacgaggttcctctctgcgaactctctaacactggaacattgaggaaatcacggaacttccatgaaggaacttccatcagttgtgacagcaactactcacaaaatgtctctgatattagcagtagtacggtctccttagagatgctggatttccagtttcatgggcgtattctcatggatggaatgtttttcagtgggcgacactaactggctgttggagatctgtgtggggacatggccatcacgtatgatccacaggcacttctctggttctctgtggctggttctgattttattccaagtttctgaatgaggtggtttctatcccgatgtgcccttcctatcttttcttcctcttgtctcccctcatttcagcctcttccgaatctcacttctaacccacaccccatctccaaaacactgggaagtctgcattgagatgataaggttatagtattagcacacttttgtatcaagttctcacagtgtctgaaatgtggttatgattccatgatgtctctaatccctactcacccagttcttaagaatcatgggcaaccctgcttgggtccgccttcacgctgtggaagctttgttcttttgctcttcactgtaaaccttgctaccactcg

SEQ ID NO: 636683 - DNA, 197 bp, Homo sapiens
acatcccgattaaagccaacatccacaagcaaattaagttgtgtactcgataacgactctagcagacttgggtttgtccccccaacttcatgaccatgcaagtaggcgtatgcattttcacgaatataacgtaacaatggctgatcatagactgtccctacaaacttgatgcgtttatcctgatcaaatcctgtttt

SEQ ID NO: 636684 - DNA, 868 bp, Homo sapiens
  misc_feature (591)..(591): n is a, c, g, or t
gagctggcactgcggtcgctctcccggcccgcggtggttgctgctgctgcgcgctggtgttgggcctgaacgcaggagctgtcatggacgtggtccacagaggagggcaaggaagtatgggattatgtgagcgggtccgcgaaggatgccgtacagtgttctaggtggctctattgatgccagcaactctctgcaagaacttctcagaactgcccctggtcgtgtggcttcagggcggtccaggcggttctagcactggatattggaaactttgaggaagagttgggccccttgacacgtgatctcaaaacacggaaaaccagctggctccaggctgtcagtctcctatattgtggataatcccgtgggcactgggttgcagttatgtgagtggtatgtgcgagccttatgggtacggcagcttgtgctatagcgagggcattcgtgaccatgattgcgttctctcgtgcacagaccgttgctgtgcagttggcccacacaagagtacccatcaccacgttccgattactacacttgactcgaccagtcctatcgtgccgtgaccaacatgagtacgctcgggcatctggntctagcagcgtttcatagatggccaatccagtcgaaggagaccaatccaaggtagcaactattatgcgggggtgtggtatgccctttagtgtggtgagttccctttgggactcttccccctttgtatgcatttgccggctagcaacgtgtcgtggagcagggaacctttatagcgcttgtgacaagtcaatgctcttacttccttctgaaatgacacagagggtccttgtgcagagggtcgtctaggggtgtgcatgagcagaggttactggcaatg

SEQ ID NO: 636685 - DNA, 233 bp, Homo sapiens
ataacaaatgcagctaggacctgctgcccaagtctccatctgtcatcaggggcgtgaggtcccaggaagcggccaaaagctagacggatccccgtccctgacatcacagcagcctccatcacaaggctcaagacctaggctcatggacgagatgggaaggcaccggcagacgggattaccctacacccagacgccaggcagcgaatgtgctatttaaacttctagacactagg

SEQ ID NO: 636686 - DNA, 254 bp, Homo sapiens
ctgtagcactgggcaatagagcaagactccatctcaaaaaaaaaaaaaaaggaaaaagaaaaaagaaaatagtctcgggttaaattaccctctgaaagactccaccaaaattttcttcttagcttttctccccaaatttcaggtaaattaaaatagagtttgagagaaaaatagaagggcaggggagttccctgtccactattttttatttaacccagttgtcctactttattttttggtgggtcctttttttt

SEQ ID NO: 636687 - DNA, 178 bp, Homo sapiens
aattgctgtcctcccaagaggtgagtccctgcacgctcctcatcatataaacatgatcagagtctcctccatctgatattacgaggggaacatcatatcctggctgacatcttcatttcaatcctgagctgagctgaaggccagcagggccactgacagcagaatcagccgcatcttg

SEQ ID NO: 636688 - DNA, 439 bp, Homo sapiens
agtgtccaaagaactgttcctcgcggctctatcagttaaattgtcaagcggatttagagagttctgtgggcaaatttgaagttgaactaagagtatatcttggacatccagctatcaccaggctcggtaggttagtcgcctatgcctatacctgttcccacgtctttgccacataggcgggtgtgctctgggacctgatcttagctagctcgtctgatttcgagtggtctcagctttggctatccctgcgacgttatctcaagttcattcattatgcagtaggtataggggctagtccctgctatattatgcatggtcataatgctcaatctttcccgtgcggactagtatctagtgcgtcaggtttcgacttctatagcgtataccgtatttgcattaatagtatgactcaggttgtctgatagtaaggtgaagtgag

SEQ ID NO: 636689 - DNA, 957 bp, Homo sapiens
aatcaggcagtggctacgcctatatttaaacactttgggaagccaaggtggtggatcacaaggtcaggagatcgagaccatcctggctaaaacggtgaaaccccgtctctactaaaaatacaaaaaattagccgagcatggtggcaggcgcctgtagtcccagctactcgggaggctgaggcaggagaatggcgttaacttgggaggcggagcttgcagtgagcggagatcagagcgagactccatctcaaaaaaaataataataattaaaaaaaaaaaaagacttcatcaagaggccaggcatggtagctcacatcctgtaataccagtgctttgggaggctgtggaggcaggaggactgctttgagcccaggagttcaagaccagcctaggcaacatggcaagaccccatctctacaaaaaatttaaaatttagccagtcatggtggcatgcacctgtagtcccagctacttgggatgctgaggtggaaggatcacttgagcccaggaggttaagtctgcagtgagccaagattgcaccattgcactccagcctgtgcgacagagcaaaaatccatctgaaaaaagtcacattataaacaataagagagtgaaaagacaatcaatggaatgggaaaaagtttttgcaaatcatagatctgataagggttaatatcccaaaattaagaattcctataatcaacaaggaaagacaaagaagcccaaaaaggcaagggcttgaaccagaacctttctcccaaagaaatctatacgattgcccgatttagataaaggcctaagaggatcttcagatcaatagtcattaggaaatggcattcaaaccacgaatgggttcactttttacctaaatggttattaaagtcccggtcagtgcgtggtcaacctgaattaacattgaagccaggggcaacaataggcagatcagacgctcatgtg

SEQ ID NO: 636690 - DNA, 277 bp, Homo sapiens
ttaataagcagagacaaaaatgacacgcaatatatttacatcaaactgatacaaaagcaaattaaattatgcaaagtatatacataaatagttgcacagagtgtttaatacattacgccatgataagcatagttgcgtgcatagtgactcataataaacgatgataaattgttctctgcttcactatcaacatccaagtagcaaaacactagtcaatgattaacattacaaacagatcgtaccacactgaacgcaaatacatcacactgggtggaga

SEQ ID NO: 636691 - DNA, 187 bp, Homo sapiens
cgcgtacgattcacgctctactgatgccctacggtggtggatgcatcttcatggttattgagggcaagaaggctgcccaagacacagactttaacaagcttgaacttagaaaagacagctcgtctgaaagaggaagcagctatgaaggccataacagagtagcagaggtatccgtgttggctgggga

SEQ ID NO: 636692 - DNA, 662 bp, Homo sapiens
caggcagagctatccatcaggtgtcatgtggtgatgatttcactgtctgtgtgactgatgagtggtcagctctatgccttcggatcagattattatggctgcatggtgggtggacaaagttgctggccctgaagtgctagaacccatgcagctgaacttcttcctcagcaatccagtggagcagtgtctcctgtggagataatcatgtggtggttctgacacgaaacaatggaagtctattcttgggtgctgtggcgaatatggactgactgggttttggattcagaagacgtgattattatacaccacaaaatgtgtgtgatgttcccaatgtgtcttgattatttgtttgcagttcaattgtgtgctgtgatgggacatttctgtatgacccagtcaggcaaatgttgcttggcctgtggactcaatgaattcaagtaagcttgggtctgaatcagttgcatgtctgggaattatcaaccatgaacgcataccatgaatgttccctacacaactgtcctttaccttgtgccaaacagttgtccttttataatgatcctgtaccatttgccccagtgcaatgactcacacagctcgctatttgatgatgctgaggccggcttgctgaccttttggctgcaagcaggtgtgggcatggttgg

SEQ ID NO: 636693 - DNA, 887 bp, Homo sapiens
gcaattaatgcacgcagttgcgataaataaaaacatctcacctaagctctccttttcttcactacacatagactactgacactgactaggaacgctctcagccttaggcgaaagcagaactaaacttcttagcacttatacgaacactggcacttcaacaacgtgacctggacacaacacttgcgctgacacacttactggctaacctgactacttccttcctggctgcttactcctctcagcgcacttgctttccacctcaaaacttctacttctctctcaacacaaactattacctctacacacttatacttcctaatgctaaacgctgactgacctctgctccaggctgacttcccagggtctgctactccttttagccctacacaaactagcacgtacattgcctcctcaaacttttagcaactggcctacttctctgacacgtgctcttacttacccaaatctgggcctactgtcgctctctgaacccccatctaacacggcctctatacaagctcacctacttccgtctcacgccaaattgcgcaccgtgcaccgcaacacggacaaacgtcctggctaaccaatctcatgcctctcgcccattagccagcaaggctccatgataccaacctactctacgcttcccacgcacctctatgataacttactatcgcccaaccgtggtttccacgccgtacgttgggcccatcaatcgtcgaacccttgcaccacacacacatggccttcataacagttacccaacataaaattctggggcacttacttgtcattaacttctcacccccatcttgtgcacactaccggccttctccagcgcgcttctcacttactcccggcggcgcctttggaacaataaatcc

SEQ ID NO: 636694 - DNA, 258 bp, Homo sapiens
  misc_feature (34)..(34): n is a, c, g, or t
  misc_feature (147)..(147): n is a, c, g, or t
  misc_feature (218)..(218): n is a, c, g, or t
attaaagcactcaaaaagaattcctggctgggtncggttggctcatgcctgtaatcctagcactttgggaggccgaggcaggcagattgcctgaactcaggagttcaagaccagcctggacaacacggcgaaaccccgtctctactnaaattcaaaaaattagccaggcatggcaacgtgtacctgtaatcccagctactagggaggctgaggcaggnaaattgcttgaaccgctcagacagagcaagctccgtcttt

SEQ ID NO: 636695 - DNA, 323 bp, Homo sapiens
gggggggggtttcccccctttttccccccccttggggggggcccggttttttttttttggcccccccccctggttttgggttttattggcccccccccccaaaacccttttttttggggggggttgtttttggggccccaaaaagcctccttgggattttggcccccccccccccccgggggttgtggggggggtcttttttccccatttttttttttacccgggggctttttggggggccccttttccaaaggtcccccttcccccggggcccccggtttttggccctgaggggggggggacccaagtttttttgttccgga

SEQ ID NO: 636696 - DNA, 379 bp, Homo sapiens
gcaatatcatgcatcagtatctatcagtaaacgagtgtgtgccaattcaaggatcgcacaaaaatctgtgatattcacaggtatgtagtgccatgcttgaataggctcacaattgaaactgatgatgtcgcatcttgatatttagggtatgcacttagacttgagggagtaaactggagccattttcagagtccatggcctccgctgataagaaaggtgtagtacaggcttattagtaggggaatatttctactagcctaaactattctgtgtaaggaagggtctgttgcttctgcagcttacgcttcctctatcactcttcacatacctatttaaagagactagttctctctgactaaccttttatgatacccgcgaa

SEQ ID NO: 636697 - DNA, 962 bp, Homo sapiens
  misc_feature (784)..(784): n is a, c, g, or t
gagtcagtcccaatcatgagactgcatggcagatggtagggtcccttgattccatgtcctggggctcctggtgctctggcactcaggtgcacagatgtgacattgagaatagagccaaatgtctccatttctcactgtggtgtatctctggatcaggacactgcagttggcctattcatgtgtgcaaggtgccttgcagaagaaagactagttgagaacgaatctacgtggtcaggagaatccggtgatgctacgacatgtatgaattgccacggggataaggttacccgaaggctctatgatcatacggagtggagcagttcaatgttgggacccaggggtcccgatcaaggtgtcctaggtggctcgatgcgaggagtaaaggctactcgtgctcgttcatcctagtcaaggaagtctctggcccaaaccgtcgtatgactactttggcgaaagcgactcttgagcgtgttcgaaaatcgaggtaatttaactgggcctgtcactctagacattttacggcccatgtggagatcacccgtggtgtaatcacgaagtcgataacccggaaaccaggttggggctgggaccccaaccccatgggattcactcctgccgcggcgaacccgtgagttgacgccaggtggagacaactcgtggaaagcctggggcgtccttggtctgattgtgccctgtccttgattgaccatttctttagtcaccagtgagggaatgcgccccaaccaagtgatcgactgcagagaaaaatggtcggatgagactnggctgcctaaccaaagttcgaaggaggttagagcttaacctaaggggagggaagtcgttcctcgaagaaaagcactggaacaacggtagaccgggacaaagacaagattaacaaaaggcttctaagcaaagaaaaggcccctagaatgccttaggccactatgtggtggacctcatcg

SEQ ID NO: 636698 - DNA, 170 bp, Homo sapiens
gttacattgggatctgcagatggggtgttttcggtatttgctgttcaaagtcttcactgtaatctgaataactttgcagtgcaataatctctctggagataaattcattagtgtgttactaaatgttaatcttctcttgcggaaatacagtaccgtgtctgacttaatta

SEQ ID NO: 636699 - DNA, 195 bp, Homo sapiens
gactctagacgatcccttatagcctaggtcaggcacggcggcttattatcgtaatcccagcactttggaaggctgaggcaggtggaccacctgcaggcaggattttgagaccagagtggccaacacggtgaaaccctttctctactaaaaatacaaaattagccagacgtggtggtgggcgcctgtagtcccagc

SEQ ID NO: 636700 - DNA, 101 bp, Homo sapiens
agttgttggctccaggcatttgcatcagttcttgggccagtgcagcagtgcagtagtcagaatgtttagtgagcctagggtgttgtgagtgtaaattagtg

SEQ ID NO: 636701 - DNA, 649 bp, Homo sapiens
tgtcgctgtgtcgctaggctggagtgcagtggctcgatctcggctcactgcaacctccacctcctgggttcaagcaattctgcctcagcctcccaagtagctgggactataggcatgcgccaacacgcccagctaatttttgtgtttttagtggagatcgtttcaccatgttgaccaggctggtctcgatctcttgaccttgtgatccaccctgcctcggcctcccaaagtgtttggattacaggtatgaaccactgcacccagccatattttttgatatttatagacgtcttttttcctttggtttttttgaggcggagtcttgctctgtcaccaggttggagttgcagtggcgcgatctcggctcactgcaacctccgcctcctgggtttaggcgattctcctgcctaagcctcccgagtagctgggattacaggcacgtgccaccacgcccaactaatttcggtattttaagtaacaggtggcattctaccatgtgcggccacggatggtcttggatttcctgaccttgtgatccccccgcctcagcctgccaaatgtgctgggattacaggcgtgacccactgaccccagcctatcgatgtcttaccctcatggtttcctgctcctttggtcccgggtacctctc

SEQ ID NO: 636702 - DNA, 368 bp, Homo sapiens
caccaagtgattttatattatatatatataaattttcttcctttcctttgtggtttttcgccccggtgcttggaaagatggaggcaggggttctggtcctgcagtctgagggcaggctctcctggcaaggccgtgtctaagagcagattgtaggacatgcgatggactcccgaggttcctctgtccgccagcagcgacgcttcttcagtccacattagccacctcaatcaactccttgatcttaacttggcatctttctcaaccggcgacaacccagcaagggcatggtccatctgctgccttttctgggctcccttttctgctgaccaatttacgtgcacggtaaaaatgcatgtttttccaaaccc

SEQ ID NO: 636703 - DNA, 109 bp, Homo sapiens
cgaccggtgtgctcatcccacctgtgtgctcataccccatctgtgtgctcataccccaccgggtgcgcatacccacatgtgtagctacataccccaccagtagtagctc

SEQ ID NO: 636704 - DNA, 290 bp, Homo sapiens
  misc_feature (262)..(262): n is a, c, g, or t
ggcaataggcctttcatctccggggaaagtctcaccttggccctcagacacccgccaagaggggtcggaaggacaaaattagcataaagaagggtggctagagcaattttcaaggtcttggcccaagaattcttgaaaagaagcgctcgggtttctgcccaaaccttccacgcgagtgtaatatatttgaagggccggcccccttttaggggtttcgcgctttctttgggcccgaggggaaaaagggtaaaaagttaatttnacataaatcgttataacagggtaaaatg

SEQ ID NO: 636705 - DNA, 236 bp, Homo sapiens
cccagcactttgggagtccaaggtgggtgaatcatttgaggtcaaaagttttagccccaccctgcccaacaaaaattagccgggcgtggtggtgggcgcctgtaattccagctactcgggtggctgaggcaggagaatcgcttgaacctgggaggcggaggttgtagtgagccgagatagcccccctcccctccagcctgggcgacaaagactccgtgctccgtttcaaacaaaga

SEQ ID NO: 636706 - DNA, 683 bp, Homo sapiens
  misc_feature (442)..(442): n is a, c, g, or t
gctctcggccttagcgccatttttttggaaacctctgcgccatgagagccaagtggaggaagaaagcgaatgcgcaggtctggaagcgcaaaagacacgacacacgactgacggcagaggtccaagtaaacccgctagccttgttggcaccctgctgtgaaaggcccacatggatgcaggaaacatggtgaatggcccagacgcttgggggaatgcctggggtacaaggtttgttaggggcgaacctggcatgttgtcttaaaccttggggtttcccttaagcaagggccttttgggttcccttttccaaaacttgggggaacttcctgagagcagagacctgtttacactttcctgtgccacccctcccgtgggaactttccgggccccgggaattttcacaaacgcgcctgtttttccttttggggcaaaccgggaaaangtcgcccctgacagaaggcgctcctttttgttggcgctcttcccaatttaagaacgatcgccacgatgaaagatgttgggacgccacccacatgtttgggcttatcagggagggatttccccccactttccccatttgtggaccccccctccccttttggggggggcaaaaaccccccccccttttggggtgctttggggaacgcccaaatttttcttcccgttgggggggagaaccctta

SEQ ID NO: 636707 - DNA, 379 bp, Homo sapiens
  misc_feature (29)..(29): n is a, c, g, or t
  misc_feature (62)..(62): n is a, c, g, or t
  misc_feature (114)..(114): n is a, c, g, or t
  misc_feature (179)..(179): n is a, c, g, or t
  misc_feature (370)..(370): n is a, c, g, or t
acaccagaacacaatgcgtacaaaccatnacccaccatcgagtcctgtcgcatatccaggantgacgtccgaaataaccgtccacttcctgggccaaacgtcgcgatcaatacnaaactccctctcgatcgagcagcgtcgcgagatcgacaactgtctctggttgatagcgtccgatnacatgcgggaggccgtcggtcatcggagcgcgcgcgatgaaggccgcggcatggccgttcccccatttgcccagcttgtcgttgtgaacatcctgataaaacacaggatcgacttgtgcggtcagttcggcgttgatgatggcgtacagaccgccatcgatcgtcacgtagctgcgggaaccaccagaatntgccgttca

SEQ ID NO: 636708 - DNA, 785 bp, Homo sapiens
catgacgttcgaatatcgagccttttggcataatgattatacgataaagtatccgttatttgggactcattcattggaatcttcctgtagcagagttgtgcatttagaggtttgagtcccatactggtttcttgccgtgctgactggtagccttcaccctgacttgaatgaaggtcttctggttggcatatggtgaggagacccctgaggtgttcaggaggtgctgcctggaggtcggtttcttcctgggtgttacgggcaagctggtcacacccattggttctctgtgaacaggttcccgtgtttaatcccaaatggaagacccccccaagcttttgctaaacttcacgggccttttataaagtcattttttaaatttcctgaaacttgctttttgaggaatataccacgggatattaaggtagacgcacggattgtttttgtttgtaaaaattctgaaatgaaactttgttttaaaaaaaggcttctttctttcatatgaccagagataggtcaggaatcattgggatcaagatttaaatgttaaaaatcgattttgttacacacgggtgtgttcatttgttttgtagccagaccagatctagatccccgaccaggaaccacacatgctatttttaaaaccgcattttaaaaggcaccttggttttccaaaggaatcagaatatggatatttgtagtgatgatctgttttctctaaaatcttaccatattgtctgtatatggttgtaaattcaatatgggaagtaaaacgttttgggccctga

SEQ ID NO: 636709 - DNA, 1562 bp, Homo sapiens
  misc_feature (413)..(413): n is a, c, g, or t
ggtgggggtggctgctgcaaaccgtgagggaacctggaaccggctggtgttccctggttgctgctgcccttctgtgccatggcctggtgacgcctgctgccagttctggagcccccctggcccatgctgtggtcctgacatcccctcttcaggggtccaccttgccctgagagttacttgccattactggcgcttgactcgacccacctatgggtgcggccctgcctgccgggtctgcctcagctaagtgccagcgcgcgatctgaaacgaccagcaacaaacaccctggtgagccctgcatatgacccccggtgcatccgcagggtgagtctttgacccccgggatcgcgcaggaaggttgtgcacaccgtgtagtatcgcatgcgtaaatgacgacaaccctctgtgtacnttagctaaacagcggcggaaccacccagtaaagttgtgaagggcagtggtcgcaaccctcatggggcggttaacaacacgtatcgaacactctgttgtagctcccccagctgcaggaattgcaacacggcgagcgaacatgctcaaaggatagcgttctctgccccgcggcgaaatagcgagacagtgaacgcgtttcgaaccccctgttggtctcaagcgcacaatttgtgtcagtgctaatcacttcttgtgtcgcattatcccccggttgtgtaaccatttggtctcacagcccgccgccaagtagactgaccaaccgatgcgcagccacaatgctcaaccgatgaccgcgctttctcacaactagagttatgaaacgtcgtcacccactcaaaaagagacgtggtgccatgcagctccagggttattaaacagacaaccacgttttgtagctttcgaccacgagaaacacctcactgtgtcgatccccacaccacgcagatcaagtgatcacgacaaacgaaaaggtgtctacatctaactgatccggtgtctcccacacacacaagacatccacatattatcactcacgccaccaaacaaaccctacatcatcactatttctaccagccatcctccggcaacccatccaacctacgttctcctatgaccaccaccagctcacaaaacttcctgtcatcacacaaccaccacactcccgtatctcttctctatccaagcccaactcatcttcgctcgaactcatatcacaccccaccatacttatcagcttactactcaccgactccccccccctacgtcgcctctcaccgtctggcggggcgcgacaactaccaaccacgaccaccgacgaccaccacgacctgtacgaaatactcacggcgattcacggcaccccactattacaaatggacgaggttcgcgacacaccaccctacattatctagctgagcagataaagattcctctctctgtgtgtgccacgacaagtagaaaaaatggtcgcgtgtcatcaccctcagctccttatcgtacaatagataccacatctgtctgatccccaatcccgcgccgcacggctagcacgctattgtgaacaatttctcgaccacgacgatcgctgttg

SEQ ID NO: 636710 - DNA, 111 bp, Homo sapiens
  misc_feature (70)..(70): n is a, c, g, or t
gtcgccccacatctccttagggctggtcatccagcatggtgttcgacaagtggctgcatctacaaccctngaaggttgttggtccctgcaagacttgggggatccgtctag

SEQ ID NO: 636711 - DNA, 805 bp, Homo sapiens
gccggggaggtcgcggcgcgtgtcactgcttgagccgagccgagccgacgccgagccgcgtccgatcgccatccggtctcgtgcactcgcgcgcgatcccggcccggcggcgcggcccggcgggccaggcggcgacacaggccatggagctcgagaacatcggtagcgaacacggtgctactcaaggcgcctgggaaggtggctggtggaaatcgctaaaggcaaagcaagaaatggtggcagatgctccagttccctccacatcagccagtgcggaagagctgcgtgctcagcggctcgagcgtgagtatcacagacctgtgcgagctggcgagccctattgggcgcctggtgtcccgaggagttctgtgccacagaatggacgtgagcatgagaccagcatgcgtctgtcacacttctctgtgatggggtggccgagtatgaagtgaccccggatgacaagcggaaggcatgtggtgcggcagacgtaacggcaagaatttattctgagccgacagcaggagtcctgaccgtctatccctgaggtaccccccggtcaagcatggtgacgaacgtgacccagcggctggagcagggtccctgtcaacacgaccttttccaggaacgtcaacccggtatgaccccagggagtacctgagcgtggccccttgttgccgaactacctcgagagcagtctactttcaacgcggtttcctgcacgggacagttggctggaaatggcagccagtgaccaaaaagagcttaggcaaatagcgggtcctgggcacacgtggtttgggaacgt

SEQ ID NO: 636712 - DNA, 1128 bp, Homo sapiens
aatagagataggtgcgacaagttggtgttaaccggccctgatttatcagtgtcctcaaataccaaattatctcgttttcactgtctaaagggggcacgtggatgcaatcaatggttatcgtgtagttctgcatgtggttactccatgtgatggtttcttattggcttgagagtacgtacaaggaaagggtatcatgtcccatgtactagcaatgcatctatgatgcttcctagcaagtgcaagaaacctgacatggcaccataatcacgtgccacagcacaatcaatccaaagttcaccgcaatcagaagctctcactctagtgctcttgctctcagtccagtataatgatcatctattagcgtagggatctagccgagtccactgcaagcttgggcacacaatcataattatcattaatagagcctgagcccaggtggctatggtgtggcctctacgccactgatagaatttccacgagaacgagcgtgtgtgggtaagggtcctataggatgtgcgctggaggaatacatgttggatccaagtgtagtattcataagaaaacaaatcgctgggagcccaggaacaaatgggtgtgatatgaattcgcgttagtaatacatatccgtaagatagattatttacacagtattgtggaaaaggtgacccaaatgagtgtgcggtggggtcacagccacctgttatgcaaggttcccaccaagaggataacgatatgtgagggaaaggggccctggatcgagcgtacgatgaatgaaaccttatggcagttttgaaaagcacccctaaggggaaagggcgccggagaaggcgcatatgtgcacgggcggggtaagccgggtacagaaatatatggccaacacaaaaacagtgattatcagtaacccaagggaccttggagggatagaaccagaggaagtgttgaattaaaacgttacgttgggttccacaaaataggaattcttttacaaaaatattttatgaatgagtcataaaaagttggagattaactatattataaacatgtagacaaaaaaatcaagtatatggtagataaacattaaattctataatcagttattaagtaaataattacatatgtgtacagaaa

SEQ ID NO: 636713 - DNA, 645 bp, Homo sapiens
caggtcgtattacataggacggctctcagttacactgtaggactgaacagccttgcatcttcacgtccgacatcacctagggccacctatgcaggactcatgcgtgagtgcatgtccatgcacgttctgcactctagtgaccaaatcgttgatgcctgtatgcagctttactgtctggaacaccagatgcatccaagactttcagatgctcagagtcactgacactgccgaagctgatgcaaagcttgacgagatgttcactgggacattcacagacaatgacgtgccgtatcaagagtacctggaccggcatcctgaggctactgctgaagttgcggactgcaatataccgacatgtcttacaccactggcacattagcacaggcatgcaagacactgacagatctatgcccgaggccactgcagcattggcacgggtgtcattggcctcaatcagtgccatgtacgaacgttgggcgacaagtagcacgaacatacacgactacttggacttatcacaagtatgatggacattacgggtacaagcagcagccttccttacgattactacgtgtttgaaatgatgatggctagtaagtacaagcatgttactctgttaaccatcgcgatgcataactgactgta

SEQ ID NO: 636714 - DNA, 427 bp, Homo sapiens
gaagaaagacatttgcaattttaattgcattgtcagaaaaagcattcctgagagacagtggtctgtttctgcctggttacaccaagggaatattttcaggtgagtgccaatgtgatgttcacacgtctttggaatctccctttgcaataaaaataaagcagaagtctgtttcagagcattttgcaattagcagagtctaactcaaacttaatacaactcttttgttgatcttgtcctcattgtatggtcctgttctatttatgcaagtgatacttgtctgccatttgaattcatgacctaaagattcttctagtaagtaaatgtatttcagtaaaaaatacaagtggatttaaagaaaaatagtaagtaaataataatacagatgttgggacacacaggaaaacgctcataaaggtggtatctcaat

SEQ ID NO: 636715 - DNA, 107 bp, Homo sapiens
gaggcatgtgttattgcagtaaaagatagcctcttagaacagacctctgggccgggtgtggtgttgctcacgcctgtaatctcagcactttgggaggccgaggcggg

SEQ ID NO: 636716 - DNA, 943 bp, Homo sapiens
gaaggatcccaaggcccaactcgttatctactctaccatctttgctagcacactcatcatagtgctcaagctcggactgatctctcatctgaagtaggcctaaaattaaaccatgctagccgttttattccagtttctaaccatcaaaataaacccttcgttacctacatgaaagacttgtccatcgacgttatcgtcctcacgcaaacgctaatgcagcatacattgatccgtttcttaatacgctatttcttctttcaaaccacatatcactctccgggacatttgtaacccattaaacagatagtagcaatcgaatcactctatctttcacttctcatcatgggctatagcaatgagaaactgaagagaataaggacctctttcgcttctgagtcccaaagcgttacccaacggaacctcctctgacattcgtgtcttgatacttctcgacgatgagaaaaactaggcccgcatgctcaatcgatgatatcaaatctgcatccgatcactaacaatgtagatgctcttcatctctcattctctcgaatgttatgccatcatagacgaggcagccgaggtggattataaccaaagcacaggctaatgccgagatcgtttgacattactcctcaatttacccagcatacggagtgacagttaaggatgcagttactagccgtatgaatcccgtaaactttgtgcatggcttaactattagatatttgatatatatgcctaaagtaacttaacgcattctctactactcaagctttaaaggtgccagcatcaagaccatatactatctcgtacctgaaataaggtaacatgataaaccttattcatccacctctctccctaggaggcctgcccccgtaaccggtttttgccaatgggcattatcgggagattccccagacataggttatcccaccatttagca

SEQ ID NO: 636717 - DNA, 221 bp, Homo sapiens
gttgggggaaaaatttttttgacaagcccccctggggagccagtaaaaataaaagttaaccctggggtaaatttcccaaaaccggggggggaattcccggggtcccaaagcaagggaaggaatgtgggggttcccttccccttttaaaaaagtggccccaaaacacccccttaagttttttgattggccccatccctcaaaaaaaaaaaattgggccccca

SEQ ID NO: 636718 - DNA, 135 bp, Homo sapiens
cggcttactgtcttacgtcttatatcggaattccgttaaccactgcgccacgacgggaactccgcagctgcatcttagattcagctctcctgcgtcctggtaaatttccacgtgtctgtggcgcgcacgcacact

SEQ ID NO: 636719 - DNA, 789 bp, Homo sapiens
agcgtggcctctgcgtggtgcggctgggaatcctgcggacatcgggtcgggtctagtgctcccgagtcctgcgctcctgtggctgggagcccttgttctgggtctcgctggggggctgccagatgctgtagtgccacactgactatgttccttcttgtctgcttttcccatgcaagatggctgtgatgactgcctgtgtgcatgctggtgggtgtgccctgtgtgggccccttggtgagccccgtgggactgggagaacctgctgtgttggcattcctgcagtgagggtttcggtgcatgtggtgcatcgcggtgaggcccgggtgggtcggcatgtgcctggttgtgaactgtgggtgccctgtgggggcccgtgacgggcctggtggggaggcttcctgcggtgcaggtgccaaatgtgccctggcatgtgggataagctgggaacgttggggatttcgcacccggtcaacccaaaaggatatggaggcgccaccgccgatgtggggggtacagaggggtgacccacttagacgaagatttcaacaggggtttcccccgttggtgccgaggcggcaagggaaaattcacttaaaatccccttccgatattacttccaccgctgtgggccccataactttgaagaggaggcaacatttcgatcgcgaacgacaattccaaatgctggaaaatgtgacgctttaccccgttggtggcgatggaccccccaatcgatccgtcgagagagggggtgaaatcgaccacgggtattaatggggacacacgact

SEQ ID NO: 636720 - DNA, 977 bp, Homo sapiens
ggaagatcgaggaagacagtgaggtgctgatggtgagaaacatttcccccacccaacaaaatatccccaatccctgacccctttagcccttacccctcttctgagaaactgaactcaatcccactccttgattcaaccatgtttatctttgtcccttagatgattaaaacccaaagttccttggtcccagctttgacagattttgttcggtgagaactttgacatggatggcggtgagggtgtgtactgtgtggctgtgacttgctgggcagtctacgggcttgcgtgtaagcggagtgggttctttatgggtaaatctttgcagtgatccccattcccaccacaccactctataatatgctacgttactgctgacactcctctactgacagtggaccgagcgctaatctgcacttgcctgtggaacaggggaactttccgtacctgcagtagggtgcgccaggatcacagagtcagttctgactctatcacagtcctgaccatgatgagccctgttcctgctacatcatgaagatcccccgcgactactctccccgcctcactgactaccacgtgcatgactcgacacacactaataaatccccgtcttctgcactcaaaaacaacacaacaacacacacctccacccaccacaacactacactccaaacacaccacaatagtctatcaaatactctacctcacatcccacccactcaatccaccattttgctctcctactccttcacgcacagacaacagcacacaactatcacacgcatcaaacactaaacccatcacactaccaacaattaaccactacaacaaaccaaacgaagtcatttaacaacacaattatacatatatataaatcaacatacacaactataaacctacaacctacacatacaactacacactaaaaactaccaaagccatataccacaaaaacataaaataatataatcttctatttt

SEQ ID NO: 636721 - DNA, 301 bp, Homo sapiens
tgcgccagtagccactactaccaatcattactcatcattaataactcatgactgtgctatagctaatataacttggaaatagctccctttcacttctgagttcccataggttacccatggcacccctcttacatccggcctgcttcttctcacatgacaaaaactagcccccatctctctcatataccacatctctccctcacgaaacgtaagccttctccgtgcactctctcaatcttatcctagtcatagcacgcagttgatggtggattaataccaaatcgcgcgacaggcccgttgt

SEQ ID NO: 636722 - DNA, 233 bp, Homo sapiens
ccttgtgggcgctccccctgcccccggagccttttgggagtggggccacccgtggacaacttaggttggggtcaatgcctcctgggcacccttgcctcgccccagaccggcccgtccagtccccatcccccctcgggggcctttattttttttgttcccccagctcggccccttttttgaaggagggctgggttttgggcctgtttcgaataaacccaaacctggatggcgca

SEQ ID NO: 636723 - DNA, 206 bp, Homo sapiens
ctctgctggagactaaagccaacttctctttgcctgaaaaatgcgactatatgataggtgacactatggggagctggagaaggaggcagctcagtccattgtcactaagtacaaggaggaggtcaggaagcttctgcccccctccgataagcggacatatcgccgaaacaaccgggtccctcggccatctggacgggctaccgagc

SEQ ID NO: 636724 - DNA, 1065 bp, Homo sapiens
gacgtcagtgccggccactacgtcgaaattgaaccgcctagatagtgttcaattgacacatctcggtctagtcgacccgtcctgcatccactagtttcgatacctagtcatcacgaccatgactagaagagctgacgtattccatcttgcgtatggctgctcgctgcctgaatcctcctagattagccacgatggaaggtatacgcgtatgccatgctaccactcagccagtaatcctgtcagacgctctgtttgatcgattcgcccaataattcattggcgaaaccacgataataaatatgcgtcgtgaagatcagtcgcgcgtagcattgaccgtccatattaggcgggcctgcaagtagtggcttcatctgtcgctcttcctaacagcattcggggcggagtgtgctactaattacgggagtcaattattttcctactcagattacctgcaatacaattgggtgataactccgtcacatgcttgagaacatatagactaagaggccttcattatggctatggtccttctctcgtgtaggcctagaagtactcgagttcctgaggtggagccacgaggctttgttactagaagcgttagcttagtccgccatgctcgatacattggggatgagatgcttaggtacaagtgacaatctgatggcatggctaatcaggatagaatccatgtcccatcgcttcatgacgagttacctttagcctttgcactttcagtctttgcccttcattattgctagtccgctacctagtgactgcgaatcgtgcctattttctttgcacgaaaacgggatcaaaacaacccccctaggaatcaccctcccattccgataaatcacttcagccttactacaccaatcaaagacgcccttcgggtttaacttctctttcttctttcgttaatgacaattagcactattttcaaccagagctcttagggaaccaagaaaattatacctaatccaaaccttaaaacccttcccaattaagccggatatatttcctaatggcttaaaaatttcgatcggcccaaaaaaagagggtctg

SEQ ID NO: 636725 - DNA, 324 bp, Homo sapiens
tcgtggcctcaggtgatccgcccaactcggcctcccagtgctgggattacaggcgggagccaccgcgcccagccctagtttgaagcttatgctaatcatctattgctagcagattatttcaatccttagtcacagtccttgagtagaatgttcctgtgtaacacaactcctcctcctttctccagatccaggattcattcgttatttattcagcaaattgactgccttccatactcaaggcactgtttagggaagtatagtgttgaactgcagtcctcaccctcaaccatagaccttacattctagaagtggtgagcatgtgca

SEQ ID NO: 636726 - DNA, 483 bp, Homo sapiens
  misc_feature (25)..(25): n is a, c, g, or t
agttcgacggagactctccaccctncacaaagctcagtgtctactgttcccttctttgtgtccatgtgtactcaatgtttaggtcccacctctaagtgagaacatgcagtatttggtttcctgttcctgcattagttcacttaagataatggcccccagctccttccatgttgctgcaaagaacatgatcttgttcttttttatggatgcacagtattccacgatgtatatgtgccaccttttctttatctggtgtattgatgatgggcatttaggttgattccgtgtctttgctattgtgagtagtgctgcaatgaacatatgagtgcgtgtgtctttatggtagaacaatttattttcctttgggtattggtatggtttggctgtgtctccacccaaatctcatcttgaattgtagctctcataatccccatgtatcatgggaggaacccagtgaaaggtaattgaatcatggggattatg

SEQ ID NO: 636727 - DNA, 700 bp, Homo sapiens
agcgggcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgtccacggcgcagcacggccggaggacggtcgggcccggcgccgacctccacctcgtgccgccgctaatggcgaacggtcgggagagcgcaggtcctctgctccattcctgaaggtgatgcctgggacacgtcgtggaatctgtgtggttgaggcttccaaagcttcctgggacaggacgacactgccaagtactttggtttgctgtccatgcccagtgatgattactacgttgtgtggtgtgtaacgagctgtacatcacggttgtcaaatccgcaggacatttcagatcacattatgaagagaagacatagctcatccatgcaagccgcctttggccgttcctcccacttgcagtattatccttgcttgcccttctctgtccaaaagcaaaggaggcagtgcaagtggaagcaaccgttcgttccagtggaggtgttcttgagcgcatcctcgatcaagttccaagtcgtgtgaaatcacccaaagagagactgcagctcagggggaacaccaggccaatgcatcccattcagcaaagtagagttcc

SEQ ID NO: 636728 - DNA, 248 bp, Homo sapiens
gtattatctgcttctagtgagttcaactcttcatagaagttggcgattccacgtgtgagatcacgtgatcgtctttctgttcctggcttattttacttttcgtaatgtccttcagtacatcccatttctcgcaaatgacaggaattccttctttttttttttggagatggagttccacttctgggtggcccaggcgtgaagtgtcaacacgtttgaccctttcagcaatgactgagttggtttggatt

SEQ ID NO: 636729 - DNA, 1100 bp, Homo sapiens
  misc_feature (1023)..(1023): n is a, c, g, or t
ggtccaggaactctagtgctttgcatagcccagggtcccaggaagacatgtcatagcaggctgtcttgatatagagcaaactagaagaaccagcacagtcattccactgtcctggcttaggttacttcctccactgactccccttgcccaactgaatggtggtatgaggtctagctctttgcctagatagcatgcccatgtttctggtttctgatgttgactcaagaatataggaaaccagatgctcacgtatcgatgactaagcctgctgcaaaatctggagagaagcgtttcgtcgagagtagggttatgttcataggcagttcttcttaatgtgcgcaatcgatgagacataacaaagccggtgcctgtagtgctggctcgccggccgtgtaaagcccaagatagctatttgggtgatggtcgaaggctgagcgcatgcgagtgactaacgcgtcgggtgacgtttcggtggagcctagacgcgtgcgtacaaacattgcttgacgaaacgcattaagccgtctaactgagaaatacacaaaaattatgcatgggtcattggtgggcacattgacctgatggtcccagatgctatggggaggctgaggcatgagaatcgctttgtgagccccgaggaaggatggaccgttgcaagttgttgcccgagactagtgcctagttggcacttcgatccacttcgagtagacctgcagcaagggttccctgccttctaataagttgaacgcatgttataaccatcgtaaattacagagagggctggggcaatacggagacaaccggacgtttttaattgcaccctcggtaactttgtggctgtcttggagggggaaggcatcaataccacgggtatgggttgacgtaaaatttgaccaattagcttagggccttgtgttaacgactgagttttaatacccgccgtcttgcttgacataaggaacctggaaaagccgggctacgggacatgggattgtcacttgcgccccaggaaacacccgcgtntagacgaggcgaagaggctgagagctactgggacagatccctctggaacacggtgcgaagtgcaggacactcatggg

SEQ ID NO: 636730 - DNA, 902 bp, Homo sapiens
tgaggtaggaggttgatccccatgtgtataagttaatatgtgataactatgaatctgtacaaaaacaaaaatgaaaaaaaaaaaagaaaagcaaaaatacagtttttatttggaaatacattggttctctggagaaggtactttatctttttttcctccagtcttttacagatatttaaaagcatttaaatggatgacaagcatttacttaaatctttcaggtggctactgggatttggcattagtggtggtatggttggtgaaatcctaactttggacataaaaggttttataagtattcccctgcctgggaaaattagtttttggtgctcctctctctctctttctcttttccactttctttctggcagactaaaacatgctcacgaagtggcatctctccttgtctctatagaagatctccagcaccatcatagattgatgtctcgcgtgtcaatggaactgtgggaagcagttagaggaaaagctcactttttttttcaggtggcaaataaagggacccctcaaaattagccaaaccaccactacctttaaaaactagtttatgtgcctgttaaaattaatgtgttctttaacatgtgggctacagctccagtgtgtttatttaactggagcatatacactgcggcattaatctccttggggcctgaattgtggcagactgaatgggaggaggtcgggaaagtctgtgagtgcgacggatcttacttgggggttaacactgctttttgatcacgttttggactctgaatccggggtaagcaaatgattaacgaattggccaaagtagaggggaaattcacattcaactgcgaaaagggagcgcgaaacctcaaaaagcagagggtgcccggagggtctctgagcaatcgaaagagaaa

SEQ ID NO: 636731 - DNA, 198 bp, Homo sapiens
tattaccggcgggggtataggaggacactgcgtcccggacgtacgtaggagcgcatactgactgggcgagtatggtcgtccgttctcatctcgcagccgccctaacacctcctggctacatgctctggaccttctgcttcatctgtcagcagagtagcgcacggaactccacatttctcccgacaccagccgggtctt

SEQ ID NO: 636732 - DNA, 920 bp, Homo sapiens
  misc_feature (920)..(920): n is a, c, g, or t
gcagcatttcccagcacacatacacacacaccaccacacccacttaatttttgtatttttagtagagacggggttcaccatgtggccaggctggtctgaactcctaacttcaggtgatctgcctgcctggctcccaaaagtgctgggattacaggcgtgggccattgcccaggtcccaaagttcttttattagatcaaataacacggatttgctaggagtagtggctcataccatttgaggactgggagtttgagaccaacttggctaaacgtggtgaaaccccttcggtgctaaaagtgcagaaaagttagctgggtgtggtggcacggcacctgtggttcccaagcacctcaggaagctgaggcacaaggattggcttgaaccccgaagaggtggaaggtatgtcagttgagcttgagatgcaccatgcagtccatgcacaccactctgtcgctgggcgaacaggcaaaggattctcacaacaataatataataaatgaagaataaaagcctgtgctacatacaaatatgacagggttagagaaaccctgtgtctttcctaaagtgcagtctcactttacctcaatataggtagttacgccggaatggggcccggcgtgggccaccaggccggtatcccagcactagggaaggcgaagggggcgggacacaggcacagaggtcgaagacagccaggccacatgggaaacccggtcgacaaacaaaactcagaaagaaaccatctggggcgccagccacagcgacaaacagcacgcacgcgcaagagacgagacaaaacgcgaagacgcgagagcgaccacaacaacgcggaggcgcacccgaagggatactgcgacagaaaaccccagaaagaagcaagtaaaacgaaaagggcacacgacgacctcgacggtgcctn

SEQ ID NO: 636733 - DNA, 167 bp, Homo sapiens
cagtgcgttctagccgagccaggagctatgctcgagctcgaccaaaggaactgcgaagcttcctccgaagttgccacactccatctcgatggcacggtcaaagctggcaccgccaccgacagccatggccaggcccatgcgctcaatgccagcgcccagtggccggg

SEQ ID NO: 636734 - DNA, 268 bp, Homo sapiens
  misc_feature (121)..(121): n is a, c, g, or t
agaccatgcaccgtatgattcctttcacgtgaaatttccagaacagggaaatgcagagcgacagaaagcaggttagaggttccaggggctgggggttgggggaatggggagagactacttnacaggcagagacttgtttttggggtggtgaaaatgttctaaactgactatggctgcacaactctgtgaacacactaaaaacactggcttggacaacctaaatggtcggatgctgacttaggtctcaataaagctaaaaaataaggtg

SEQ ID NO: 636735 - DNA, 306 bp, Homo sapiens
  misc_feature (5)..(5): n is a, c, g, or t
  misc_feature (50)..(50): n is a, c, g, or t
  misc_feature (92)..(92): n is a, c, g, or t
  misc_feature (119)..(119): n is a, c, g, or t
  misc_feature (184)..(184): n is a, c, g, or t
  misc_feature (296)..(296): n is a, c, g, or t
tagtntgccagtgcccatggatctcgtcctcactgccagccctcccaccntccccagattcaagtgattccttgtgcccttagccctccctnagtagttgggacctaccaggtgtgcgnccacccacacccggcctaagttctgtacttttagtaaagatggggttttgcccatgttaggcagnctggtctggaacttctgaccctcaagtgcttcacccacctcagcctcttaaagtgctgggattacaggtgtgagccactgctcctggcctacgaatgactgttttaatgctnctgtcaataa

SEQ ID NO: 636736 - DNA, 947 bp, Homo sapiens
tgaaactttaaaatccctcaaaaactgtttattatacaagtgatgttttggagtcacgatggggcttatcggtaaggatttctgggtaagcgagcgcgggcaccagggcctaccaaatctttttgggactcgcagcgacaaggtgtcagctaccagcagggtcccggtcataactgggatagaggatggtacttggatactccttactgggaacgcctcatccactattattacctgggtaataggcccaccagggcttcgggaaaatgggactgacggatagctataaatctggggccactgtgaccaccaccctttacacgggacccggtattgtctacaccagcaatatcgctctcttgccagaaaagcaaaattgggctcaccagacagtcttgtaactgtcgtaagccgtgagcagcggactacaaatactattctcacacaggggagcccgccccgtataacaccctttgtattagagagacccaatatggccggcagtatatggcatgtgtgggccccaaaaagatagtgtacggcatttgatcatcaactattagcgagatcacgaggaaaaaactcttgcaccaaagaatctgtgcacacgcggagggcccccttttgagaacagggaaattatgggcttccccagaagccttgttggccactataaaaaaagaacccttacaaccggggatacccaaaggggccagtagagacgttgggatccataccgcccagaaaagtagagcaaggaagaagcgccataccagggacaaggggataccaccaacgggaaagtgaacccgaaggtgggagaacaacaaggagggcacccagagggggtgtgacaaagaaaaccccgcaaaaaacataaaagcgccatgtggggacacgttggagaccacccagataaatgtggccagatcaagggaaccattccc

SEQ ID NO: 636737 - DNA, 170 bp, Homo sapiens
accaagacctggttggcagaagcaggaagcaggctgaggcaggagaatcacttgaacctggcagaagcaggaagcaggtctgggaggggcagaagcaggaagcagaagaaggggaagaaaagaaggggaagaagatcaaaacccaccatgccccaggcagaagcaggaag

SEQ ID NO: 636738 - DNA, 1085 bp, Homo sapiens
ggtgccgggcttccggccggagccggcactgcacaacccgctccgactttcaatgttccaactccccgggcagagcctcctcggcttctttttttccctcactgaaattaaccaatagaattgaaaaaagggaatatgatcagatacaagcggacacgaccattaataagaactcttacgatcgacagcactgaccagaaaagaatgtaaagatgagatacagacaatgaaaaccaatcaagaacatcatcagaagcgcaaaaacagcaaaacagccatcagcataaagcaacagagagaacaacggagacaaaaggactcagacaatgtatagaaagcacaaagagactgcaacgcaaaagatagactacagaaaaagcactatggagtgaccaaatatacagaaatgacgatacatataaccaacaacaaacatcgtagcgcaacaatctacagcaaagcagtactcatacacgaacataaataaggccccagcacgggcgaactaaagtagccataacacacagatacgagagcgcacaagttacagagagaacacaacatcatcagtagagaacataacagcaaactaacaccagcgagcgacaacacaccagcagagaaaatcacgcaaaactgtcaacacagttaacgccgatgcatgcagtagtagacctaacacactcaagagcaacacgcaacgtcacactaccacagatcacacagcacatgtaacaatgtgtagtgggagcaacgatagtccacaagtctactaaggagaaacagccgaccgactacacactcaggaaatgcaagatgataccacagtcagtatgaggctatgacagtggtattacagcagtcgacagatacacacaagacatcaagacttacgaccatctcaccatagaacaacaaataatagtcacatactcgtaggtacttacatgtactacactgattggagaaacataagcagactgaaaagacggcacaaaaattacacgctgaaggagtaacaacaaagacaccaaagggatgaacgatcaaggcacacagcacacagcctgtggatcataacagga

SEQ ID NO: 636739 - DNA, 226 bp, Homo sapiens
tctgagaagtaatgacgatgattgaactgcacaatcagaaatacagggaagggaaacacagacttcacaatggccatgaacgcctttggagacatggtaggtgtgctgtggactgccgagctctgtgcttcctactcttcggttctttactaaaggtaatctacttgctatttcatcattttactttcctttatccttgaatgaccatgtgaatgaattcatggca

SEQ ID NO: 636740 - DNA, 1500 bp, Homo sapiens
acgcgttaatcagatgtagtggtctcaagattgagtcctggacactattaaccaggggttggatatatgttattatacactattgaaagtagtcgaggggtccagtgcatgctggggctatcgagggaacgcaccaattcgtctgcgaaaacagttttaacatacatatttacgtcgcaggacagtggctggtgcaccgtgtcggatcgtcagacgcgtccctgagctggtcagtgggattgcacgagggcctgctcgatccaggacgcgcgacctgtaatcatgccgtatattattcagttgagagaacggggagagtcctttcgtcgcgatagttatcgagcgcaggaccctagttcttctaggaaatctcacttgaagcatacgaagtgtggctctcgaccatagtcgtctgagacatttaccctgaaaaggtagctaggggaatgacggctgagttggagccggactagcgaccctgtggtttggcactgcgcgcagataagctctgttccagagggtaggactggcacgagcgtcgaatacacccggtggcaacctgtggggggctcctcaacgttatgcaaaatcaagggcgaaataccatatggattcgcacttcggcctagcctcgcgtacaaaagcccgtggccaagagggtaccctcctatgccatggaattgttgtacccctagggcttgtcgacattgcccaagtgggctttggtgcacacatcttaagggtggcactacgcaaattgtcttatgatggcacaattctttcacgaaagtgtgaggtggttccccgtgtatggcctatgaggcacgccaagggctggtatggagccgcgatatttaccaaggcctacgtggagccggagacggcgccaatgtgccccatggataccagcgctttctggacggcacgggggcgcaggcaaacaatgagggactcctaaggttgacgcaaagggcgagtgtaccaacctcccccgtatccaaagctaaggttgcccaagggttaactattacaaccttcgtgtggcgcaaaccgcgggctatccagaggctagcaatcctcacaccgaatagctgcggacgacaacgcgcgcgtcgaaggccatggcacagtagaatgcgcgtcgcgccaatgaggagtacacccaccaacgtatggtggcggcgcacgtgggaaaccccccatgggggagctagccgacgctcaacgaagctactcccaatacggcagagagagaacacacccggtgtgggaacgctaaaacgagacgcccgggggttacgcaagatagatccaaacccgccacaataggtagagggcgtgcatcggcacaaacgcggagagccatagtgggtagaggagcatggaagtgacggctaccacaagtaagacgtgcgggagcgacaacaccacaacgtggagggggacaccacgggagtcaaccgcgactacacaagcggatgtgggagtatataagcggag

SEQ ID NO: 636741 - DNA, 1059 bp, Homo sapiens
  misc_feature (140)..(140): n is a, c, g, or t
  misc_feature (476)..(476): n is a, c, g, or t
agcggagctgagcttgctggtagtgcccgctggtgcttgggctcactgatgggtgtgctcgttgatggtggactccggcggagattcatctcccagagtgtgtacccgtccttatcagtctgcctcgccgtctgcagtcnaggatgtcattggccgtggcccggcctatctggctatccgaccctggagcgaccagaactattcggtgcggtcgaggggtcgtttccattgcgattggtcaaggttgcgagatcgatcagccgaacggaccaaggagctagtcagggaccgagcaccgccgagtcgtacgtggtcccttcgacggagcgagccagatgcgcgcatcactcggggcgaacgcgcgggcaaggaagccgatggtgggcaactgaacgcgcggatccaaacagcaattcatatcgatcggccaaagtaggcgtgagttggacgggaaatttcgaggtaatgccaacagntgctggtctcgtgagtgatgataaacatatggagcggtggcggtggatggatgagctgaggggatgggcaaggccactaaaggtgtgagaagtaagcaagtaactggaggggtgagatcgctagagtaggcatattttggccatgaagaagaatatgggtcccatgtgttacctcaggaaagtatgaatggagatcgtcggaaaggccgtaaccatgcggggggggtcgaacgtgttcgccacacggagcccgtgtcaatgaaaccgggttccccggacactatttgtgaaactcgatttcgggagtcgccagagggtccactcaaagggaatagcagggggtagaaacaatcgattgggggagacttcggattgatggtggttgatggcaatttattcaaaagaggggcacaattggcgtggcgtgacaatcggcctaaagggccgtggaacaaagaaatgggggtagttgccggggcagtgcgaagaacaaaaaggtgtatcaattcgtttatggaccttggtggggtgttggaaacctctggagagctggtccaagttctgtaaagcagttgagagaatt

SEQ ID NO: 636742 - DNA, 188 bp, Homo sapiens
cacgcgcctttagtaccacgtacttaggaggctgaggtgtgaggattgcttgagctggggaggtcgaggctgcagtgagccgtgattgcatcactgcactccagcctgggcgacagagtatgaccctgtctcataagaagagattgcaacctaaatttcccaccacttgaggggcctctacttgtata

SEQ ID NO: 636743 - DNA, 425 bp, Homo sapiens
  misc_feature (86)..(86): n is a, c, g, or t
tacggttgggaaatttaattcctttcagattgtgcctcattttagcccaacctatatttccatatttaaaacctaattatagcatncctgtggtgtatcagttacccttttgcctgccttaagaactgtcctgaggcccagtgtggtggttcacgcctctaatccccagcattttgggaggtcgaggcaggcagatcacctgaggcccaggaattcaagaccagcctgaccaacatggagaaaccttgtctctactaaaaatacaaaaaattagccaggcgtagtggcacatgcctataatctcaggtgtttgggaggctgaggcaggagaatcacttgaacccaggaggcagaggttgcggtgagccaagatcgcaccattacactccaacctgggcaacaagagcaaaactccgcgcccaccc

SEQ ID NO: 636744 - DNA, 191 bp, Homo sapiens
cacctaaaaaaggcacacaccaagacacatgctcgtgacttttataatcccagtgaaactgctacttggataaaacttcccatgcactgatagtagggatgctcttgcaagttaaatatatgcaaagatttaactccttttactttttctctttttttttttatggaaacgaacccttattctgtgttcaa

SEQ ID NO: 636745 - DNA, 802 bp, Homo sapiens
acagagcctcgcctttgccgatccgccgccgtccacaccgcgccgtcagctcaccactggatgatgatatcgccgcgctcgtcgtcgagacggctccggcatgtgccaggcccggttcgcgggcgacgatgccccccgggcgtcttcccctccatcggtggggcgccccaggcgaccacggcgtgagtgtgtgggcatggcgtcagaaggattccgtatgtgggcgacgaggcccagagcaagagaggcatcctcaccctgaagtaccccatcgagcacggatcgtcaccaactgggacgacatggcagaaaatctggaccaaccttctacaatgagctgcgtgtggctccgaggagcaccccgtgctgttgaccgaggccccctgaaccccagggcaacgcgagaagatgacccagatcatgtttggaccttcaacaccccagcatgtacgttgctaatccaggctgtgctatccctgtacgcctcttggccgtaccactggcatcgtgatggaactccggtgacggggtcccccacgatgtgccatctacgaggggtatgccctccccccaatgccatccgtgcggtcgggggacccgggcttggccgggaccttgactagactacttcattgaagaatcctcacggagcgcgggttcacaggtttcagcaccaaaggccgagcggaaatccgtgcgtgcctacaggggacacttgggctaaggttgcctggcttcgagcaagaatgggcccggggcgtccggcccccctgggaagaaaccaacaggcctaggcggctcc

SEQ ID NO: 636746 - DNA, 142 bp, Homo sapiens
taggcagatcacctgagctcaggactttgagaccagtccgggcaacgtggtgaaaactcatctctaacaaaaatatcaaacttagctgggtatagtggtatgtgcctgtagtcccagctacacaagaagtggaggcaggaga

SEQ ID NO: 636747 - DNA, 333 bp, Homo sapiens
  misc_feature (52)..(52): n is a, c, g, or t
tggatgagtctagggtgggggtgatggctgcttgctgtagtcttgcaggcancagatggatgtttctcgcctgagagctgtgggtaggtgtactttattcttcttcttttttatttttttttgagacggagtctcgctctgtcgcccaggctggagtgcagtggcgtgacctctgttcactgcaacctccgcctcctgggttcacgccattctcctgcttcagcctcccgaggagcggggactgcgggtgcccgccaccacgcccggctaatttttgtatttttagtggagacgggatttcgccacgttggccaggatggtctcgatctcctg

SEQ ID NO: 636748 - DNA, 343 bp, Homo sapiens
tgtgattacaatgagaaataatggcttgaaaatggagtcttggggaataacctttatagggttatactggggaagtggagcccacaaagacaaatgaaaaagaatggtcagaaaagtatgggtggaaggtagaggggagaccagaactttgtatcacagaagctgagtaagtagaaagtatcagatacaaacaagtctaggaaaagaatcacttatgatatctatatgtgacttgacattggggaagttatactgatgaccttatcagggatagtatagtgaactagtaaaaaatgaaaactagatgcagtggtttgagaaatgagatgtgagatagtggcaa

SEQ ID NO: 636749 - DNA, 691 bp, Homo sapiens
  misc_feature (235)..(235): n is a, c, g, or t
  misc_feature (241)..(241): n is a, c, g, or t
caccagggtgtgttttcccccccacattgcccacccgtccacgtggggggggaaataccagcgccccccccccccctctcgtttaatagggacccaccggcgtgcagtagatgatttcgccgggcggagagaatatatgtccgagagaccacccacgtcatggtataccattgttcgcccacacacacacagatgagacattcttctagcaggggcgcgacaccttgttataaanagaggnggtgtcttctaccctccctcgcacagcagacataccttcccacaaatggggggggcttccatatgatgttagtgaccccccgcacatgtgcaacataagagaagaaaggacacacgcgcgagtgtgtgtgataaatatgaacgcacatatccgggcagtagaatatatatgttgcctgtgtaaagaaaatatgtgtgcgaacatattcgtggtaaatatacggcgcagcaccatcggtcgtataacaccaccaccttcttatatgtgttccccatgaacgtttttatatagaggaacggttccagcacccggcgtatttgaatttttttttcaaaaggcgcgtgttcagagagagatagagaggatgatgtctgctctcatctataaagatatgatgtgtcatgatggaccggctcgtgctgtgatgactgtgtgctactaacaaatacc

SEQ ID NO: 636750 - DNA, 378 bp, Homo sapiens
acagtcactttcaaacacactgtgacactgtgaatttgttaacactgaggtgattaaacctaaagtgcacgaagacttagttaactatgtctactattaaaaatactcgggaaaattctgatgaaaaaggacattcagcaattagttctcacgataaaattactttttggccgggcgcggttgctcacgcctgtaatcccagtactttgggaggccaatgtgagcggatcacctgaggtcgggagtttgagaccagcctgaccgacatggagataccctgtctctactaaaaatataaaattggccaggcatggtggtacatacttgtaatcccagctactcgggaggctgagacaggataatcgcttgaacccggga

SEQ ID NO: 636751 - DNA, 215 bp, Homo sapiens
ctcagctggtaactctgctgttgtccggaggttcaggcttgggtgtgccttcctcctggtttgtctgacttttgggctccaatgggtcaatctcctgccctgcccaccacaaggaaaagggatgctgctgaccaagtgctccaaatgacccaagcatgaaggccagcgcggacgcttttaaatgtgttagtggcttaggtaactgtgtgttaact

SEQ ID NO: 636752 - DNA, 362 bp, Homo sapiens
catctgcgctggctcgggtgggtcaggtcgggcgcggaggagacggggaggctggataggtggcaggcctgatcatggaactcttctaatgcaagtggtacttttgccagtaacgggcctttttaaaagactaactgtgtcaagataaccccttcgcacaacgggttctgttctcctgtgagcatctcctctgcctggcagttctcctaggggcaagggacaccgaaccagatggccaggacgttaacaagggaagaatctcggttccgcgttctcactgaggaacagtgcaaagactgtggaaggcacggtctgggaaactgtcgtccttccgtaggatctgttcatctacagctgacgag

SEQ ID NO: 636753 - DNA, 1457 bp, Homo sapiens
ggagagaactagtctcgagtttttttgttggtttttttttttggcaaaccccaccgccgaggaaaaccggtgttactatttagccatgtggttcaaccccaccggtgtttcttcgactttgccgctcgacggcaacgccctttgggccgcgttctcctttgtgagccgtgttgtgcaaacaggtgtcctcaaggacgcgccacgaaacaattttccggtgcctcgtgagccccgtgggagaagaacagaggtattgggctctcataggggcgtctccgtgcttctctcacgagacaatttatctcccagggtttaagtgtgtgtctcaggggtgggtgactttcacaacgcccatataacgtggccctgtggcgtggcaaggtctccactctctatgtgggagaagaaatttgtgaacaatcgtgaacacactttcatctcctataaagccatatacggggctcccgtggcatctcttgtgctccatgtggccacaatgtgcgtggcccccaaacccaccaaagtgtgggtctctcccccaccctctcttcacccctcgtgcccacctgtgccccacagaaaccgtgggagtgtgccgctccgcccatgtgtgcccacccgccccgtgtttgccgcgtgtcttgcggccccacaccgtctcgcaacacgacgcggcgcctctgcaccctatctgcgggtggcggacccgcccatgcttgcaccagccgccctctgcgcgggcctccccacggacaactgtcgcgcccacaacacccgcacgcccacgacaccacacccatcttccccccaagctgcgcccggcgcatcctggcgtcgcgcaccacaccctccgcaacaaaaacgctttcgggaaccctgtggcggtaccaccaactctcataaaccccacccccacgaccttgccttccccctctcgtgtagtagcccctccagcggcagcaacgacacccgccgctgctcgcgacccccccaactttatcgtactctcgccacggcactcctcccgtcccggacacttctttgcggcggcccaccctacgcgcctgtgcgaggctttcccccttttggggggatcccacgaggtatgtatccctttgctgcccccctccccccctctgcccatcagcccgcggatttggcccacacctcaaccttccacaccaacttcactccacatctccccacccctaccccctctccccaaccacacccgatccccccacgcagtccaacaacaacaccacgcgcgacacctcattcaatgcggcaccacgcccaaccaaccggctctcaccacaacgccccctccgcacccaacccgtctccccaccccccacctctctgtgtaccaccggcgctcaacttccgcgcggcccccacaagagaccaccaacacatctcacacccgcgatcacgcatctacacgcccccccgcg

SEQ ID NO: 636754 - DNA, 323 bp, Homo sapiens
gtttcctcaccttttttcccctttccaggcgggccatgatcccccccccatgtgttttaaaaaggcagtagcctttgcagggacctgtctgtcccaactgtttgaacagtgtgctccccagattttgtgttcaaaaggatttgctgcattgagccttgaaccctttggataggggaaaaaattatatatatatatatttttttgttcggttggcattttttaatttgggcttggaatgggttgatgggcccagctaatgattcaatgcgagccaagattggggtttgtgttgtgggggtttcaaataaagagccctcttctta

SEQ ID NO: 636755 - DNA, 290 bp, Homo sapiens
agtcgatctgtctatgacccagtacacaggagcaagtgtttcacatcatagacttcacttccaactccttggaaatgtacatttctttggacttacagcgagacgactaggcaggcaaggccaggcacatgctataggcaactacaaatgcaggttgggaggtaatgctaactgtcaccctacacagggcatggccacggggcactgttattccgcaagctggttttccagaacctgttagctgtgaagcatggtgcagcaccatattctgagacgctacaggcgcgtgt

SEQ ID NO: 636756 - DNA, 357 bp, Homo sapiens
cggccgcagagctccaccgctgaggccaacgaggccatgtttttattttaaaaaaatacatataagctgggtgtggtggctcacacctgtaatctcagtgctttgggaggccaaagtgggaggatccctcgaggcaagaagtttgagatcaacctggggtaacataggaagatcttgtcttacaaaaaattagaaaattagctgggcatggtagggtgcacctttagtcccagctcgtcgggaggctgaggtggaatgatcacttttgaccccaggagttcgaggtaacagttagctttgattgtaccactgcactccagcctgggcaacagaacaagaccccatctctggatcgtg

SEQ ID NO: 636757 - DNA, 201 bp, Homo sapiens
atagtcccaaccatacaggaatcatgcaaatacaatgaacttccaggaacgaaacaatataaacccagctgatatagctaccgtcagtctttgcaatctggccatatgaatatgttgggggactctgggaatatacaactctcacagagcaagtagatgagcccagctcacaaaaccacaaacacaccttccatgcttgag

SEQ ID NO: 636758 - DNA, 1332 bp, Homo sapiens
atggtcgaggccatctcctgtgtgcctgtcatggctggccatcgtggctaaacatgtgtactgctgggccggaattgtggtggtctgtacgctgtgaatgtgcatcaacatttcttgtgcaattatctacatgaaacaatgttgaatgtaccttggctttcctcctgcaagctggatgaacaccaacccttccctgaggcccctaccacttcctgggcccccagcctgcatcttcttggctgtgacctgtgcgatggtattgcttgccccacaaaaccaatgctgatgtgccatgtgccgctctgtgacctgtctcaatgtgtgttttgactggcactcccacctgcccctactgatcaagtgaaaacagcggactggttgtgttccatgcctgccctcaatggctctgtgctgctcttgaagcgctacaatgcaaagctttgcctattcttggtgtgctgcctgtgcctcacctgcaggcttggctgcgcaaggtaccagtgcatgctgacaagccacgacccttgggcagcgccgcacatgacggacacacatgacgacacaggccacgagcagtccacctagccgggacacgaacgaccaccaggccatcaatgacgctgcctccgggacacccagggcccgagcacaggacacgatggatgaacgacaattctgacccaataacacagagaggtcctcaaatgacccactgagaactccatgcgtctgagacccagcttatgcaggactaggtacacacttcctccacacactccacatataccccatccataccctcagacgtggctcataccacatcgccctcctcgcgatttgccgcgtcaccacaaccgccctgtcataagttgacaacgtggcgctccacttggggcacgcatccggttgtagtctatactctttggacacccaggcactctatcatctgtatctcccacaccgtcgtgtcatgaaaatattccccgtgttactaccccaataatagcgtgtgtgccggttcatcaactttctgcacaacacaccacgagtaaccccttgccatattctcaccctcaccacgcacgcaatccttatcacagtctctctccctcgctctacagcaccgtccgacaccagcgttcgccctcgtctccttacacttctctctcgctccctccccggctcgcgccccccctcaggcatagcccctgacccctctcaccatactacaggcctcaccaatcaccagctgatctcactactcccaactcctctcatacataacacatatacctccctcgtagacatcacccatcaatcctcactacccca

SEQ ID NO: 636759 - DNA, 378 bp, Homo sapiens
  misc_feature (281)..(281): n is a, c, g, or t
gggagtctggagatcgacgtgtcaaagacatggcacctcgaagaggggcacaggaagaagaaggaagaacaggatcatcagccatcggcagcctcaggtgcggctgaaggagagaatgtagtttggttggtcgtgccatagtctttctgcatcgcgttcaagtgacacttgttgtccatgtcactgatcgttgtctggcaaggaagaccgatctgccagtgtgatctcggtggggatagaaggtagaacggcagagcgcgaagatgaatcctcaccatatngcttgctatgttagtgctagtcccagtgatcgtgtgcccaagtaggtgcaatggagactagtggtatcatccgctctctcacgagcgagtcaatact

SEQ ID NO: 636760 - DNA, 273 bp, Homo sapiens
  misc_feature (199)..(199): n is a, c, g, or t
  misc_feature (239)..(239): n is a, c, g, or t
aacctccgcctcccgggtttaagcaattctccttcctcagcatcccgagtaactgggattacaggtgcctgccaccatacccagctaattttttgtattatgttggccaggctggtctcaaactcctgacctcaggtgatccacctgccttggcctcccaaagtgttgggattacaggcgtgacccactgcacctgggnaatatgagcattttttagatgacttaatgtattccaactnataaaaaaaagtaataattacaaactaattaatt

SEQ ID NO: 636761 - DNA, 902 bp, Homo sapiens
  misc_feature (415)..(415): n is a, c, g, or t
  misc_feature (458)..(458): n is a, c, g, or t
  misc_feature (721)..(721): n is a, c, g, or t
  misc_feature (772)..(772): n is a, c, g, or t
  misc_feature (775)..(775): n is a, c, g, or t
gggcggaacaggctaccaagtccgtgctggtggtgtgtctgggtaacatttgtcgatcacccattgcatgaagcagttttcagagaagagcttgtagagccgatcataaacgatctcagcagaattggacgggtagacgacgcgtcgggcaacctgccggggctagtgagatacgggaacacccgcgctgagcgtacacgatgaggcaggacgcttggcactgaaggacggtcactcggacataatcccaggtggagcgcacgggtatgcccccggtcgagcatatacgcagagacgaatgacttgttaggtccagcagttctggagttaatagtaacgtagtgatagtgggacgtgaaacgtcaagtcctggaacgagaggtttgtaactacgaagaggacggtagatcggaangtatataagacgcgttgcagagagggcgtacacaagtgtgaancgtaatctgtgggaagatggctgattgcactctgatcgaggagacacgcaatgtactatgaagtgggtacacgaattccgcgtgatggcaatggaggaagagtagagcatcatagaccttgtgaagaacgggtggttaccgacgtgagatgctgtgcagtgtagcgtggacagaaggggtcacttggagagaataggccacaacatgcagtgcaagagttcagtagaccacttgcgtaatgggaacgagtagctgtactgagnactcaccaagcactggtagggtccctcgctcaatttcatacaggtacgggntgntggtaaagtcagcgtgtgaccgcaggggccccgaataggccgcagacttgcttaggattccagttatgagcattagctgggtgaacgttacgcgttaccaaagctaattggtagaatggaagaatca

SEQ ID NO: 636762 - DNA, 449 bp, Homo sapiens
cacaattgtagaaaatactgtttaatttacatggatgcatgttgtctactaaagactaaacaaaactatgctaatttttctgaagtaataagtagaaaccaaagcacagctaaaaattccattgctcagtttatacactaacagttctagcttttgcagtgttaaatactttaggctccagatattatcacctttgatataatcgccttggatgattagttttctgttggagaaacttagtatcttttactcttcattactctgtattgctgaattgaatcctatcctttgtgctcaacttttgtgtgatcttaaagtgagctttatcattctaaacaaatctgtgtctattttaaaagactgaaaatggaaaaaaaaaaaactttgccaaatcaaaagcaaaaacaaagtggtggttctcaggtcctagataaagagaatcctgagtc

SEQ ID NO: 636763 - DNA, 597 bp, Homo sapiens
cgcgttgtgtttacagtaaaatcagagaacttattcctttttctttctgtctattcgagaaacggagtcttgctctgttgcccaggctgaaatgcagtggcacaatcatagcttactatatgtcctttaactcctaggctcaagccatcctcccgcctcagcctcctgagtagctaggaaggactacaggcgcgtgcacagagcatggacaattttttttttagagacagggtcgcactgtgttgcccaggctggtctcaaaatcctggcctcgagcaatcctcctgcctcagccacccaaagtggctgagccatcatgcccagccctcccttatttgcttaatcgcatctcattagagctggcatgtgaatttactttgcccatttttcagtttcctttaatttacatattaacgacatgtaacagttctttaccaatgaatccaaaaccattcacttgaattaattttcctccagggcagaggcctcgtctgcttgaggaacaacgaagagttcaggttaccttcatgacagcacccagatgaatagcaaggaatgtgacaagtcccattgaaaacactggaatttccacacaga

SEQ ID NO: 636764 - DNA, 294 bp, Homo sapiens
gcagactgtactagctgcgcctatctgttccagcagcatatactcttccatacttaattcttttcaggaactatcttaaataatttaacattcctttataacatctataacagtgtcaaaactggggtagaagggattttattttagcccggaagggttccatctttgctatctgtagatcagcgcttaggaagatctaagtagtgatcaataaattttactggttgatggcatcctgtgtccgctggagtagtgagttgtgaagtcttgaaaacctagtactatttgacccta

SEQ ID NO: 636765 - DNA, 605 bp, Homo sapiens
gcaggttgttttgcctttctggctctcacaaaaaaggttagtgattgatactgtatctgcatattttctattcctttctctgtactttagttaatagcattttgtgattaaaaaaaatacgcccttgacttacttttcttgttgttattgaaagcagtttttcctgtgtctgagcatgtataacattagtgatctatatagagagtttgtttattgcaaccagaggcacattcctagggaagaatggtttttgaatgttccgttatcttatttccagtaggacatctttagaaatgagcaaattccattaaactaataaccctgattttggtggataagcacttatactaattctgctttgagaaaagagattgttcactctgctttaggagctgctggctaagtctggtgcttcttaacctttaactaagaaaaatgaggcttgctgacaataggtagtttttactggcctgtgaaacccaacagcatgttcagcaatgtaaaccacagcagctatcttttgctggcttcactgttgtttgaagtataatgaaatgcttcttggccggtctcggtggctcacgcctataatcccagcactttgg

SEQ ID NO: 636766 - DNA, 82 bp, Homo sapiens
ggccccgggggggtttcccccgggacccccctgggggggggggggggccccccccccttttttttccccccggggggtttta

SEQ ID NO: 636767 - DNA, 223 bp, Homo sapiens
  misc_feature (3)..(3): n is a, c, g, or t
  misc_feature (27)..(27): n is a, c, g, or t
  misc_feature (146)..(147): n is a, c, g, or t
  misc_feature (193)..(193): n is a, c, g, or t
ctnctctccccgcttctgtgctgcctntcctgcccttcgcttgctcgcttcttcccgggtgcttgccccccttctgctgcctggtctccccctctggggtcgctccttggtttgccccttccctctcttcctccccccttcccttnntctttctttcctggccgttggggcctgggtgcgggcggcgcggggngggccgtctgggctgccgggttctgtctcc

SEQ ID NO: 636768 - DNA, 929 bp, Homo sapiens
ggtggctgctacagctcccagacaagttggccacccggaggccacaggatccagtcttttagataaacaggccactgggcgtcgaatggccgcaaagttgagtaggacactctgggaagacaaagtttgggccttcttggtgagacccgatacccaagctcctaaaggagtcctgtaccggccgtattcattgttccgggtttctgaccagcaaaaatggagtattccaggtgactgacacggtatacgatccctctcttcagaggtgaaacggattaaacaggagttgctgacaatcatcccagaacagtcctaaattccattaggcatgaaacaatgaagtaggcattctgtggactaccaggtgagtttctgaaactgaggtaagagaggagtctccctctgtcaaccattgaatccagtctgggcaacagagtgagattcgtctcagaaaagaaaaggaaagggaaaaaagtaggtttatattcttcgtggtttaaaggggcaatagaaattttgtggagagagtccaattccaggtgtggattattccaaacagaaacattttataacgtttacgattacttgagcgttcttagtaggcaagataggtatcacttaaaaacaggcttcagggtatatactctttgtaaagaggctacaaattacagtgcaggttaccagtgtaaccacggtatgttcttttaggttggaagaagaattaagggctattttcagttgggggtgttcggcttagggggcctaacagtggggtgcaaataaatttcggagaatacccggaggtggaaaaagcgcattaggtttgttacaatgggagaatttccaaagggcggggttatttgaagtcgaaacgatcttgaagagaagagaaggattggaggaggaggattagaataggagctgttagc

SEQ ID NO: 636769 - DNA, 93 bp, Homo sapiens
ctggccagatttcttaggacttcatgacaagtgtttgtgtaatttgtccaaagccttgatatacttggcggttctagatcgcgagcggccgct

SEQ ID NO: 636770 - DNA, 2682 bp, Homo sapiens
ggcacgaggggttccgtttccggagtggagggcacgccaggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgtgccgctcggtactacgtgggcatgtgccttgcggcttcagaaaagcggctccacgccctcagccagggcccctgaggcctggcggctcttcctgctgctggccgtgacctcccctccatcgcctgcatcctgatctactactggtcccgtgaccggtgggcctgccacccactggcgcgcaccctggccctctacgcctcccacagtctggctggcaggcttgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccgcaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtg

SEQ ID NO: 636771 - DNA, 534 bp, Homo sapiens
aacgagggtcctcagcgcaacgggggataataatatggtcacctcagggtggtgtggtgaaaattaaataaattaataaatgaatatggcagggagcagtgttgggcacagaatacatagtaatagtcattatggtcattagaacataagttggatcaaggtagaaatttttattggattattcccggcggtattcctagcacctagaacagttctaggcacatagcaggcactcagtatcggttaaatgaatgactaaatgaataactagaatataaagagaacaatttcccaagaagttggtgattaaggactactacatgactcctctcccactctcagcccttcaaccaaacaaagcagtaactaatgctaaatccaaagaactggggtttatgtccactacatgctaatttccagattaattcagcccggaaaaaaagggatctggaaaggtagctgagattagatgttttatgagaacagcctaacatccatttcctgcttcttctttagaatctatctttagtgagc

SEQ ID NO: 636772 - DNA, 106 bp, Homo sapiens
gagataaggtctcacgctgtcgcccaagctggagtgcagtggcgggatcatggcttaactctagcctcaacttccggggctctagcaacccttctgtcgtcttctc

SEQ ID NO: 636773 - DNA, 346 bp, Homo sapiens
ttgtcatctgacatcccatttggctggctgcacattcatcaggattttttttttaatacaaagttaacaagcgttagaatatggggaaattgaagccttcataccttgcttggtaggaatgtaaaatggtacagctgctgtgtaaacagttgggcaagtccttaaaatgttaaacatagaattaccatatgatccagcaattccacttataggttcatacccaaaagaattgaaaaactgggatgcaaacaaatgcttgtacaccattgttcacagcagtactagtcacaatagccaaaaagtggaagcaacccaaatgtccatcaacagaaaactggataaacac

SEQ ID NO: 636774 - DNA, 251 bp, Homo sapiens
  misc_feature (87)..(87): n is a, c, g, or t
  misc_feature (101)..(101): n is a, c, g, or t
  misc_feature (161)..(161): n is a, c, g, or t
ccccccccccggggggcccttttgagaggtggggttttctttgtgacccccccggcccggacaaattctgtaaatagagagaagganttggggcctcttcncccccccccccacccggggggccgggggggggggggccgggccagcccaaaggggggtcnaaaaaaaaaattttttttttttttttttccccggggcttttttttgcctttaaaaaatgggaaaaaaaatttttcccgaaagctttggga

SEQ ID NO: 636775 - DNA, 278 bp, Homo sapiens
  misc_feature (8)..(8): n is a, c, g, or t
  misc_feature (23)..(23): n is a, c, g, or t
  misc_feature (42)..(42): n is a, c, g, or t
  misc_feature (74)..(74): n is a, c, g, or t
  misc_feature (78)..(78): n is a, c, g, or t
  misc_feature (82)..(82): n is a, c, g, or t
  misc_feature (106)..(106): n is a, c, g, or t
  misc_feature (108)..(108): n is a, c, g, or t
  misc_feature (162)..(162): n is a, c, g, or t
  misc_feature (175)..(175): n is a, c, g, or t
  misc_feature (195)..(195): n is a, c, g, or t
  misc_feature (203)..(203): n is a, c, g, or t
  misc_feature (216)..(216): n is a, c, g, or t
  misc_feature (229)..(230): n is a, c, g, or t
  misc_feature (243)..(243): n is a, c, g, or t
  misc_feature (268)..(269): n is a, c, g, or t
ctcgtgcncgggacattgtcagntgcgtttccgcggtcgcgnttgaggagctcaagcttgggaaaatggtgtgnattncttntatcgtcattccagttctgctctngntctcacaaaaaattcctggagccatatatataccctctggtttccccttgcgtnagtcgtatatggnctaagacagcaatacaagantccaatgnatacaaacaaagngcaaagtaaactnntaagggtgacagnacatgcaatggtattaccaacaaanngccccaaca

SEQ ID NO: 636776 - DNA, 544 bp, Homo sapiens
  misc_feature (12)..(12): n is a, c, g, or t
  misc_feature (36)..(36): n is a, c, g, or t
  misc_feature (222)..(222): n is a, c, g, or t
  misc_feature (460)..(460): n is a, c, g, or t
ggcccatataancacacagttaaggacagcctcggncatttatatatgaatcctcagaattttaggtacacccatttcttttcccgtaaataaaatttctttcctgccttttaagtgtcttttccctgattcctacatagaaaatttgatgaatatttaccagcccattaaaaagaatgaaatccatgtccctttgcagtaaccatggatgcaccctggagnccattattttaagcgaactaatacaggaacagaaaaccaaaaagcacacgttctcacttatacgtggtagctaaacattgactacataaagatgggaacgatagacagtggggaatgcttgagagagagggtgggggaggcatggattggaagactaactgttgggtactgtgcttactaccttggtgatgggatccttcgtacaccaagcctcagcaacacacaacctacccgtgtnacaaacctgcacatatatctcctgaacctaagattaaagtagaaaagaagaaaaatgttaaaaacatttgcttaagtaagaaca

SEQ ID NO: 636777 - DNA, 112 bp, Homo sapiens
acggtcttaccatagaaagatctttatattttttaggaatcatgacttaacagaactcaactgtataaatagttttggtccccttaaaatgccaatcttccatatatagttt

SEQ ID NO: 636778 - DNA, 86 bp, Homo sapiens
cgtcccccgccggggcgaccgagccgagccgggccggagcggcgggcgcggcgggccgccatggaccacaagccgctgctgcagga

SEQ ID NO: 636779 - DNA, 262 bp, Homo sapiens
ccgggatgcacgatataaaaatccagatcagaagctgtcagccagttgatgcgcatgacagcatgccctgctaagattccagatgaagaggcacaaaacccgaaggcgggttagatgatgagcctgagtactgtacctgcatccagaggcagagaaacctgaggcttaggctgaaagccatggatggagaatgggaggctcctcagcattgcgaacccatagatgtgagtcaggtcttttatgtggatgtcaggcagcgacg

SEQ ID NO: 636780 - DNA, 864 bp, Homo sapiens
atatttttaatagatatggggttttaccatgtggccaggctgtctcaaactcctgacttcaggtgatctgcccacctctgcctcccgaagtgctgggattacaggcggggaccgtgtgcccggcaccgttttagtttttacactgaaattattcatgctgcttctgtcttatactgttgtgggtctctgtgatcttatggtgtcgggcttcattttcacacaactgtgggaatgtgcgggttttctctgttccctggtttcactgaagatgtagttctaatgagaagctgtgtatacgtctgtgtgcacgtgcaatgtatgtgtatgcagttggcattcattcctgtgtgctctgtatgtggtttaagagtgggaagatgtggggctgggccatcattatgctctttctagaatgaacctactagatattaattttttatttacacaaatgtgtacttgtgatgctttaaatgtgagagggaatcgggtaattattcggctaaattattaaattgtgacacatcactttttttggcagtagtacgtttgttaaatgagcgaatttgtcatcacatctcagttcaggaaggtgagctgggacaaagcaatgttagcaatttttctgaacctgtgatgcgtcaggacagagagagtgttgtgccagttatcactctggcagtccaatgttgggggtgtggggggctaaagatgatggtggcattctgttggggacagggttagggaatgggggccaggacaatctgccaattggggtgagggggttggaagaatataggggcaaggctgttgaaaaattggggaacttgtgggggggacacgggggtgctacggggaaaatacggt

SEQ ID NO: 636781 - DNA, 116 bp, Homo sapiens
gagcagccgctgggctgacctggccagtggtgttgatctggggtatgacgctgagaagctgatggagttgtgtcaagaacaaaaggccatgtgaggattgagctgaaggagccccc

SEQ ID NO: 636782 - DNA, 719 bp, Homo sapiens
ctgtctgggaaacgaggagcacctctgcccggctgccccatctgggatgtggggagtgcctctgcccagctgcccatcatctgggaagtggggagcgcctctgcccggccaccccatctgggaagtgaggagtgcctctgcccagccgccccgtctgggatgtgaggagcgcctctgcctggccacccatagtctgggaagtggggagtgcctctgcccggctgccccatctgggacgtggggagcgcctttgcccagccgcccatagtctgggaagtggggagcacctctacccagccaccccgtctgggaagtggggagcatctctgcccggacacccatcctctgggatgtgaggagcacctctgccccaccgccctgtctgggaagcgaggagcgcctctacccagccgacccatctgggaggtgtacccaacatctccgacgagacagcaaccatcaagaatgggccatgatgacgatggtggtttgttgcacagcacaccaggggcgaaactgtggggaacacagaaccgagagatcagactggttcctgcgtctgctgctcccacaagaatgtcgaccctcgcgagactccatctcgtctcgtgtacttacacacccttctcctgccctgctctgctgctcactcctctactttcccccccccctcgtctcctgcaccatgcgcgctccatccggtccacgcctaccggtct

SEQ ID NO: 636783 - DNA, 882 bp, Homo sapiens
gccagaacacaggtgtcgtgaaaactacccctaacaagccaccaatgggaaaggaaatagtactcatatcatcattgtcgtcattggacacgttgattcccggcgagtccaccactactggccatctgatctataaatgcggtggattcgactaaatatccattgaaaaatttgagaaggaggctgctgagatggggaatagggctccttcatagtattgcctcggagtcttgtgcataaactgataagctcgagcgtgaacgtggtatctccattgatcatctccttgcttggaaattggataccagccaatgtactatgtgactatcattgatgccccaggacactgagactttatcaaaacaacatgattacagggacgatctcaggctgactggttctgtcctgattgttgctgctggtgttggtgaatttcgaagactggtatctccaagtaatgggcaagcactcccgataagtcatggcccttctggcttacacactgggtgtgaaacagagctaattgtcggtgttcaacaaaatggattccactgagccaccctacagccagaagagatatgaggaaatcgttaaggaagtcagcacttacatttaagaaaattggcttacaacccgacacagtagcaatttgttgccaatttcttggtgtggaatcggtgacaacatgctggagccaagtgctaacatgccttgggtccaggggatggaaagccacccgtcacggatggcatggccgtggaaccacgctgttgaggctctggaatggtccaaccaccaatcgttcaatgtaaagcttggggcggcttccggagttaccactggggtttggacgccgttggcgtgaatggttcaccgtttgcc

SEQ ID NO: 636784 - DNA, 407 bp, Homo sapiens
ggcatgcattatagaaagatacaaaatcagatataatcaaaatatatggtaggcccaggtcaaacatcatattggggggacagagtagaagcaagaaagattcaaggttagccagagagaagaaattcttcctcattagagaaatgaaatgcagttgtctcagatgctagtgagagactccagaaatcttccctgatgttgaccttccataatcgctcagtcctgccccagaaagtgccctgaactcagagttgagaggagccaactcatagacaattacctcattatataaatggggatgccgagactcagaaagggagagagatttgcccaagatcacccagcatgggggtggcagagacagcatcagtgccagctcagagctctctccccaagacaggagtctg

SEQ ID NO: 636785 - DNA, 232 bp, Homo sapiens
tggtactggtcctctataaacttcatatagtggcaataaatcgcacaaccatagcaggcgactgtataaacacccacaggataccggctcgatttcgaatatggatcataggagtcacgcgaatgacttcagttttcacagttggaactagaactctggtctcctaacacacttcatttggttttttactttatcgaacaccattggcttttggtttttataaacacttaca

SEQ ID NO: 636786 - DNA, 163 bp, Homo sapiens
aaaaaaagaaaaaactttttggttgtagtttattaagtctattaatggccctggccccccaaaaggacttttgcatgtcatctttgtggtgtccaaccaaaccttgattttgaaggatataatccttgataataaaaattgttatacctttttttggcctgga

SEQ ID NO: 636787 - DNA, 805 bp, Homo sapiens
gtgagcttgagttgtcaggagccaggactgtccccactgcagtgcccaggccagtattgagcagcagggagggctcagctgtccccagatgcaggtgccgtctgaccaggcgtggtgcactctcgctgaggaataactgctgaagctcacatatgccccatcattgccatttcttctcaattcacagtgccccgtctttgtatctgggggtggaactaggtcctgagggcacagactagctgagtgccaagaactatagtgatgcttagaaagcatacaggaggggccaggcgtggtggcgtcatgcctgtaaatcccagaactttgtggatgccaaggttggtgggattacctgagatcaggtggattacctggttctcgagagcagcctgagccaatatggtgagggcccggctctactaggatatagcaaaaggttaggctgagacaggagaattgcttgaacccagcgaggcagacggttgcactgagctgagattgcatcactgcactccagcatggtgcaacaaaatgcaatgactccgtcacatgagacactaaacaagtattcgcggagtgggcctaaaagaggggttggccggcctttgacgtgtggcgcagcggattgtcttgcagaacctttccggtgcacataagctagtggggtgtcccccttgagccatcggggagaggaacgtggggggccacggtgctatgtggaccacagggctgtggagcccaggggggggcctgggtggcaaccttccggtgtgcttcctccgggtggttaggcccttatgcctcc

SEQ ID NO: 636788 - DNA, 406 bp, Homo sapiens
aagctctttagagtagtcagctaccgacagcccatcatcatttccattgtgctccagtctctctcagcagctctctgggatccatgctgtgtactattactcaacaggaatcttcaaggatgcaggtgttcaagagcccatctataccaccatcggagcgagtatggttcatactatcttcactgtagtatctctatcactggtggagagggcaggcagaaggactctgcatataataggccttggagggataggctttttgttccacgctcatgactgtttctttgttattaaaggataactataatgggatgagctttgtctgtattggggctatcttggtctttgtagccttctttgacattggaccaggccccattccctggtttattgtggccgaactctt

SEQ ID NO: 636789 - DNA, 2609 bp, Homo sapiens
agcgggacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggagggtctcgctctgccacccaggctggagtgcagtggcatgatcacggctcactgcagcctcaacctcccgagagcttaggtggtcctcctgcctcagccccctgctgggactacaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 636790 - DNA, 144 bp, Homo sapiens
tcaagttattcaagcaaaaccccaaatggctttggtaaacccaaattctagttgaggtaagcatccatcagccttcaagagggggtgccaggacaaagggaggaggctgcgaaaccagtgcagggcgagcctccagagccgagc

SEQ ID NO: 636791 - DNA, 2326 bp, Homo sapiens
agcgggacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 636792 - DNA, 1627 bp, Homo sapiens
agcgggacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacatccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgtggctggaaaatagcttgccctcagtgtgcggaggctactgtgagccgtgaatcagacacatgcactcaggcctaaaaaacaatgcttgaatccat

SEQ ID NO: 636793 - DNA, 2766 bp, Homo sapiens
  misc_feature (434)..(434): n is a, c, g, or t
  misc_feature (439)..(439): n is a, c, g, or t
  misc_feature (621)..(621): n is a, c, g, or t
  misc_feature (640)..(640): n is a, c, g, or t
  misc_feature (659)..(659): n is a, c, g, or t
  misc_feature (705)..(705): n is a, c, g, or t
agcgggctattccgactggcaatctcgaaccactgcggctgcttcggagtgccaacagcgcccaagcagttgccctcttccttggtgcttaacttaagaaagaacagtgctgggaaggataaagatcacccaggaaggacaggggaggaggagtctgacgtagagaacacgagataagcccctcgctcttcctttttttctctgtcatctttgacttctgggataaccgggggcaaccaggtcaattatggagacacacaatcacttcgaacccagactagtgatcgctggggtataattacaagggaaaacggggtgaggagagcaaaggtctggagacggaaagtgcagacaggcaacaatgcacagaagttaacaacgagaacgcgggggtcgggggcgatgtaaggaagtcgtcatcgacgccgcgccgnttccnccacctcgcaccagacctctgaaatgccctcggagactcggcctctcctataaggacgatcgtcctctcagctggagaacaaggccatgcctcagctcctacgccaggcggaagcgggagaggaaggccgacccccaagagcgcccttcagggggtccatccggccttgatctcagatgggngggtgttgcggagggcggngcatcgcctcacagctggnggctgcatcatggcaggaacgagtttcctgagccacggagctgcangtcgcctcctctactacctgctaccggttacctcttcgcctcttggtcgtcgagcagctccggctcggtcgccgccattaccacatcgcactccgcggcagccgccatcttaccgccgggaccagagagctgggtgggaggccggcggtgaagagcacttccggttggagcatagagcagctccgcggcgcctacgcccagaagggctccctcgggctcgtctaccagagagaggctccgcttggggccagagcggcactcccgacccccggatgtccacggtggtctccgcgccggggcgggagcccagggctgtgccaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagctccccttcctcagccctcccagcctactccccatcccagcttttagaggatctgctccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 636794 - DNA, 327 bp, Homo sapiens
agatttgactgcaagattgaaggatacccagaccccgagtttgtctgtttcaaagatgaccagtcaatcagggattccccccacttccagatagactacgatgaggacgggaacttctctttaattattagtaatttttgcggggatgacgatgccaagtacacctgcaaggctttcaacagtcttggagaagccacctgcacaccagagctcattttggaaacgatggaggaagttcaatttaaattttaatttgaagaagagtgaaacaaagccagagaaaagcagtttctaagtcatattaaaaggactatttctctaaaactc

SEQ ID NO: 636795 - DNA, 3396 bp, Homo sapiens
  misc_feature (434)..(434): n is a, c, g, or t
  misc_feature (439)..(439): n is a, c, g, or t
  misc_feature (621)..(621): n is a, c, g, or t
  misc_feature (640)..(640): n is a, c, g, or t
  misc_feature (659)..(659): n is a, c, g, or t
  misc_feature (705)..(705): n is a, c, g, or t
agcgggctattccgactggcaatctcgaaccactgcggctgcttcggagtgccaacagcgcccaagcagttgccctcttccttggtgcttaacttaagaaagaacagtgctgggaaggataaagatcacccaggaaggacaggggaggaggagtctgacgtagagaacacgagataagcccctcgctcttcctttttttctctgtcatctttgacttctgggataaccgggggcaaccaggtcaattatggagacacacaatcacttcgaacccagactagtgatcgctggggtataattacaagggaaaacggggtgaggagagcaaaggtctggagacggaaagtgcagacaggcaacaatgcacagaagttaacaacgagaacgcgggggtcgggggcgatgtaaggaagtcgtcatcgacgccgcgccgnttccnccacctcgcaccagacctctgaaatgccctcggagactcggcctctcctataaggacgatcgtcctctcagctggagaacaaggccatgcctcagctcctacgccaggcggaagcgggagaggaaggccgacccccaagagcgcccttcagggggtccatccggccttgatctcagatgggngggtgttgcggagggcggngcatcgcctcacagctggnggctgcatcatggcaggaacgagtttcctgagccacggagctgcangtcgcctcctctactacctgctaccggttacctcttcgcctcttggtcgtcgagcagctccggctcggtcgccgccattaccacatcgcactccgcggcagccgccatcttaccgccgggaccagagagctgggtgggaggccggcggtgaagagcacttccggttggagcatagagcagctccgcggcgcctacgcccagaagggctccctcgggctcgtctaccagagagaggctccgcttggggccagagcggcactcccgacccccggatgtccacggtggtctccgcgccggggcgggagcccagggctgtgccaggttgaaaactaagcatggggaagagctgcaaggtggtcgtgtgtggccaggcgtctgtgggcaaaacttcaatcctggagcagcttctgtatgggaaccatgtagtgggtgagtgttgttggagggggaggaacagtggaagaagttgaaaaataaggaataggacttgatcacaacacacacaggctaaaagctgctcctggtggttttcccccctggaagaataaaacttacattgtaacagatcaactctacaacactgaacaaatccggagggagaaagccctatgtccaagataggaaagagaagctgtcatgtcacacttgtgcttagcatggaattagcataaaattaatgtccattggccgggtgcggtggatcacgcctgtaatccgagcactttgggaggctgaggcgggtggatcacctcaggtcgggagttcgagaccagcctaacgaacttggagaaaccctgtctctactaaaaatacaaaattagccgggtgtggtggcacatgcctgtaatcccagctattcgggaggccgaggcaggagaatcgcttgaactcgggaggtggaggttgcggtgagccgagattgcgccattgcactccagcctgggcaacgagagcaaaactccgtctcaaaaaaagaaagaaattaatgttcgttcccctaaacccaaatcatttcagtcctgccaggctgtcaattctctggcctcctcagccccctacattcctttctccccatttggtcagccttaagatgctctcatcactcacatttcccatctctctctccacttcagacagttttctcattttataccaggttcggagatgatcgagacgcaggaggacatccactgtctcctggggcagttgtgggtcactgtcccttccagctgccccagacaggaagcagagtcaccacgcagcagtgtcccttcttgggtctgagttcctattataggtaggggccccaccctctgggcttcccatcagcgacacacacacacttatggcaccagcctggactccagaaaaagggtgtccaggtattgtgtgtatgcatttagttgtgcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaaaaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 636796 - DNA, 414 bp, Homo sapiens
ggtcgaccagagtctcactctgtctcccaggctggagtggcatgatcttggctcactgcaacgtttgccttccaggttcaacagattctcaagcctcggcctcccgagcagctgaaactacaggagtgcaccaccatgcctggctactttttgtatctttagtagagatatggttttgccgtgtgggccaggcttgtctcaaacttctgaccttaggtgatctgcccacttcagcctcccagattgctgggattacatttgtgagccaccacgcccagccagttttaattcttcattaagggcaaacacgatggcatttaattgggaaggaacaaagagaagagttctcagaatttatatttagtcttaccagtgaagagcgtgtcttacactttcagtaaatgttcgtcgacg

SEQ ID NO: 636797 - DNA, 978 bp, Homo sapiens
gagcggagtcgcgcggtgagcgaggtagcgcgcgcgagggcgttgggcgccgccgctgaggcggggaagcgcggggccgcggcggtgcgggttctagggcggcggccgtcgccgtcgcagcagacgccccgagcggggagggccgaggaggcccgacgagctggggatggagagtaccgggcccctcactgcctcagaagcgcgtgtgcggctctgggcgcgcacaggtgacggtgacggcacccctggcccggctaggcgcctgaggccgcttcgctcagacatgtctagcggcccgtgcggcaggccggggcccatgagcggcaggggccgggtccgggcctcgctgacccctgtgctccgctgcggcagcttcccccagttttccggctccggtctctcggcattgagatgtcctgcccgggcccggggctgccggttgccccagacccgccgcactggcttggcgcagctccgggcccgcgggagccgacggtgctgattacctgcggcccgcactgcgcccgcccgctccgtccgctgtgtgcccccggggtgcgcggccactggcaggtggtgggatgactttcgatgtacatgcacagaggggatctcgatgggaccacgggggccttcgcgcgtgcgtcttccggcgggtgcacggccacccgtgccaggaccagaccttgactttgggcacgcgtacgcctacattccaaccacacgtttattatcactttaccaaccacggaaacccctggttcgacagcaaactctcaacaccaattaccttgggatgttgggccaacaaggggaacagtgtgaccacatacttcttttaaaacgggcgaacctttgccaggcaaggtgtacacataatgacattggataggtcccctgccctaatatcacttggtctcacgcgtgcacattctagccgcccaaagcctcctggtctcttttgatatgcgtacgacg

SEQ ID NO: 636798 - DNA, 1218 bp, Homo sapiens
agcgggacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctggggctctggtagatgtgttgagggcaaagtagaggacaagctgtctttcccagtcagccagggagctccccgccaggccacgccccagccactttgctccctctcacctctgggaagtgcaaatactcttggttgacacaggtcctctttcggggctcaggagggtgggcacacacccagcggcctgcagagtaagcttattacccacaactgtgcccgctttgtgcttctaaggtgcacacctagcctaggtgagacactgcagccaggcaaccaccgacacacgccccttctcaaagccagaggtgagtggggcaggtgcccggggctgggtgagtggaattaggacacacacaggcttgggcttcaagttcatttattgatgcattggttggacacaataaaaccacaattgttatcaa

SEQ ID NO: 636799 - DNA, 919 bp, Homo sapiens
agcgggacggaagctggggagcgggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtcgtgtgtggccaggcgtctgtgggcaaaacttcaatcctggagcagcttctgtatgggaaccatgtagtgggttcggagatgatcgagacgcaggaggacatctacgtgggctccattgagacagaccggggggtgcgagagcaggtgcgtttctatgacacccgggggctccgagatggggccgaactgccccgacactgcttctcttgcactgatggctacgtcctggtctatagcacagatagcagagagtcttttcagcgtgtggagctgctcaagaaggagattgacaaatccaaggacaagaaggaggtcaccatcgtggtccttggcaacaagtgtgacttacaggagcagcggcgtgtagacccagatgtggctcagcactgggccaagtcagagaaggtgaagctgtgggaggtgtcagtggcggaccggcgctccctcctggagccctttgtctacttggccagcaagatgacgcaaccccagagcaagtctgccttccccctcagccggaagaacaagggcagcggctccttggatggctgaagagctgccgttcctctttcacgatcccagccccatttcagtgtctgggcgctgtgctaagatgctagaggaggacagacagtacgaggacaatctttgagtactcagtcactcgcaggggagctaattcatacgacccagcggcatacactttactctcgatgtcacat

SEQ ID NO: 636800 - DNA, 817 bp, Homo sapiens
ggcgacagcgagctgcggcagagtcttgctgcgacacccaggctggagtgcaagggcgctatctcggctcacgtgcaacctccgcttcccgggattcaagcgattctcctgcctcagcctcccgagtaggtgggactacaggaccagaggagcgagagcagcaagaaccacacccagcagcaatgtcagcggcacgtggaacgcctcgagcagggggtagaccgagctcagaacacacaagaacctctggggcccctagaacaaggagaaccacaagtgagaactggctagacctctcggagctcctgaaggcacagggaccacaggaacgcacacgacccgggccagaagaacacccagtttggctcaaggcactctctctgcacacggcaacactctaacgacacggcagcgtcgtcaaaccttggccactcacggccacttacactgtcacactacctcagcccctcgcagcgacgcgccccctggccgcccgcacccaacggcacccatcccacccacttttgcccccctctcgcacctctcccccagtggccgccctgccaccgggcccgcgcagcgcgccttgccccacgggcccccttggcacgctctcccctctcggcctgaccacccggggcgcagtcgacgcacggggtgccagatgtcccccaaaggcgctgcctcaggcaagcctaccgctcgcaacccgccactccacctaccactaagcgcccagaaaccgaagccccgcaagctaccttgggttggcgccccccatttcccacttcaccacccgcggccatacacaatggcg

SEQ ID NO: 636801 - DNA, 403 bp, Homo sapiens
agttcagtcgacaaaccattgaagattattagggtaagaaatactgctttctgtctgaaaactttccaatgacatcttctgaaaagacaaagaaagtatcagcatcaaaatttgcataataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacctgggaggcggagcttgcagtgagccgagatcccgccactgcactccagcctgggcgacagagcaagactccgtctca

SEQ ID NO: 636802 - DNA, 450 bp, Homo sapiens
  misc_feature (34)..(35): n is a, c, g, or t
  misc_feature (39)..(40): n is a, c, g, or t
  misc_feature (42)..(42): n is a, c, g, or t
  misc_feature (170)..(171): n is a, c, g, or t
  misc_feature (185)..(185): n is a, c, g, or t
  misc_feature (189)..(189): n is a, c, g, or t
  misc_feature (207)..(207): n is a, c, g, or t
  misc_feature (213)..(213): n is a, c, g, or t
  misc_feature (215)..(215): n is a, c, g, or t
  misc_feature (218)..(219): n is a, c, g, or t
  misc_feature (222)..(222): n is a, c, g, or t
  misc_feature (225)..(226): n is a, c, g, or t
  misc_feature (253)..(253): n is a, c, g, or t
  misc_feature (260)..(260): n is a, c, g, or t
  misc_feature (267)..(268): n is a, c, g, or t
  misc_feature (272)..(274): n is a, c, g, or t
  misc_feature (279)..(279): n is a, c, g, or t
  misc_feature (284)..(284): n is a, c, g, or t
  misc_feature (289)..(289): n is a, c, g, or t
  misc_feature (296)..(296): n is a, c, g, or t
  misc_feature (299)..(299): n is a, c, g, or t
  misc_feature (302)..(302): n is a, c, g, or t
  misc_feature (304)..(304): n is a, c, g, or t
  misc_feature (306)..(306): n is a, c, g, or t
  misc_feature (308)..(309): n is a, c, g, or t
ggcgctcaatggaattcctttttttttccaacgnnatannancgccaggaggcccaggaccctccagactgaagagtccatgggcccctgtgcatgtgagagctacacagggaatcgctgtcaccttccaaggataagcagacagggccacacatgccatggccactcgnngcacagggaccagnctgngccagagacccaggcatncagctngnatnncangtnncttactgagagccccactgcttgatgncaagctntaggttnnttgnnnttgangactncgctnatgaagnagntgntntngnngtctgtagggacaatgataataaggaagggcctgtcgaaacatacaatgatccttgtttccgctaaagtagccaggcgggtgcttcagcctgctgtgatagtagctgcttctgtgcatttctgaagaggagaaggtgtact

SEQ ID NO: 636803 - DNA, 200 bp, Homo sapiens
gtccggttgtacagacgctcaagctgttccttccgcgtcgttcgcgcccagcatcaaatactggtatctaaggtctgtgcctggcacatcccgcacgttggcgagcttagcacatatgtggtagtaccgctccttcatgtcttacacagaacgcttcttgaactgatggtggtcataccggtcatggataacaacaaaac

SEQ ID NO: 636804 - DNA, 280 bp, Homo sapiens
  misc_feature (149)..(149): n is a, c, g, or t
acccttttttccaaaaaattttttttttttaacccggggggggggccccagaaaaccccctttttcctttggggggcccccctcccccccccccttttttgggtggggcctggggagggggtttttccccttttaaccccccccccccnggggaaagggggtttccccccttccccggggggggggggggggaatttggggcccccgggggggggggcccccttttttttttttttttttgggggttttttttccccaaaaaaaagggggtttcggggga

SEQ ID NO: 636805 - DNA, 315 bp, Homo sapiens
cccgagaatcgatcaaggtctgtcctcataccaggacctctaacttactgccagaccgagacctctcgaaccattctcttcccttccctcctgatcttccttcccccacaggtgctcttttccagcccacagctgcagatgacgagtctgtctaatctacatcccctctgcgggtcctttcccaccaatattagaatcagaacaaacctctctcatatacaaaagcgaatactccctccctatttccctctagaagtgggatcctccgagtcacaacccccatctctccttacatgggtaccgagcatcgaatcg

SEQ ID NO: 636806 - DNA, 151 bp, Homo sapiens
atcatttctagcatgcattcacggctttttaaaaacaccaagtactcgattaagccactgtaatagtgatcagcaactgacagtgtgaggctataaaacaaatcaaagcatattagtacccaattgcgctactattaaggagcagcaggag

SEQ ID NO: 636807 - DNA, 956 bp, Homo sapiens
gtgtgcctgtgcgagaaccgacccgactatgggcgcctattttttcaatgcgtccacggcgggtcacgccggttcttacggccggtctgtttggtgacgccccccgtgtgtgtgtgagcgcccccgggtccacaggactcttttttcgcgagaaacgctttccaatgttctcccgggccccgctgggccagtctccggttccccccgaggtccaccttgctccttctcctgacccactccccgcgaagtctccccgtccgtctttgctgggaaagcccctcatgaagggccacacattgccgagggcacacaaagaacatggggtggacaacgagaacatcgccgggccaaaagaggtaaaaagccagatggttccccaatgggggccaatgtctcagtgaccccctggagcgcatatatgtcacttcccgttggcccagatattcccgcaggaaaaaaatgcgggccgtccgaaaaaaaagtgtgttctattttgaccagctttcttgaaacaaaatcatcaagaccccccattaagttgtaatgcatactcttttttactgcgcgcgtggggcacaacaacatttcttcttgcaaaacaggatcgttgcctcgcagatcatctagatgggtcaagacgtgtttgttttgttttggtctgtgaaacaaccaccactatttgtgaccagctcaggtaaatacccacaccgcaggtctcgcagggtacggtatgaatagagggggaggaggcagtagaaagagtaatctggtaaatgcggggattgttgatagagtagatgatgcacctgggacagcctgacccataacgatggcacccccacaagtcagtaatcccccgccgtattgtgtccatgaacaggcgcgaacgtagcacacattttactggtttgtacgcccaacaatccaaatattttttcaattgccccacaataaca

SEQ ID NO: 636808 - DNA, 257 bp, Homo sapiens
  misc_feature (7)..(7): n is a, c, g, or t
  misc_feature (116)..(116): n is a, c, g, or t
  misc_feature (145)..(145): n is a, c, g, or t
ttatgtntcaaagtatgttagaagttgaagagtgctatagacaaacggacgggacgctagaaaggggactgcaggacgcagggtgagaggacaggcagcagctttaactaggatgnccaggtaatctcactgagaccgtggaatnccagaaaggtaatgaaggaggacaaaccatattgatattttggagaatagtgtagacagagcacccagtgctctcagcaagaaagctggtgtggctagagagaaatgaagaa

SEQ ID NO: 636809 - DNA, 278 bp, Homo sapiens
agatgatggccactgaccacagaaaatgagtgtaattcatggaaatcaggttaaacaaaaatgtcccaaccttgagggttgcagtgatatgagaggaaaacagtaacagttaagaaaaatgagtctaggccgggcacggtggctcgcgcctgtaatcccagcactttgggaggccgaggcaggatgaatgtgatgaacccgggagtgctggatgcttgtagtgagcctagaccacgccactgcactccagcctgggcgacagagctgagactctgtcc

SEQ ID NO: 636810 - DNA, 174 bp, Homo sapiens
gtaaaacgtgggctacctgtatgctgtgagggaccgtgaatgtttggatatatgatattacattcagaggattttctgaagaagataagaaaacatatggtgaaatttttgaaaatttccatccatacgttgaggtcttcaaaatgcttctcagtttcactgatacctgctgtt

SEQ ID NO: 636811 - DNA, 324 bp, Homo sapiens
tattgcacatttcccaaacaacccaaagctcatgagaactcctatgacaagaacagtacccaaagggatggtgccaaagcattcattaaggatccacccccttgatccagtcacctctcacccaggccccatctccaacattggggattacaattgaacataagatttgggtgtggacacagatccaaaccatgtcaggcgtgatggcacactcctgtggtcccagctactcgcaaggctgaggtgggaggaccgcttgtgcctgggaattcgaggctgcagtgagatatagtcatgccaatacactccagcctgggcaaagga

SEQ ID NO: 636812 - DNA, 260 bp, Homo sapiens
ttccgtagatcagcctagaagcccgtataagaggcttgcgcagcaattacacctcctgacaactctaccagcagccttcaacatgcgaaactcctatgctgcgatttttaatttgggaatagggaaagaaaacagataggtgggaatgactgctgtttgaactctagtttcaggatatgaagagtgatgtatagagtgcaaagagccacatgctaactttactagatactaacttgatcctaaagttatttggagtctgt

SEQ ID NO: 636813 - DNA, 600 bp, Homo sapiens
aggatccccctgtatatgtctgggagcagtggtgatatcccctttatcatttgttattgcacctatttgattcttctctcttttcttctttattagtcttgctagcggtctatcagttgtgttgatctttaacaaaaaaccagctcctggattcattgatttttgggaagggttgtttgcgtctctatttccttcagttctgctctgatcttagttatttcttgccttctgctagcttttgaatgtgttggctcttgcttctctagtttttttttttttttttttagtttttatggatcatgctggggtgttcctgggagggggtatggtggcagggtcataggataataggggagagagtggccagcagattaaacacgtgaacaagggtctcgggtattccaaggcagaggtccctatggcctaccgcagggttggtgtcccggggtacttgagatcagggaggggcgatgactcttacggcgcatgcagcctttaggcttcgtgtaaacaaagcacatctggcacggccctaaatccatttaacccggagtggacccagcactggttacagagagccgggggtggggggtagggtta

SEQ ID NO: 636814 - DNA, 719 bp, Homo sapiens
  misc_feature (710)..(710): n is a, c, g, or t
ctttttgtctcatgcctgatttaagagcgatttggtagatcatggctaggctggtctacaagtccgagcgtttgctaatggtctggccgtaccacttgatcgtgatcacttgtatgtaatccatgacattgaccaataacacgctatacgcttgattatcaatgcactctatgcactagtaccgtgttctccattagtccagagaagctgaggtatcgaagctcactgcttgacacgtaccagtcttatctatgcatcagtatcagctacgatagtcggctactagaattactaagtccgtcatgatacagggatttggcacactatagatacattgagtaatggtcatgtgttgacacgattatgattgccaagagaactgagctctcaatgacttaaactgactatcaagcctctacgaatggagtgtgactagctcatcttttacgagttaggctgtactatgactctcaggcgattgtagacataatgaactcccctaggtagtccaaaaaagctcttcgtaccctttcatacagggcgtcatcgaatcactttaaccttgactctactttgttcgcatgtggatcagccctcattctataatgctttcgactccctttactacacttcttaaagtctaccttgattcgaatgccccctgcccagtctcaataatccacgcaatttgtcctcaacgtacctctgtncctccgccc

SEQ ID NO: 636815 - DNA, 192 bp, Homo sapiens
ccatgcagtccatgatccccaccccatgtgttttaaaaagccagtagcctttgcagggacatgtctgtcccatctgtttgcccacgtgtctgcatcagattgtgtgttcacaaggactagctgcattgaccattgaaccctgaggacatcgcccaaaaggagaaagaaaaattttactatagcctcactgat

SEQ ID NO: 636816 - DNA, 154 bp, Homo sapiens
acgacagaaggggtttcactatgtttcccaggctggtctcaaactcctgggctcaagcaatctgcctgcctcaccctctcaacgtgctgggattacaagagtgagccaggtgagccactgtacctggcctgggctgtgtgtactcctacttatt

SEQ ID NO: 636817 - DNA, 273 bp, Homo sapiens
ccccccccgggggggggggggggggggggccccaggggccccttttttttttttcccccccctttttagggggggggttttgggggggccccccccccccaggggccccccccccccctctttttaaaaggggggcccccccctggggggcggggggggggggggccccccttttttttcccccccccccggggggggggggggttttttttttttttgggccccccccccccccgggccccccccccttttacccttttttttgggggggga

SEQ ID NO: 636818 - DNA, 468 bp, Homo sapiens
gcatctctgctgtggcacatcaagctcttggactgggttgtctactgcatgctgacgcctgtacttgggcctctgagagatacatgttctccttccatacagctgaaattatatcctcaagaggttgaatcctcacagctgtcacactgtttgttgcttctacaacttatactcttccttgattaatgaggtcctccagctgtagattactcattgctgacagggctcccagattgaaaggaatataaggagttagagagtggaaactgacagggggtaaataggtcccaagtaggtatgttgaaacacatggtcagtcccttcatactctgcttcatactcagaccaagctgcttttctttcttcttcagtcacctcttcttcttctttgaggtcccaaaagagaatcatgtacatggtatcctacaatgtgttctacattgtatctgaaggagctctgaaagtatg

SEQ ID NO: 636819 - DNA, 317 bp, Homo sapiens
  misc_feature (6)..(6): n is a, c, g, or t
  misc_feature (15)..(15): n is a, c, g, or t
  misc_feature (47)..(47): n is a, c, g, or t
gacctnatcttttanatattaagagagagagagagagtgtgtgtatnctttgtgtgtattacacacatatataaattttatattacacatgaatacatattacatgttatatataaattttaaaaaattaaaaaagaattggaaccccgtctctactaaatatacaagggttagccgggcatggtgatgtgtgcctgtagtccctgctactctagaggctcaggcaggaggactgattgagcctggaagtttgaggctgcagtgagctgattttgccagtgcactccagcctggttgacagaatgagaccccatctc

SEQ ID NO: 636820 - DNA, 93 bp, Homo sapiens
  misc_feature (33)..(33): n is a, c, g, or t
ctcaggttggggacgctttactccccccagaanataataacccaagcctgtgaccccattgtccatcccctgatttcttgggctacgggatgc

SEQ ID NO: 636821 - DNA, 485 bp, Homo sapiens
gaatgagttcgagagaagaagttgagtcataagcatgcaatggagaacatgttagaacaatctaactttgatcatggaaccggggagaagtctccaaaaatagtggcactcgtttacaattggaagtgagggtgtaagatggaaccaaaatacaggagaaactgaatactcacaatcttttcaagaagcaattaggcaaagccatgtgatcatctcaattggtgcagaaaaagcacctcacaaactccaacaccttttaatagataaaacactctacaggccaggactggaagggagaaaagaaaatagtaatacattttggggagctagatagatgaataaacactgacttaggccagaagaggttgagtcataagcatgcaatggagaacatggaagaacaatctatctttgatcatggaacccccagaaggctccaaaaatagtggcactagtttacaattggaagtgagggtgtaagatgg

SEQ ID NO: 636822 - DNA, 903 bp, Homo sapiens
  misc_feature (434)..(434): n is a, c, g, or t
ggctcgtttcccctggctggcagcgcggaggccgcacgatgcctggagttagctgtaaaagacgtgaaccagcaggagttcgtcagagctctggcagccttcctcaataaagtccgggaatgctgtatatgtcccccgaagtgggtggatacctgtcaatgctggcgcaagacacaaagagctatgcatcccttacgatgagaactggttgctacacgcgagcatgtcttccacagtcgcgagacctgtacctccggggttggcagctggtggtttggctccaatgaccagagatctatgggggacgtcgagagaaagcggatgtcatgccccaagactatttcagccggaggctccaaagaagatgtaggcccagccgtggtccgtccgaagccgcttggagtgggcttgaaagatggtggaaggaaggaccnaagattgcgcggccgcatatctggagaagcctcaggggacaaagagagactcgtggaccggaatccgcacgcgacgcaggtgggcaaggcgtgccaagtcgaaagtaaggccacttgagtagaccagaaagcaatgacttggggggtataattacacattgggccctcagattacgggcaaagaagcaagcgggcaatcccttggacacgaaggagcggaaacgaccaaagaaaggacccaagcgatcgcctaccagagggaaacgaggaagcactctccgtcgcctccgctcgcaggaaaacaagtacgcgaaggtcaaggcaacacggaacgaccacagacgcagagggagagggcacaccgccggggacacccgaaataccaccgaggaggaccagcgcgcagaccccacaggggtgcggccagaaacaagacgtggcggcgctccacccaagggaggcaggcgcg

SEQ ID NO: 636823 - DNA, 267 bp, Homo sapiens
tcactggcaatgtcacatttcattcaacaggtaataatagttgttgattatttcaataccttcgtgaacgtactgcgagcaataataagaaatggctgccataacaagaaatgacttaacacaataagatgaagaataaatttcacaataattatgctcagtgaaaaacagaagaaaaaggacacactgtgattccactgctgtaatatctaggatatgcagctaagcaggcccatggtcaccacgatcgggtactacgctttggca

SEQ ID NO: 636824 - DNA, 490 bp, Homo sapiens
gctcctacaggtaagacatttgttgatcagtcccaacagcctagaattccctaaatgaatgtacatattaggtacttatccaaactctttccatctgaataaaataaaacgtggtgtctgaggttcattttttgttttatatctctccttgttgatttatatgtttagaaactagatatgtatatttgtctgtatgaatagctgtatatgctctatattgtattatactaaacatgtgtctccattaagtctaagctttcttttcctcatcacttcgttctcagaactcccgttctgacttatatttagcctggcaataggctgacgcatgtctcagatgcgagtacttacaccttttaacatagttagaattgggaatcccactcatcattcctgtttttatttgctctctcagaatggtcattgtgtatttccttgttgcatatgtggttactggccttgaactctggatgtagtggttatcaagaac

SEQ ID NO: 636825 - DNA, 146 bp, Homo sapiens
atgctgagcttacaggtttgagccactgcccctagcctaagttttgctaagttcctgtttactacattctaaaattttaaattgaatttctgtttttgggtactaagggtatttggtccgtgtgtttgtttatgtttttgttttag

SEQ ID NO: 636826 - DNA, 89 bp, Homo sapiens
ctggggggcgctgtgggcgagtgggcgcctttctcttcccattccttccccctacacccattccagacatcccagagttaacaaaaccc

SEQ ID NO: 636827 - DNA, 256 bp, Homo sapiens
gcgtaagtgggcatccgacttagaggcgtcagctcattagtccgcacggatggtagcttcgccccgttgggtcctcggtcaagcacatcctccagatgtctgaatcctgcggttccgtctcgtacggagcaggataaccatggcgacaacacatcatcagtagggtagaactaacctgtctcacgacggtctgagaccctgctcacgttcgcgctattagtgggtgcagccatccaacgcttggtcgcagtctcta

SEQ ID NO: 636828 - DNA, 181 bp, Homo sapiens
tgagctcggtaccctcatcgatcttgtccgcagcgccgggagcgatcttcttggcgaagtcgcgacaccgtcgagcaccttgtcgctgatgtctccgcctgctcgctcttgacggcctcggcgatcttgtccttgttctggctcgtacaggtctttgcccttgttcacggcgtcttcgatt

SEQ ID NO: 636829 - DNA, 183 bp, Homo sapiens
cgggggccgcgacagccgagtttcctgatgtagacgaggatggctccacaattccaaccttcacaaccccgagaaagggaatgaacttttgcaaggagttttagacaggcctattcttctagctggttgatgagcaccacactgacacggagctggagttcacagttgtgccctgcgatgtac

SEQ ID NO: 636830 - DNA, 1094 bp, Homo sapiens
tgagaagagcaaacaatactgctgctattaacacaaactgacgacagagagaaaagtagcagaaacacgatggcataggaaacactgaccaaagaaaagcctgaacacagagaggcatctagcagaaagcaaagaaaagcacttgatggagaaaaaaaataaacaatcagataacagctgaataccgtaaatcagaccacaggcacaaacactcaccgaaaaagacacggcagctagcatacaaacaggaaaaatctaccacgatacacgacacgtataactataactaactccaaacacatacaggaacgaaaaacaacatcaagtaatagtagacggtacataaagcacaacatgacacaacaccttatcccttaccagaaaaaacaaaagactgaaccttcgacaactccagatggacaccagacacacagactacaacaaacgactacacgattatacactacatacaaacgacaccgacacacacacatacacgcattccccattccacctcacactagcattacctcaccactaaacactctgaacccagcataagccctacaccctcaagtcattccccaagcatcccaagagagtacaccgacgctcaaccgacacagagggtaaggtgcacatgcatgcattcaactcgcaagcaccaaagctcgtgacccgacatgctaacgcccttacaggacctacgcacaccctaggaaaccagttggctacccatcagacacagtttagcgacacgaacactcaactcacaaaccaataaacagtgaaccgggtttgcgtaaacacccgaaaagctggttcagacaaaaaggagcctcaatagcccatacaagcagcaccacaccaatatattttcggcacgctcatctagagcacctcattgaattaatgatgttgtctaaaccaaatcattgataagaggacaccggcgccccccactagatgatgctagaccagcatgtgcgctgtgagcagcgtgatactccacagagaaacatgagctagccataatcaagtggtcttgtgttcgcaccgagcaaatgccccgtgtgcaccgaggtctgttgacc

SEQ ID NO: 636831 - DNA, 347 bp, Homo sapiens
  misc_feature (288)..(288): n is a, c, g, or t
cacgagggcggtgccaactcctcctgagttaacccattctgagcttcctgagtaaatgctatcgatgagcccggccccatgggatcccatgtctcttggggagatgggccccaagttccaataggacgatctggagcctcccacgggaagaaggccggcggggacgggctgctacgtggctccaccgcatccgcgactgccgaatgtggaatctcccacagggaaggggcttcgagggacgggctcctttccccagcaacacactgattccactgggaaaggatcggnggggaagggcttctcctgctgacagtttcctcgacggcaggattttgattttcccactc

SEQ ID NO: 636832 - DNA, 130 bp, Homo sapiens
tgtgtgccccagaactcagccgggagctgctgaggagagcgcactcatcagtgaaactccggtgacgttttacacgcagaggctgatccaaattcttcattgatcagagtaaaaagatgctgagaagtat

SEQ ID NO: 636833 - DNA, 191 bp, Homo sapiens
cctctgctgcgtcctgctgaccttcgggtcggtcagagctgacgataagttgatgtggatggtacagtagaagaggatcttgggtaaaagtagagaaggatcaaggacggatgataagtagtacagagagaggagaagctattcagttgatgattaaatcatcacaaataagagaacttagagagaaggtc

SEQ ID NO: 636834 - DNA, 143 bp, Homo sapiens
  misc_feature (14)..(14): n is a, c, g, or t
gccgccaaatatgnggagcccagacagaggaggcgcccagagcgagcgagggctgtgaggactgcctgcacgctgtcacctctcagtatctttataaaaggtaagatggcagacaggaagcaggactagcttgcagctacagc

SEQ ID NO: 636835 - DNA, 231 bp, Homo sapiens
agggcatgtataacatacattgcttggcaaagccatcaaccatattgctgctacttttgtttacaattcacataatgatgcattgaagacgtgtcttacacgaatttctggcgcttgcttcctccagtctactgaaaattggcccggatacagatttctctacgacaagagatagagaatctgtttatttactgctagatctgattgtgcctgcccgggtgggccgctcga

SEQ ID NO: 636836 - DNA, 375 bp, Homo sapiens
accgggacgtgtttcacgtgggaaggcgctccacgaatggaactgtcagcagccggcgcctgaagagctcctgccgcgggcgggcgcgaggcctatggcttggcatccgcaggacccaatggatcaggcgctcacactcttctcagtacatggtgtcagtgcaatgcctggcacctcctatcctgtaactggccgaatcggggtcccacccaggcttctccagcgcccgggaaggggctctgcttccggaagtgtttaggaagagatgccagcgtaaacccgagtcccttcctccaagcatcgatgaagccttttctcccctggcaaccgatttccttttccatggaaaggacgtcagttcttttagcttgttga

SEQ ID NO: 636837 - DNA, 178 bp, Homo sapiens
  misc_feature (163)..(163): n is a, c, g, or t
gagcgcgtgtaccaagtccaagacagaaacgcacgagttggccgatagattgagtagctcattgaactctaatcgactcggatcattccttctaaagagtctgaagcaattcactctagtccagctcttgtagtcagaatagcttgcgaggcaagcgtgcagngaggtgcggtaatcc

SEQ ID NO: 636838 - DNA, 697 bp, Homo sapiens
  misc_feature (15)..(15): n is a, c, g, or t
  misc_feature (78)..(78): n is a, c, g, or t
  misc_feature (357)..(357): n is a, c, g, or t
tcatgacattctaantcattttgcaattacatatgctacatagcttaaaacacaggtattctttattgcacatttcanagttgtaaggacgctctagcttaaaaggtgatttttatttagggaagaaatgacatttttgaattgtttggctcaaaatggcacactgccaaggcagcttagttctaacaacaaaccttttaaaataaacttttggattttgaagccaatgaaatcctttactgtaatggataatgcacagtacactttctttccaatgaaacctcagaggtcatagttttatgggctctgttttaaagcctgtgaacagtcctggctagtgctctgagaggcaggtgnaggctcatctctagagcctgacgccagtaagtctcttacagcaggtggtggtgggtattcctgggcaccatgggttagcggtggtactcgggttccatcaatgaagtactctcatggcaccagtgagcctataggtctaaatggtgcgtgtccaggtgaaaatctgcgaggatgaacaggcaggttccgtcctcctggtggaccgcatggtgctaattctcttaagcctagtggtgatcgcattccaggaccaaagggtgtagaaagtgcccgaggccctaaaggtccgcagagcttaggtggtggtccatatcgaatgggtggtggtacagggcctccg

SEQ ID NO: 636839 - DNA, 279 bp, Homo sapiens
ttggcgaccaaatggggcaatacagtatatcccatctctttagaaaaaagttagccaggtcaggcatggtggctcacaccggtaatcccagcacttcagtaggctgaggtgggcagaccacaaggtcaggagttcaagaccaaccgggctaattgggtgaaactccgtctctactaaaaatacaaaacttagccgggcatggtggcaggtgcctatagtcctagttactggggaggctgaggcaggagagtcacttgaacctgggaggcagaggtggca

SEQ ID NO: 636840 - DNA, 287 bp, Homo sapiens
catttttggccagctgtgtcggatccgacacccgggccggaggacgccgtgatccgggtggaggcgagcggcatctgtcggagcgactggcatggatggatgggggactggacctggctcgggctttcgccgcagttgcccatcacgcccggtcacgaattcggtggcgagatcgtcgcattggggcgggaggtgcgagactttcaaatcggcgacaaggtgacggtgccgtttcactacgcctgcggacactgtgaacactgccacgcgggcgtgccgaaccggtg

SEQ ID NO: 636841 - DNA, 481 bp, Homo sapiens
  misc_feature (78)..(78): n is a, c, g, or t
  misc_feature (98)..(98): n is a, c, g, or t
  misc_feature (219)..(219): n is a, c, g, or t
  misc_feature (309)..(309): n is a, c, g, or t
  misc_feature (334)..(334): n is a, c, g, or t
  misc_feature (369)..(369): n is a, c, g, or t
  misc_feature (417)..(417): n is a, c, g, or t
  misc_feature (420)..(420): n is a, c, g, or t
  misc_feature (435)..(435): n is a, c, g, or t
  misc_feature (437)..(440): n is a, c, g, or t
  misc_feature (443)..(443): n is a, c, g, or t
  misc_feature (453)..(453): n is a, c, g, or t
  misc_feature (471)..(471): n is a, c, g, or t
  misc_feature (473)..(473): n is a, c, g, or t
gaagatttacagaagccgagacccacagctctttttatcagtttccacctcaaaatatgttcccataaaaaattttgnagcatttgggtacaaagagnctggaaaggtattgggggagttgggggcctcacaccaagtctttactgtgatgtcccctggagatgctgattcccgtgcagagtggggtgttaatcagcagctgcaggggagggagaaggnaaggggcaggtggttgtgtgtgcgcatccatgtgaggtgagtgctgtgtctctcatttcatagcggttggatgattttgacctgccacantagtgtgcgctctccatccctgcancaagcatttcacttgcagaagatgctgtgccttgnaatattccctcctcacctggggctatatgaagtgcttatgcatatgtncantgtttattttagatntnnnncanttccttttanataaaccagtgagaaggntntgagttta

SEQ ID NO: 636842 - DNA, 757 bp, Homo sapiens
cctcctgccgttgtcatctgcacctacttgttcccaccttgggagaggacgatgacttgtggagtggactgcgtgaagggagaaggggtcctacccatgatggcttgagtgatgtgactgaaccttgtgatgcagatgtgaccatgtgctatgactgtgtgcttgaatgttgtgtgtgtcccaaaaatacacaatgtacacatgatgtgtgttgtgtgtgatgcgctgccatccacatatgcataccatgtgccgcacggtgagcccatggggtgtgacatatgagcactcgaaaacgcacaccatcacgaatgtggcatagaccccgtacacgagtatgtgacttggcacaccccaaggacaacaatgattgtcgtggaaccacttggatgaccatgagggtgatatatatgagtgccatattgtagaagggtggtgatatgcaacagcacagtgactgtgactttggggttcaccataaagtcccatcggatttggccgtatgggtggccacgacttaccgcaaattcaacttgggcgtcacaaatataatgggcagcaccaccgacacggtgggtcgactcccaccgagttaaaccgccaccaactgccatgtggaaacacatttggcggaccgattcgactcaatgggcgatggattccacctatatcctgagagccataccatattcgacagccaccagccaattcatatatcccccccatatctatccacccacatggtgggagcgaacgg

SEQ ID NO: 636843 - DNA, 302 bp, Homo sapiens
  misc_feature (78)..(78): n is a, c, g, or t
  misc_feature (98)..(98): n is a, c, g, or t
  misc_feature (130)..(130): n is a, c, g, or t
  misc_feature (155)..(155): n is a, c, g, or t
  misc_feature (190)..(190): n is a, c, g, or t
  misc_feature (238)..(238): n is a, c, g, or t
  misc_feature (241)..(241): n is a, c, g, or t
  misc_feature (256)..(256): n is a, c, g, or t
  misc_feature (258)..(261): n is a, c, g, or t
  misc_feature (264)..(264): n is a, c, g, or t
  misc_feature (274)..(274): n is a, c, g, or t
  misc_feature (292)..(292): n is a, c, g, or t
  misc_feature (294)..(294): n is a, c, g, or t
gaagatttacagaagccgagacccacagctctttttatcagtttccacctcaaaatatgttcccataaaaaattttgnagcatttgggtacaaagagnctgagcggttggatgattttgacctgccacantagtgtgcgctctccatccctgcancaagcatttcacttgcagaagatgctgtgccttgnaatattccctcctcacctggggctatatgaagtgcttatgcatatgtncantgtttattttagatntnnnncanttccttttanataaaccagtgagaaggntntgagttta

SEQ ID NO: 636844 - DNA, 352 bp, Homo sapiens
tccaaacattagccacctgggtgcgcttttcagtatatacaatctagcacaatgtcatgtcccctgcttcacccactttcggtcggacgtagtggccgacatcccagcacgcctgtcctcccagcactttgggaggccgacgcaggcagatcacgagcgcaggagatggcgaccatcctggccaacatggtgaacccctgtctctactcaagcaatcacacacattcagctgggcatggtatttgcgtgcctgtaatccccagctcactatgggaggctgcaggcaggcagcaatcgtatgaaccagggagtcggagctagcagtgagccaagcatagtgcccagccactcc

SEQ ID NO: 636845 - DNA, 186 bp, Homo sapiens
gctctttacggactccacttatgactgcctaaagcccatgtcgaaggccccatcgctgggtcaatagtattttccgcagtactcttgaaactaggcggctattggataatacggctcacactcattctcaaccccctgacaaaacacatagcctaccctttcttgtactatccctattagggataa

SEQ ID NO: 636846 - DNA, 629 bp, Homo sapiens
  misc_feature (3)..(3): n is a, c, g, or t
  misc_feature (18)..(18): n is a, c, g, or t
tgnctccgccgatcctgntgaggacaggctaagaggggagccgggtaccggttacgaacggttcagtcgcaacagtgcgcaagttggagcgcatcccgaaacgggaacgtgccacacgtacaattgcgccacaaaaaacagcagcaccatgaagtagaaattgcccatgaatgcggcaccgccaatggcctcgatcaacgagccctcacggctaacgaaatggtcacattgatctttgcgaacgggtgcaatcggtttgtctgaaagctccgcgtcgacgcaatcagtccaacggtaggtgccagcaacagttcccgcctgcaagctctgaattctttcgtgactggtgaccatgacactttcaatgactttggtcggcgagtagtcatttgccattagcaagccggtgagcagtacccctgcgggaactgcgatcagtcctaaccataaccgattgaatatcaccgtaatggcaacgaaaccgtccagaagccgcccactgaaggactcgtgcttagtggtagttgcagtcatgcttttccccttctaacgattaaacacgacgtgcaacccacgccgtggtgcagcggtgccccgatgatcggtgcggtggtttaaatcacggattc

SEQ ID NO: 636847 - DNA, 101 bp, Homo sapiens
cagtaagatggctcagttggcccctcaggacacagcaagcagggtgaagcatggggaagggaggaagttggattaatctgtggttggggttttgagggtgt

SEQ ID NO: 636848 - DNA, 311 bp, Homo sapiens
  misc_feature (17)..(17): n is a, c, g, or t
  misc_feature (205)..(205): n is a, c, g, or t
  misc_feature (207)..(210): n is a, c, g, or t
  misc_feature (215)..(215): n is a, c, g, or t
gctgccgaccgcggggnctgctcctgcgttcttggagctcctggcgcgtttctcggagctcccggctcctcagcgggtgggaacctcggggcccaggggtggagtgggcccggtggttggcgccggtggtataggtacggggcaggcgccgtggtcaggatccataatcggggtttggtctcagcatttacaaatgtgtttcagncnnnntgaancacattccttctagaaagtgcttgggggtttttgctgccctggaagccaggagcctgctcactccaaccacaagtcgcccttgacgcggcggccgc

SEQ ID NO: 636849 - DNA, 1184 bp, Homo sapiens
  misc_feature (375)..(375): n is a, c, g, or t
  misc_feature (428)..(428): n is a, c, g, or t
  misc_feature (460)..(460): n is a, c, g, or t
  misc_feature (516)..(516): n is a, c, g, or t
  misc_feature (592)..(592): n is a, c, g, or t
  misc_feature (701)..(701): n is a, c, g, or t
  misc_feature (779)..(779): n is a, c, g, or t
  misc_feature (822)..(822): n is a, c, g, or t
tactgtggctcacacctgtaatcccagcactttgggaggctgaggcaggcggatcacgaggtcaggagatcgagaccaacctggccaacatggtgaaacccccatccccaccaaaaaatacaaaaaattagccgggcgtggtggggggcgcctgcagtcccagccacagggaggccgaggcaggagaatggcgtgaacccgggaggtggagcttgcagtgagccgagatcgcaccaccgcactccagcctgggcgacagagggagactctgtctcaaaaaaaaaaaagaaagaaagaaaaaaggatagcgtagttgtcacactcattgtcccagctactcaggaggctgaggcggaaggactgcttgagcccggnagatggaagctgcagtgagctatgattaccactgccactgcactccagagtgngcaacaaagcaagaccttgtctcaaaaaacanaaaacaaacaaacagaaaacagcagtttgagatacccaatacaagtaatacagtantaattaacatattaagaagaaattttcactaaaagattgccacaagacttcttagacacatcatgacgtaaatggntgatataagtgtttattaccaggcgtggtagctcacgcctgtaatcccaggaccttgggaggctgagaccattctggccaacattgtggaaacccatttttaccaaaantccaaaaattacccggcgtggaacggcattttgaagcccagcaatcggaaggctgagccgaaaaacgcgtagacccgnaagccgaagcttcaagagcccggaccatgcaaccgatttcagnctgggagaaggcagactccttcaaaaaaaaaaataaaataaaaaaaactattggccgcttggccaagcgttttagacggcaaggtatttattcgcccaattggctcaattgcaaatggccttaaggggcgtttaaatcagggcccggtttacaagtgggctgggaacctgggttccaataaagctttggaaacccttttgaagtgcaataccgaagccccacatggcttcaaaaagtgccctttgggagggaaaggggcgtattttgaaaccgggaattttacttttttcacaggcctgggctctataactcttagggggccccgggcaccctcaattttttgtgggcgcggcatatcctct

SEQ ID NO: 636850 - DNA, 113 bp, Homo sapiens
ctgattgccacaatcatccctcgggtcgtcgcagccacagcagcgcggacgttgaggttacgcggcggtatgaaggaagccgtggctctggtcatatgttatattgggtcgta

SEQ ID NO: 636851 - DNA, 154 bp, Homo sapiens
ttgtagaacatacttctaggtggagcactgtgctgcgaaacttaaggataaatcagtgagctgcatgcacttaaaaggcgtggcctgtctcctcactatagtgcaaggtccatcgaccaaagccctgttctgatcaatactcatgtacagccag

SEQ ID NO: 636852 - DNA, 119 bp, Homo sapiens
  misc_feature (119)..(119): n is a, c, g, or t
gacagggctgacagactactcacccacttcgtcactgctacccggcttacccttcgttatgtctcctgggacttcccatggctaggaccccgatcctgggacaattctagagacccagn

SEQ ID NO: 636853 - DNA, 1053 bp, Homo sapiens
ttgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttattataaggctgtagtatcaggttaaggatacagataaataaagttcacttatatcttcttacaaatgtctgggttttaatatggttaatcacttatatacaaatattacaactttttagtgcaagtttttggaagaaaactttttgataaaacactgtgattgatgtgactttatttttaatttaaacgatgaggtggccagaagaaagatgggtctaaaatttctccccatgaaagatgtaaaactatggctttttttaaaatcaaaatttcatcttttaaaataatggtttgaaatactgtatggatctgaacagaataatcacatttaggattctatataaatctcaactggagtataatctgaaggaaattagcagtgtattttaagaaatatatttcaaaaatataaatactgattatgaacttccttttacatggtggttatttgtgccgattaggtttttggttggctctcttatgtgttgtttgggggagagggtgacctggaaagcacaagtgagtatttgacatattctgtatccttaatccaatcattggaaactaaagggttctggttggtacgaatttgataataaggggtaagaacttgggaaagacttgcctggtgttgattaagacgttatggtttttactgggctagagagtgttgaaactgaatagcttaataggcttgtgcatctttggacacaggctactacagcgggattta

SEQ ID NO: 636854 - DNA, 1058 bp, Homo sapiens
gcgcatgatcatggttggtcctgcggctgatgatgtacggatggttgagagcctcctgcggcacacgtctgtcacgcgtcctgaagcaactggtcacgatgccaattttgactgtgatgggtcacagtcaggatgcctcttcatgtcagtcacgttgtgacgtgacatcgagtgctcgaaatgatggccctgtcgactcgtccgcatgactgtaatgtttcacttggcagatgtcccatccctttgaccctccagtgttgtaatcggacccgaattgacgctgagttgtgtctgtggtataatcttcagcagcaaatacagtctccgggaacacacgaggagtccctgtcgccatgtggatagcagtcttcttcttggggaaggtgtgtttcgctcgccaaaggtgctggcgccgggatgatccactgtagcattcaccgtcatacctgtgggtgaatgcttggctccacacctatcgaagccccctgctctactgtgacctggatgagtgtgaaaggctttagtggccaccatggatgcagcgcctggtgcgcgtgcgtgcagatctgtgctggacacgtgcccggtgtctcacgtctctagataaccttggagtcctctgctgagaagctctgagggcccctcccttggaacggacctgtgagggtggctgggccctggagctgccccttctcatgggcttcgtgctgtattccataaaagattgtctgttgaggatgttcagtccagtggctttgacatgtgcccagtgctcatgaccgcctgtggacttgcgaagggtcacttgtaagttgtcgagtagattcatcattggaaaagcttgggcagaaagtatgccgatgtatgcccagctgggtcagaaatggagacccctacacaagttcccaagtcactctttgtcgaagcctggtgtcttttaggccaggctggggtgtaacatcttccatttaggtttccttttgaacaaaagggcctgtgggtaaaaaaagtttaaatccaaaaaggtaaaactttgaggaatatattgggggggaaag

SEQ ID NO: 636855 - DNA, 861 bp, Homo sapiens
aacattcaggactagtacgaggactggagtgtctaatcggccgaggcttgtatttagcctctggaaaggggtgaagacatcaggaaaggtatggattgatgccgcaactcagatatttatttccttgggggctggatatggagtattgatatgcatttgccagttacaacaaattttgacaacaactgttacagggatgccctgctgaccagcagcatcaacatgtatcaccagcttcagatcatactgtggtacgccatcattctccatcctatgtgttacatggcccatgaacacaaggtcaacattgagcgatgtggccacagaaggagctggcactagtgtacatcctgtatccagaggccatttctaccctgtcttggatctacattctagggctatgtattgtgtaataacagtacatgctcctggcgctggtgccttgacagctcaattgggagtgcatggagagctgtcatcacagtgcctggcagatgacttccagtgtcctgaagcgacacctggaaactcttacacatataggaagtcaaccttacagacacatttccttctcgaccctgttctgcataaccaaagggtaggaatatacgtctttgaccctcctggacaactattgcttgcaatggacaccatccaatactttatttggctgtccatcatgggaaagcccataccggaagatacctgcgattaatagaaagtgacagggtacaaaaacgaacatccagcagaaataatggggtacaaagccagactaatactggagaatgtcttgaaattcagtaaacctgctacccctgttagatatatatgacacatcataaaataagcatcactaca

SEQ ID NO: 636856 - DNA, 252 bp, Homo sapiens
cgccgcatgcttgagcacacatatgcaaattattgtgttatgctatagcaatgaacttacttgttctagtttctaaacgaaaacattgagtacacacacaggcctggaacaaagcttcccacttctgagactatttactgatcttcattattctcataagaatgctagatgaagtgctgtgcatataccataggctatggcaatgtgactgcatcttgagcctggactgagttatgtgtcccatactattaa

SEQ ID NO: 636857 - DNA, 624 bp, Homo sapiens
  misc_feature (71)..(71): n is a, c, g, or t
  misc_feature (218)..(218): n is a, c, g, or t
tgtctgtgtgtgtgtgtctgcatccgcatgtgtgtgcacgtctctggtgtgtggttgcatatgtttctgtnagagtatgtgtgtgtgtctgtgtgggtatatgtgtgcatgtctgtgtgtgtgtctgcatctgtgtgcatgctgtgagccggtgggtgtctgcatatgactgtcgtgcttgtgtgtctgtgtgcatgtgtgtgtgtgtgtgcatgtcnatgtgtctgtatctgtgtgcatggtgtgtgtcttccgtgcatatgtaactgtgtgtgcacgtctgtgtagtatgtccttgtgtgtgtgtctgtgcatgagactgtgtctgtgtccacatgtctgcaagtctctgtggtgtgtggttgcatatgtttctgtgaggggatgtgtgtgcatctatgtggatatatgtgtgcatgtctgtgtatgtgcgtctctgtgtgcccgtctgtgtctgcatttgtgtgtatgctgtgtgctggtaggtgtgtgtgtgtatgtgactgctgtggttgtgtgtccctgtgtgcatgtgtctgtgtgtacgtctgcatctgtgtgcatgctgtgggccggtggttgtgtgcatatgtgactgccgtggttgtgtgactgtgtgcatgt

SEQ ID NO: 636858 - DNA, 614 bp, Homo sapiens
cctttccttccagccaaccagcccctcccatgtgacatttggaccctgtcctgcggctccaactgcaaactgggctcctgttacaccactggaccagacccaccccactgccgccgctgcccagccctttcctcccccacccagactgcccagacgactacatccattttgcccaccagacctgcgctgccaccagccattgccactccactcgcatcccacccgacacgactgctgctcctagtgatctggaactcaccctcggaggtatttttggctggccacccgtccctggaccccgtgatcccgacacgctggccgccccccagggatctgtcaccttcagcgagacctatttcctccccacccccccggaacctcttgtgttcttgcctaggccccggtgttcctggcacgcccaatcgagtctctcacttttctcttgtggacccgttagttttgcccctaaacgccgtattctgagtttgccagctgtctctctgatgtgtgccttttgttccacaccgtaacccctgcattttgctctgctctaatacactacctggagaagtcttttccttattttccataaatgtccgaccttattggaaaga

SEQ ID NO: 636859 - DNA, 265 bp, Homo sapiens
atgtgcattattccccagaggagaccctgtgtgcattattcccccaagaggagatcccatgtgcattattcccccaagaggagatcccatgtgcattattcccccaagaggagaccccatgtgcattattcccccaagaggagatcccatgtgcattattcccccaagaggagaccccatgtgcattattcccccaagaggagaccccattgtgcattattcccccgagaggagagcccatgtgcattattcccccgagaggaga

SEQ ID NO: 636860 - DNA, 1746 bp, Homo sapiens
ggcagaagtcctggtaatctaggtccttgtatcccgtactggataccagcaaaccttcagacagcagcaggcggtggtcccatgaggcccgtggaaggagtcaaacttgcgggcaatttatgcacgaagctcactcggtatttcacaagcacgaactaacgcaacgaaacgaacacgaacggaacggaaagagcagcgatcgaccacgaatacacacgactgacacatccgtgataaaacacacctgcgcacggcacacaccccagaccacatggcaggagatagacaaccaacacgccattgagggaaaagcagccccaaaagcccatgaagcggcaaacacggccacgaacagccaggcacgagcacgccaagaccatcagacaggaggagaagggcccaaaaggacaaaccaggcgacaaaccacaacaacaagaaccaaccaaagagcgaacgtggcaaatgaccaaaaaaccataacatacccacagaggaacgcatactccaaacacccggacaacgcagtacagtacaccccagccaaaagcaaagggcacacaaatgcaaaagggacaacgcggtgacacacagccactcacctgggcaacaaccgacacgcaacgacgacgcacacagatagcacatagcatacagcacagtcgcagagcacactcaacacggcgcacggaaaagcgaccacagaaaaaagacagaaaaaaaaacagcaaacaaaacagagggggacagagccagacactcaggggacaaaaagcgggacataacaactaccgggagaaaaacacccagaagtacagattaaaaccgcacacacataaagtaaaacaaaagcggactacgacatcatcacacccactaatgcacaagcataaccataacgagtccgaatggaacaatacgaatacacaacaccagcagagacaagcaccaaacataaaaatacaacagccaatgcaggaaacaaagaacaaacaactagaagagacaaactaacacaacaatgagtatcataacatccacacccagaatagcgcgatagccacaagtaatatagacaacacagacatacaagttaacaccagcaaggcacagagccacaacaaacacaagaacaggccagcattatacacagaacagcaagccagacactcaccagcccacgtgcaagacgaaccaagtagccacagaataagcacacacaacgaggacacatacgacccggagacagataaagagaggacagcccacaaatacccaaacccgacggagcacgcaccgaaggactgcctaagacaatcgtaaaaccaacacacacatacaactacacaaaccaaatcaagacgtacacagacaacaccgaagagacaccactagaggaccaacgacgactaaatattaatcaacaacgcgagcacaccaaaggtgtggacgcacacgaaacagtagacatgagaacagatcagacacagcgaaatagcaagacagctgcaacaaacgagaggtgaatacatggctacatagacgcaacacgtgaacgacagacaagatggctgagcagagaagtgcaaacgaaagcagacaaccacagcatgcgcgcggaagagacgcacagagagctgcagcaggacaagacaacaactggagaggacgagaagaaaccaacaacactaggacacggcaaaacgacatacccagctacacagcacatccgcacaaaagcagagaag

SEQ ID NO: 636861 - DNA, 122 bp, Homo sapiens
tgtatctgtatatgatctatccacagggccacctgactaccaaagtgaacatcctaggtatacagacccctatgccgccggaggatcctactagtagtcagacctgacaggcatagcaagct

SEQ ID NO: 636862 - DNA, 547 bp, Homo sapiens
atagaataacgggtacgcacagaaagcagagcaagacaagagaaggagaagacacccccatggaaacccattgatggaagcgcctcgaagtgccgcaaccaggcaatacggccataagggccgggggagacatggcgctagcaagcgtgttggagagaccgttaccggagaaccagcgcgggggctacggactggggggtcgtgcagaactgctggatcaaggtccagggagcctcagggatggcctgagcctggccgcgccaggctggggagacccagaagagccaggaatcgaaaggctccatggaacaaccacccgggccttaaagtcccgccatggagacaaagttgcagctgactccagggctacagcgggagctaacatggccacccagaaggtgaagaaggtgatagagatcaacccatacctgctaggcaccatggctgggggcgcagcggaatgcagctactgggaacggatgacggctcggaaaaggcaaatctacgagctacgaaaaaaggaacgcaactatggagcagctggctc

SEQ ID NO: 636863 - DNA, 867 bp, Homo sapiens
gtggatgttctgtggaggaagcatcaaaggagggaaaagttgagagacagagagtcgttaggaggctatttcagtagagaaggagaagaaaagaacggagaaggaacgaagaaccaaaggaggaggaggagaaagaggaaaagaaggaggaacgaaggacgaagaacgaaacgaacgaacaggagaaagaactaagaagaacaccggacgaggaacgaacgaacgaacggaaaagaacgtggggaaccgaacgaacggacggacgtgacgaacgtgaacgaaacgaacacgaacgtgagacaccgaacgaacacgacaacactgacgacagaagtgacgacggacggaacgaacgaacgacgaaaggacacgaacgacacggaaacacaccggacgaacgaacgaacggaaagtgacgacacgcgacacggaaggacggagaaaggacgaaagacagacgaagcgacggacgacaggaccgaaggaacacgtacagaagaacggagaacgacggtgacgaaggaacgaccaacggaagaacggaaacgaaaggagaagaacctaacgaagacagaaccggcaaggacggcagacacgacaagaaactaagggaagacacgaaaagaaacgcaacgcgaggcacagaaggcaaacacggacccaacaggggacaggacacgcaccgaccggcaccggaccggcacagaaacctaacagacagcaagcaacgggacaccggaacgaaagggacgcacacccacaccagcacccgaacagggacggaggagacaggacaggacgaagggcacgcaaccacaacaacgagcgagcacccgcggaacggacgcagcaactcacgccgaacgc

SEQ ID NO: 636864 - DNA, 222 bp, Homo sapiens
gatcccctataagtgcatgatcacttaacctttatgttgtgtgaatagttgattatgatacatttcttcagaacatttaatctgtcacttttatcctttgtcatttgtgagctatatttgtacagttcctcatgaagttgcatctgagatgtgtgtattttaaaagattatacaagggttaaattcagcaatatattaacctatcgattcatgaagatgaga

SEQ ID NO: 636865 - DNA, 472 bp, Homo sapiens
  misc_feature (46)..(47): n is a, c, g, or t
ccggaccacgctttgttcgcatagctttttgatattcgttcacatnntgtgtgtattattggtttgtttttttaaatactaagttgaattattttgtttatccattcagctataggcagacattgggttgttttcagtgtctgacttttatgactaaatgcaccatgggcattttcatacaagttatttttgtagaaatatgttcttattccttttgaggaaatacctaggagtaggattgctacatgctactgtaagtatatgtttaagcttacaagaaattgacaaactattttccaaagtagttgacgactttacaattcaaccaccaaggtaggtatgagagttccagttgttccatgtccttgtcagtgcttggtattgtagctcttttaaatttcagccggtctagtgggtgtatagtgatagcttattgtgatttttatttgcatttctctactgaccaaagctt

SEQ ID NO: 636866 - DNA, 199 bp, Homo sapiens
  misc_feature (9)..(9): n is a, c, g, or t
  misc_feature (43)..(43): n is a, c, g, or t
  misc_feature (51)..(51): n is a, c, g, or t
  misc_feature (72)..(72): n is a, c, g, or t
  misc_feature (94)..(94): n is a, c, g, or t
aatggtggnctgcctaaaagtctttggccccctgccttgaggnattgaggnggtcccttcacaggggtgggncccattcacagccccctcctgnccagtctgcatgctgcccgttcctgttcctgtgttcaccacatccccacaccccattgccacttatttattcatctcaggaaataaagaaaggtcttggaaagtt

SEQ ID NO: 636867 - DNA, 216 bp, Homo sapiens
tgatttaagattcttctcggcatttatttcttttaaaaaatattctacttttttgcaaacatgtacatattttataaaccactgcacacttattatactgtatggtgtcacaagggtgttttttttttttcttacttgtaatgttttgcctatctttagagatagcttgacaagttaattaaaatcaacttatgtcccaacattttgttgcagtag

SEQ ID NO: 636868 - DNA, 170 bp, Homo sapiens
  misc_feature (9)..(9): n is a, c, g, or t
tcgtggtanaaatttttattaatactgggattatagctaataggtttatttcgaatccgtttcagatgagtagtcagtgtgagctgattattactagtatggttccggacattactgttatgataagggtagtgtacgataatgggattaattagtatgggaagggtatg

SEQ ID NO: 636869 - DNA, 119 bp, Homo sapiens
attcggatcccctgaaggcaacgtcttttttatctgttttgatgacatctttcaggaggggaagggcactttcttgcagttccattacgacaccgtccaggacacccatcatgggggtg

SEQ ID NO: 636870 - DNA, 1126 bp, Homo sapiens
ggctaggggcttaagcggagtggagtcgagccagcgtcgccgcgatggtgttagttgtgagagctgagcagttcctgactggagctgaccagacttttccagaagtgcctggacgtctgggcagctgtctatatcaccttgaagaagtatgactggtctgaaccaaacccattccaaagaagggtactgtggagggcttagagcccagcagcacaacaagtgtctgttcaagagctaccgatgggcaagcacagcacagatcagccactgtggtgcagctccaaggaagtgaataagtttcagcatggcttattcaaacctccttagagctaacatggatgggctgaacgaagagagacaaaaagaacaaaactaagacagaccaaagcagcagcagcagcagccagcagcagacacactgccgcagacagcaacagcaccaacagacaagcagcgaacaacagcagacacagcagcacagtaaagggcatacatttcctgctttcagcaattaaccactgacttgctattttttccttcttggaccagcatagctagagttacttggtacccaccaacagaaaagtgtatacaacattaagattcggggtccattatggaaacagaatagtagcagatgtaacaacgggcatagatagtggtaagaatctaaattaagacgggctattgggctacatcagggtactgttgattggatgtgtatatcataaatcataggaataaaatgattaaaatgtatactgtaaaacattcactagtgaagagcaaagcaatagttaaagattgtcaggcaaataatgaaaaaaataacaaaggtagagacagaagaaagacggaagcgcagagaacaaagcagaaataagaaggaacacgccacacagggaacgagaccaacagtatgcggacacggcatacatggcggatacccaaaggaaaagccaaaaagggagacagggacgagttcagacaagagagacaaacaaacgaggcgagagggagaaagggggacccagagagaaagaagaaagcacgcaacactcaaaggacgcacagagcacaaacaagcaaaacagacaacaacgacaaaaacaaacagacagagaaa

SEQ ID NO: 636871 - DNA, 242 bp, Homo sapiens
aatttataaactagccatggcatcccgcttatgagcgggcacgaggattactaggcttatcgcgctaagattcataaatgtccctagcgcactatcttaccacaagagcacaccgtacacccctttatccccatactagatattatcgataatcatcagcctaatcattcacacacaatagcccttggccggacggcctagactgctaagcattacctgcacggccagctcacttcatgcat

SEQ ID NO: 636872 - DNA, 213 bp, Homo sapiens
gtggactccgatcatcgcacccagagggaaagaagtcagttatacggtgaaagatacgtgcacacgcatgtttatagcagcacaattcgcaattgcaaaaacgtggaaccaacccaaatgcccatcactcaatgcgtggatcaagtaactgtgatatatatacatacaatggaatactcctcaggccataaccggagtgaattactggccttc

SEQ ID NO: 636873 - DNA, 455 bp, Homo sapiens
  misc_feature (21)..(21): n is a, c, g, or t
  misc_feature (39)..(39): n is a, c, g, or t
  misc_feature (451)..(451): n is a, c, g, or t
  misc_feature (454)..(454): n is a, c, g, or t
gggaatggggcacgccttccncaaagatgagggccaaanggagcatgtaggacaagtagagagaactttccaaaagtgagaggagagaatttgaaggctgcatcctgatgttccatcatccttattttaaggtcactgtttcctcagtgggcacgatgatatttgatgtagggggcacttctttgggtgagactgtccctcccattgcaggatatttagccacccacatcacaagtggtaccatggtgattgtgatacccaaaatgtctccacatttctcaggtgaggaccctgctggaaaagccaccagttagcccggacacattcgtcctcacttccttcagtacttcccactcgtaagagctttgaaaattcagaagggcaatctttggcagatttgttaaggttttttaatatagccagtaatgttccagaatctgacatgtgaagnttnc

SEQ ID NO: 636874 - DNA, 201 bp, Homo sapiens
ctctcggtgcagcgggacaggcgaagcggctgcgcccacggagcgcgcgacactgcccggaagggaccgcaccttgccccctcagctggcccactcgtgatttccagcggctccgcgcgcgcacgatgccctcggcaccagccacagcgggagcggagcaagtcgtccggaccgccaccgccgtcgggttcctccgggagt

SEQ ID NO: 636875 - DNA, 205 bp, Homo sapiens
ggggccccccccccccccccccccccctttttttgggtggggggatttttttaaaaaaaaaaaatttttcccccccccccggggggggggggtttttccctcttttttttcccaaaatttttggtcctttttttccccccccccccgggggggggggtttgttttttttttttttgcccccccgttttttttttttggggcccca

SEQ ID NO: 636876 - DNA, 208 bp, Homo sapiens
cctttaaaaaaaattttttagccccccctgttaaaaaagggccgggttttaaacccccaatggaaccaattttttccaaatgaaaggggaaaggggaattgggcccctttttttccaccccccccagttgggtgtttttaaaagtgaattaggggggtttttccccccccccccctttccaaccctttaaaaaaaattggatttttta

SEQ ID NO: 636877 - DNA, 135 bp, Homo sapiens
tggatacggcagtgaatcgagctcggtaccgatagtacaaggaagggaagggggagggaaacggggacaacctgcgctgctgcttcggctcctgttcactagtggttgctcagtcataatcgccggtcacgagat

SEQ ID NO: 636878 - DNA, 339 bp, Homo sapiens
  misc_feature (26)..(26): n is a, c, g, or t
  misc_feature (238)..(238): n is a, c, g, or t
  misc_feature (253)..(253): n is a, c, g, or t
  misc_feature (321)..(321): n is a, c, g, or t
gatcctgtctcaaaagaaaataatantaaaaattaaaacctgggtatagggccgggtgcattggctcacacttaaaatcccagcactttgggaggccaaggtggatggatcacgtgaggtcaggagttcgagaccagcccgaccaacatggtgaaaccttgtctctactaaaaacacaaaaattagccgggtgtgatggcacgtgcctgtaatcccagctacttgggaggctgaggcnggagaatcgcgtgancccgggaggcggaggttacagtgaacccacatgggcgccactggcactccgagcttggggtgattagnagtggagactctatctca

SEQ ID NO: 636879 - DNA, 439 bp, Homo sapiens
  misc_feature (81)..(81): n is a, c, g, or t
  misc_feature (119)..(119): n is a, c, g, or t
  misc_feature (142)..(142): n is a, c, g, or t
  misc_feature (189)..(189): n is a, c, g, or t
  misc_feature (192)..(192): n is a, c, g, or t
  misc_feature (215)..(216): n is a, c, g, or t
  misc_feature (317)..(317): n is a, c, g, or t
aatagctaggaaaacacagggaaagaagagttttgagcagggcttagttttagaaaatattaaaacatattatgaagcgtntgatatttaaacaggatggggttggtaagtaaataganaaatgcagttaggtggctctttnaaagagtgtggggaaaaaaagtagtaaaaagttaaatgcaatcaatnagnaattgaaagttaagtgagagagnnagagggcttctttggtggtaaaagagggttgcatttcttgcagccagaaggcagagaaagtgaagaccaagtccagaattgaatcttaagaaatgcaggantgcaaagaaattggtgtgtgtgtgtgtgtgtgtgtgtgtgtgtgtgtgtgtgtgtttaatttttaaaaagtttttattgagatacaagtcaataccataaagctctcacccttttaaagtgt

SEQ ID NO: 636880 - DNA, 320 bp, Homo sapiens
gattttcaatccaatcatctgacactcagtattcaccatcacagatggagtcttgctatgttgcccaggctggtctcaaatccctgtccttaagcaatcctcccctcgtcacgctcccaaagtgctgggattacaggcctgagccactgtacctggcttgttttaatcttttatactgcatttttactgtacttattattattattattattatttttgagacagagtcttgctctgtcccccaggcaggagaatcgcttgaacctgagaggcggaggtggcagtgagccgagatggtaccactgcactccaaccagggt

SEQ ID NO: 636881 - DNA, 842 bp, Homo sapiens
tcaccgcggcacgctgtgcagaagtttctggttcataattgccgccccccaatgtcgtttccacggggaacccggagggggaaaaagcgccgcacaccacttgtcgttgtgccttgaacagcgcccgttccgctttgtacactattaccctccggggttatgtcgataacactgagtagccgcgggttcacacacaagcttaaggccttgtggaagaattgtccacagccgccacgatgaatacacctggacgtcgtttaaaaagtcgttaatttccccaaggtaccccgacttgtgcgacagcgtttgcccccttgtcagtgttgggtaacaggaggcccgccgcccggagcatggctgttaaacagcagctcgcgggtaccactagaaacgtgtcaccaccagaaatgtgtgttaaatttatcatgtagaccgcacacacgatgcggatggacgcacgctacattgaggttaggtgttactcccgcacacaatattgttacccgcgagcaaggatcttatgagaacgccccgcggtttgtcaaataaaatatatagaagacattttgtgtgggcggcgaatttgttcattagactccctgtgctccaaaagccgtgtttttcatatggttcacacacagtcgccgcacggccggcgaaaataattctgttttaccacacgccttatgtgtgtctgacccacgcccccgccctgcttagatgcttttacaggcgaagcccaccaccaacgaggaaacatgtggaggctacgggataagagaggacgtttaggaggggttaaagcatggttcgataaaaaggcgaaaataaatagtcgagaa

SEQ ID NO: 636882 - DNA, 319 bp, Homo sapiens
ctttggggtctttgcttataatcttcctttagtgcacatagacagtgactgctgagaatgatcaagtaaatgggcttttgaacaggtaatgaggaaacaaagaatcaaggtatccctgtggaatagagctagaaaggagtgcccacacccatagggttatctacaatagctactcggccataaggaccccacggagacagaccacaaatgtatgagcagcacacttctatgatcaaactctacctctagcaaggcgtatcaacagtcaagttctattgaaagcattcgctcgtgtctcctgtcagacatgatgaaataa

SEQ ID NO: 636883 - DNA, 190 bp, Homo sapiens
ccccggaaaggtggcccatttaattacactcctttttccggggccaattatttaaaagggtgggacattttcttaagggagaatccttccacttccacttccagggggaaggaaattcaaacttaatggtggttccatgccttttcaacatttttaaccccctggcattattttggatccttagggtttt

SEQ ID NO: 636884 - DNA, 305 bp, Homo sapiens
ggcctctaccgagataacagcaacgagctgagctgctgtgacagaggggaacaagatggcggcgcctgaatggggagcctctgggtgaggacccaagtgaggctcccgctgctgctgctgatgaccatggccttggccggagtttcggggaacgcttcggctgaagcatttgactcgggcttgggtgatacggcgtcttgccaccgggcctgtcagttgacctaaccccttgcaaacctaccctaaggaagaggagttgtacgcatgtcagagaggttgcaggctgctcccactttgtcagttgg

SEQ ID NO: 636885 - DNA, 561 bp, Homo sapiens
ggcgcataggtgtgcaagggatgcacttataggatctgctgttacaaaaaatatgagaatctggctggacgcggtggcttacgtctgtaatcccagcactagggaggctgaggtgtgcggatctcctgaggtcaggagttcaagaccagcctgaccaacatggagaaaccgcgtctgtactaaaaatacaaaattagctgggcatagtggtgcatgcctgtaatcccagctacatgggaggcttaggcaggagaatcgcttgaacccaggaggcggaggttgcagtgagccgaaattgcaccgagctgagattgcgccattgcactccagcctgggcaagtaagagcaaaactccatctcagaacaaataaaagaaagggtgatgactgtcagactatagagatgagaatagagatagagtagacggaaagggcctcaagtcaaagggggatgtccaagatcatcagtcataacggaaaggcccatcaaaaccaccaagagatgccacttcaaacccattaggatagctatagtacttccttttcactggaccccagcacc

SEQ ID NO: 636886 - DNA, 566 bp, Homo sapiens
  misc_feature (557)..(557): n is a, c, g, or t
gagttatgaactgctcctcctctgacctgcagtgactgaatcacagtttaggtccctgtctagcaggggctgaggtgtcaggaggggacttctggcccaccttagcgttcaggcctctgtgagtgggcatgcagcagatattgtggggaggcgatggccagatgggactagtgttccctcctatctggccacggcgttatgcggcgatggggtgggccggggtggtcctggctggcattgcctgagccggcagtgatgaagtggggagctttgccctttgacaggtggtgggctggtctggggccttaatgtgaaaagacgagtggcaggcagctggagtagagcgagcccagcagccctaaaaggctgcttcatggccatctagtccccagttcagggcagcatccaatagcccacaaggccagcgtgggtggggcgggggtggtcccacagctgggttccacctgaagagcctccgtgcctcggagcatggagaggcaggctatgggtggcacctctcccgtcctgccctgtgttcccagttgaagaacctggancttgagtac

SEQ ID NO: 636887 - DNA, 109 bp, Homo sapiens
gacagcccagaggaggggccactgtgagcgcgcaggctggcttcgtgagcagcaggacgaccccagcaccccctgtgtcagctgcccctcttgctgtccacctcctctg

SEQ ID NO: 636888 - DNA, 356 bp, Homo sapiens
tctcaggatctcacgtaatatgtacatatcacggagaataacagtgagatacttttttatatgataggataaaaaataagtgcagtccttaaattgccagtgaaaatttaccacataatccattgtataggcccattaatggttattgaagttgaaatttagcagtacccagttattagtctaaggggtgggtatagagggaagtataggaaagtgctgcaggaaggaaaatgagaaaaagtttccttcttctttttctagattgtacatacaatagacccccatggctaaacaaacttggaaatgtatcagggtttattattggcatcctgctagtctctattttggtttctctt

SEQ ID NO: 636889 - DNA, 212 bp, Homo sapiens
  misc_feature (18)..(18): n is a, c, g, or t
  misc_feature (36)..(36): n is a, c, g, or t
  misc_feature (91)..(91): n is a, c, g, or t
tgttcctggtctacccanggtggggttacaatctcnctccctccatggaaagtgaaccagaaatggtccaagctgtgctgtcccttcgtgnaaatggtctgtattctctgcttgaaataggaaggtgggatttctggggaggctggtgaaggaggcagggtcttttctcacgtgtcatgttaaaattgccaaataaagtacctctgcctgtg

SEQ ID NO: 636890 - DNA, 740 bp, Homo sapiens
  misc_feature (62)..(62): n is a, c, g, or t
  misc_feature (65)..(65): n is a, c, g, or t
  misc_feature (67)..(68): n is a, c, g, or t
  misc_feature (73)..(73): n is a, c, g, or t
  misc_feature (104)..(104): n is a, c, g, or t
  misc_feature (106)..(106): n is a, c, g, or t
  misc_feature (113)..(113): n is a, c, g, or t
  misc_feature (116)..(117): n is a, c, g, or t
  misc_feature (139)..(139): n is a, c, g, or t
agagaacaggagaggagaaaacaaaaggcacccaccccatggaaaacccatggaaaggccgnagngnngaagnagaggaacacgggaacccgcatgagaacgtngnaaaagcnggnncaagccagtaagcccagcaaanagggaggcaggggcaggagaaaagaaagagttcaggagaacaagaccagacagggcaacaaggcaaaacacagaaacaacgggaaaaaaaaaaaaaaaaagggaaaaagacaagaaaaagcaaaggaggacgaaagaaaaagaagaaagaggagcaaagaggccaggaacagaggcaaaggccagaaaaaacaacacaaagggaggcgaaggagggaaaagacagagaagccaggaggaagagaccgcagagagaaaagaaagagacaaagaaatccagacagggagagagagagacacccaacgaaaaacaaagaaaaaaaaaaaaagacaagaaaaaacaaaagaaaaagaaggaaacaaaaaaagaaaaggagagagaaagaaagggcaaaggcaaagaaaaggacgaaaaaggcaaggggaaaaaggaaagggaagaagaaggcgaacgaaaaagaaagggaagaagaaagacagggacaagagaaaaaagagcaaagggggaaaaaaggggaaaggaaaggaaagaacgggaaaaacgggaaaaaaaaaaaaggggaagggcaagacaaaggaaaaaagaggaacaggggagggcg

SEQ ID NO: 636891 - DNA, 326 bp, Homo sapiens
attagccagattcatgtggtattgccaagtaaagccacgtggtgcagggacattcatccaagatggatgtccatcacgacttccccaacgcacaactgagttaacaaagccaacatggtcattttctgtaatgaaatcaaccaagtattttagtgcatcaggttcagcaatggtatcatcatccattaaccaaacataatcatcttgcgtttcttcagcgcataggcgcacggccttattaaaaccaccagcgccgcccagattctcttcagagttatagacggtcactcttggatcagtcaccgttgccaagtattcagcggttt

SEQ ID NO: 636892 - DNA, 139 bp, Homo sapiens
gacatatacgaattgagctggtaccccccgactagcccgacagcgtagttctacctctgaccccagcttctctctggttccacaggccccatgcatctccctgcctcactcccctcagcccctgtcgggctagtcgggg

SEQ ID NO: 636893 - DNA, 382 bp, Homo sapiens
  misc_feature (291)..(291): n is a, c, g, or t
  misc_feature (343)..(343): n is a, c, g, or t
ggggcgggcacctgtaatcccagctactcggaggtggagtttgcagtgagcttagattgtaccactgcactccagcctgggcaacagagtgagactctgtctcaaaaaaaagttacagcaagacttttctttttgagacagggtctggctctgttgcccagtctggagtgtggtggcatgatcatagctccttgcacctttaacctcctgggctcaagagatcctcccacctcagcctccccagtagctgggactaattttttttttgtagtgatggggtctcgctatttntgcccagcctgggtctcgaacttctgagctaaagtcatcctcctgccttggnctcccaaactgctggggattgcaggtatgaggcagcctc

SEQ ID NO: 636894 - DNA, 573 bp, Homo sapiens
  misc_feature (573)..(573): n is a, c, g, or t
gtcgcattggggaggttcctgctataatattgccgcacggtgagccggagaggtccgctccggggtagaggtacgaaggaactaatataagacatctcatctctgtatggactggggatcgagagatgcagtgaaaagagcagagaatgcacttgttggctggcctctacttacttggaatcgactactatacctgcacatgacggaggtgtgtaagtggatgagtggagataggataaaattttcacgtggacaattgtcgcgctagagagttatgtggagtattagtagcgtgctaaagtggcgaatgcttatgttatcacgacagcatgcgtaacacagcacgcgcctcatgtggggcgtcagataatttcgcaaaagatgcattctgtactttccccaacaggcacaccatcccacgtactgcgcgcactgcgctccgcgccccgtctggtccgggctgcgggcatactcaatatgcgctttaatacggaggtccccaccaggtccatggtctgctggattcacccacccacaaaggggcagaggcatccgcagtcgccaccgtggaan

SEQ ID NO: 636895 - DNA, 207 bp, Homo sapiens
catcgctaattgacgttttgaatatttcattgtttctaattgttactacagatacagcggggtgagcaactcgtgtgtacataggtttatctcctactggaatattttctttatataggcgttttttttttttctttttttttttttttttttttttttttttttttttttttttttttttttttttgtggggctttccccccttta

SEQ ID NO: 636896 - DNA, 458 bp, Homo sapiens
tcaacacatcttacctccactaatgtcagtggggcccagtggagaactgagccttcactcccatctggcaagtgatgggtggcagggctagttggcattctgcttccttctctaccctcccctgttgttagctgggtcctttggggagctgagcttttggctttatagtgcagcaacaaagaagtttgagtcagccctctgctttcctcctccctgtcatcagtggggcccagcagggaggtgagcttacacccctactcagaggcagtgaggtgatacaggttggtgccctactttcattgggactaagagtggagctgaacttccgtcccacccatctgcaacaaaacagtgtgagtcattgctccacttttgcctgggtgatgttggtgcggcccagagggaagttgaacatacacactccacctcaacaggaggactgcctgcttcggggaaaa

SEQ ID NO: 636897 - DNA, 861 bp, Homo sapiens
cagtcctcaggtgcaaccccctgcgtggtcctctgtggcagccttctctcattcagaggctaaaaagaaaactcagtagaagataatggcaagtccagactggggatatgatgacaaaaatggtcctgaacaatggagcaagctgtatcccattgccaatggaaataaccagtcccctgttgatattaaaaccagtgaaaccaaacatgacacctctctgaaacctattagtgtctcctacaacccagccacagccaaagaaattatcaatgtggggcattccttccatgtaaattttgaggacaacgataaccgatcagtgctgaaaggtggtcctttctctgacagctacaggctctttcagttccattttcactggggcagtacaaatgagcatggttcagaacatacagtggatggagtcaaatattctgccgagcttcacgtagctcactggaattctgcaaagtactccagccttgctgaagctgcctcaaaggctgatggtttggcagttattggtgtttgatgaaggttggtgaggccaacccaaagctgcagaaagtacttgatgccctccaagcaattaaaaccaagggcaaacgagccccattcacaaattttgacccctctactctccttccttcatccctggatttctggacctaccctggctctctgactcatcctcctctttatgagagtgtaacttgggatccatctgtaagggagaagcatcagtgtcagctcagagcagctggcacaattccgcagccttctatcaaatgttgaagggtgataacgcttgtccccattggcagaacaaaaaccgggccaaccaaacctctgagggcagaacag

SEQ ID NO: 636898 - DNA, 190 bp, Homo sapiens
tggacaagatgcgtgatcatctcattgctaagaacgtggctgcagacattgccgtcagctctgtgaatctgttgccaacaagttggaaggggaggtgaatgggacggtcagcaaggttactttcacagttaagcaagccctacaagagtcccttgtgcagatatcttcagaccacagcgcttgtgttgga

SEQ ID NO: 636899 - DNA, 141 bp, Homo sapiens
tgctcgctccgtgcctggcagcgcgtgcctaccacgtcaaccgcgacatgccccgcgtgagcgcggcggcggtcagcgcgagccgggcgatccggccaattccgctggtggcggctcgctggcgatgcggctgacgcgcat

SEQ ID NO: 636900 - DNA, 291 bp, Homo sapiens
cgaacttttttcatgatccactgatcaaaccccacaccaccatctcactgacaccatgttcaaccatgtcttttacttaacaaattccaggaactggccttaggaaatccaagtatcaaaccaaggttgtggagtattccacctcaggaaggaatgctgaacaactgatttacagacttgttgccccagctagaccaccaggtagcccattactcaaggtaaccattacaaccaaatagtgcttacctgcataccctacccctcacatgctttgccaagccccagctgcgg

SEQ ID NO: 636901 - DNA, 107 bp, Homo sapiens
gatcccctggtttgcgtgtcacttactgctgagtttctctcctccattcaccatgtggtcagtcctagaccaggtgtatgtgaccacaagctgaccacgcaaacgcc

SEQ ID NO: 636902 - DNA, 172 bp, Homo sapiens
cacctccagctagcgggatgtatctgtgtcacaagctgaattctcagtaaagaaagctgagcagacactaaacaaggatgttactaaaagacaatgatttgttaaaattataaagcaatcatcttatggcctgcaagacagtcacacattacgaactctccaccacatgcgg

SEQ ID NO: 636903 - DNA, 571 bp, Homo sapiens
  misc_feature (29)..(29): n is a, c, g, or t
  misc_feature (564)..(564): n is a, c, g, or t
agttcgacggagactctcagagatacatngggacagccgtgcctactttatattaagacagtgggtaggggccgagactcagccagtgataacggattacatatcggagtaacagatatacaatcatatatacacagatacacactcatgccacacacgaaagaaatgagaagagggagaaggaacaaattttggaaaacgatgccacggatgctacactacatgaaactacttgagtttttttagcaagcagtaatttccaggcctttacatgatattacgtggttgatggttcacattattagacagccaggaggtcaatcccgaggccagaacaagggagggttgtaaaggcctcatggtagcacaaggcctgagcttcaacagagaagatacaatgtttatgtgaatgctggtgtgcccaagtgtgatctagtctcttcactgactactctgatgtgtgatgagaatatatatattatcctctgactggcttgaatagttaagacaagtccgaaaggtaagagagtggtttcacatcgtcatgtggttctgaaatgaaancatgggg

SEQ ID NO: 636904 - DNA, 1018 bp, Homo sapiens
tttggggcctgtgcgccggggtgccagacgacgcggggtggccgcgcgatttctcggtcgttgtccgcgcccgccctgccgatgtgttgggggcgcggcggcggctgctctccggggggcgggcgacggtgtgttagtggagaggggttgttgttcacgcgacgggcgccctcttgtgtgatgcggggcccgcgccgcgtggtgtcggccttctgtctgtgtgtgtctcgcacgacggtgacgcccgagctgcgcgccggaccgtccttgtattgtggctgtgtgtgggacacgcgcgccacgggggaggcagccacagcccacgcactgccaccacggcggggtgctgcaacatcccacgtgatgtgttgtggttggggttgcacttaaggttgatccgaccctgggggacggccaccccttcttggtggggggggaccacagacaacaggttgcggttggggggggggtgtgttggttgttttctgtccccccccggcggcctccgccgcgcgggcgatcctctatgttgggctcggtttgttctcgcctctccgcgcggtgtttttagagaattggttctctggctggcgctaccgtcctcccctctctcccctccccctcctttcggtggtgactagcctcgctctttcgccacgacccaggagtagttgggtggcgtgccaaggatggtggaggagcccccggcgcccccttccctggttgcttcttcgcccccacgatgttagcgtgggggcacccaagaaagtacttatgtgaggttgaggaggcgcacgttttccgccgatattgtgccgcccgccgatgctgttggggggggcccccggccccccccgcgccggttgtgggtggtttcttttgggcgggggccgcggggggggttaaccccccccgggcgccccgatttattttttaatatttctcccccccccccgggttttttgggaacgacacgaaaaaagaggttttttttttcccccttttttttaaaatagga

SEQ ID NO: 636905 - DNA, 109 bp, Homo sapiens
ggtcattctagcaggatcccagccttcatacctctctcacgacaacgcagtctatgagaccgagctgtagatccaggggtaccgatgcttacgagattcagtaagtcat

SEQ ID NO: 636906 - DNA, 217 bp, Homo sapiens
ccccctttttggggggccccccgggggggcccgtttttttttggggggccccccccgggtttttttccctttttccccctgccctggggggttttttccccccccttgggggtccccttttggggggttttaaaaaccctttttttttaaccaaattggggtttttttttaaaaacggggaaggggaaaaaaaaaaattttttccccacccctccca

SEQ ID NO: 636907 - DNA, 100 bp, Homo sapiens
tccatcttactatcaattcccatcccaaaaagcactcatactttatgcatccccgcagctacatacacacaacacacagcacacgcatgaacacagcaca

SEQ ID NO: 636908 - DNA, 736 bp, Homo sapiens
tggcaaaaaccccaaaatattaatttaaaaaccccagggtctcagctgggatatgccccgcccatagggggccccctttcaaatttaaaagtccctcaagaggccccttccaacccccagcaacaaggggctgagcagggccccagcgtgggggctctggcaggcctctgtggccccctccacatgtgatctctggagaggaggcccagcctcctcagggtgctagcgtgggcacaggtcctgcgtgccggcgctgcttctctacgaggcctccttctcttgccccagcgtgtgggcctcactccctccaccgctccgtgggagagggttggcccaaaacctttgttcttaagaagtgccaacacctcctgtgggcccctccagtggggcctcaatgtagcggctccccctctctccgagtgggcggaactctcgacactccacctgtgcgaggaccccgtgtaggggtgctgctgtgcgcgtaaacagtgctcatagaagcgtgcctctctgtgaagccctctcagtgaatcctcctctctgtggccgtgagatgttggcaattgctcttgtgggcttttggcccccgggcgcgcccctcctgtgaggggcttgggtgggactcactgacataccggagagtccgggaacccagattgttgggcaccattcgcctggaggttcgcccggcggacaaaaaccccgggacccatgcttggcggcttgcccacgccca

SEQ ID NO: 636909 - DNA, 406 bp, Homo sapiens
ctgtggtgtagttgcagatcagctcagaccccatgtggctgtggtgtaggctggtagctacagctctgattcaacccctaacctggaaacttgtacatgctgcaaggtgcagccctaaaaacaaacaaaacaaaacaaaaccccaagaagagaaacagacacggagttcctgttgtggctcagtggttaacgcatctgactagggaccatgctgttgtgggttcgatccctagcctcgctcagtgggttgaggatcctgaattgctgtggctctggtgtaggcccacagctacagctctgattagacccctagcctgggaacctccacagaacagataaaaagacaaaaaaaaaaagaaagaaagaattagacaagatggcagagtaggaggactcaggctcccct

SEQ ID NO: 636910 - DNA, 309 bp, Homo sapiens
  misc_feature (124)..(124): n is a, c, g, or t
  misc_feature (232)..(232): n is a, c, g, or t
  misc_feature (260)..(260): n is a, c, g, or t
  misc_feature (277)..(277): n is a, c, g, or t
  misc_feature (288)..(288): n is a, c, g, or t
gcgccggatgttcgggtttaggggtttggttgtcaatgggttttctcgtctctgacataaccacgaagttatataaatgctcctgaagtgtgggcatccggtgtgtggtttgaagccttggagntttcctagaatggttaccttttttggaacacacttatatttggaggctaaaagaggggaaccgcttaaattgtgtttcccgtaattcttgtcctgtgcgacttctaanaactgaggtacctaaagttgtcttgaantttacctttcctgcacncatgtcaaaantaaaacaccccagcgaggtga

SEQ ID NO: 636911 - DNA, 290 bp, Homo sapiens
ggctacttttttgtagagacggggttttgccatgttgcgcaggctggtcttgaactcctgggctcgggtgatctgcctgcctcggcctcccaaagtgctgggattacaggcgtgagccactgtgcccagtcatcaaatgatatttaattacttattaagtggcccatgcctatggccccagctactcccggggctgcctcgagaggctcacttgagcagtgcaggctgaggagcggactatcttgccactgcgttcgtagaccttcggatgacagagagaccctgtctcc

SEQ ID NO: 636912 - DNA, 128 bp, Homo sapiens
tcatcttggcttcccgagtagctgggacacaggtacgtgccaccacacttagctaatctttcttttccttttttttttttgggtaaaaacggaatttggcggtgtggcccaggtgactttgattcctg

SEQ ID NO: 636913 - DNA, 892 bp, Homo sapiens
  misc_feature (24)..(24): n is a, c, g, or t
  misc_feature (71)..(71): n is a, c, g, or t
  misc_feature (144)..(144): n is a, c, g, or t
  misc_feature (293)..(293): n is a, c, g, or t
  misc_feature (316)..(316): n is a, c, g, or t
  misc_feature (319)..(319): n is a, c, g, or t
  misc_feature (334)..(334): n is a, c, g, or t
  misc_feature (336)..(336): n is a, c, g, or t
  misc_feature (353)..(353): n is a, c, g, or t
  misc_feature (369)..(369): n is a, c, g, or t
  misc_feature (380)..(380): n is a, c, g, or t
  misc_feature (386)..(386): n is a, c, g, or t
  misc_feature (388)..(388): n is a, c, g, or t
  misc_feature (401)..(401): n is a, c, g, or t
  misc_feature (404)..(404): n is a, c, g, or t
  misc_feature (406)..(406): n is a, c, g, or t
  misc_feature (409)..(409): n is a, c, g, or t
  misc_feature (412)..(413): n is a, c, g, or t
  misc_feature (479)..(479): n is a, c, g, or t
  misc_feature (698)..(698): n is a, c, g, or t
cccagccagccccaacctcggagnacctgacctctgcaaccaacatcgtgaagtggatcacgaagcagcanaatgcccagggcggtttctcctccacccaggacacagtggtggctctccatgctctgtccaaatatggggcanccacatttaccaggactgggaaggctgcacaggtgactatccagtcttcagggacattttccagcaaattccaagtggacaacaacaaccgcctgttactgcagcaggtctcattgccagagctgcctggggaatacaacatgaaaatnacagaagaaggatgtctctcccnccncacatccttcaaatncnatattctcccagaaaangaacagttcccctttnctttaggagtncaactntncctcaaacttgtnatnanccnaannccccccccagcttccaaatttcccttaagtgtcagttcccagggacccgctttgccttccaacatngcgaatcgttgaatgtgaagatggtctctggcttcatttccccctgaagcccaacagtgaaaatgcttgaaaagatctacccatttgacccggacagaagtcagcagcaaccatgtcttgatttcccttgataaggtgtcaaatcagacactgagcttgttcttcacggttctgcaagatgtcccagtaagagatctgaaaccacccatagtgaaagtntatgattactacgagacggatgagtttgcaattgctgagtacaatgctccttgcagcaaagattttggaaatgcttgaagaccccaaggctgaaaagtgctttgctggagtcctgttttcaaagctccccaaaagacacgtgtttttgtatctttaaagacttgatgaataaaccctttttttggtcaatgtca

SEQ ID NO: 636914 - DNA, 450 bp, Homo sapiens
gaagcatctccctactgaatggaatcgaaacaccggctgtgaatgattacgggcggggagttatgggagggaatgcttggaccatcattagcgggggttggagctattgaaacctgaaagacacaaactttaccaaaaggttaaaaacacaatacgccaaaaggaatagcaattaaaagaccacttagggtccgaagaaagggaaaaaccatgacatactttgtaggtatccactgacggagccccagatcggctgagcagtagaggcattacgattatgcagccaggtagcctctcggtgaatctttacttatattttcttttggagacagggactcactctgtcatccaggtaggagtgcagtggagccatcatggcttactgcagcctcaaccttctgggctcaggcaatccttccacctcagcctcctgagtagctgtgaccacag

SEQ ID NO: 636915 - DNA, 172 bp, Homo sapiens
atagaatgaaatatttattgttactcaaatgcccagaaacggcattgagttctttaagaatttgttccttcattttcctctcttcatctgaagcctctacacctccccaaaagacacgtgtttttgtatctttaaagacttgatgaataaaccctttttttggtcaatgtca

SEQ ID NO: 636916 - DNA, 1325 bp, Homo sapiens
  misc_feature (397)..(397): n is a, c, g, or t
  misc_feature (465)..(465): n is a, c, g, or t
  misc_feature (1325)..(1325): n is a, c, g, or t
gcaaggaaggatgtgacccagatcaatggctgggactggggagtgcactcgcgccaggctggtgccagaggtgcaaaggctcctggtggcccaaggtgatggggctcgaagggtcccagacacgaggcgtccacatgcctagcaggggtcctcctggagagtcggctacgcgtatcatccggtcgatgctgttctcggcaatgatacacgttgtttcgtgcacgtacggacggcagtggcgtcgtgtggcgtgcgggagacgcacatgtccatgctcgcctcgacctacccagagtgcgctggtcgcgaggaggtgttggcccgggtggtccatcgtgcgtggcacctggtgatacacaggcgatggtgcgcaggatgatagtcgatgcgtctacanttggttcgttagaaaataggcgcagaaacaacagctagttttcactgcgcgtacggcactcagatagntagaaaaccaagcttagaaggggggcggtattgatgtagcgtgaggagacgtggttggtagagagggattggtggttgcgggaacggaatggggaaaggggaatggtttagagggacacaacgggcacgggcaacatatcacgacgcaggtggagccaccttaatgcctcaccgttacctcgctgggcatgttacatgcattgcgaacaacatcccacgaaagtgaacacaggtgaatgctcgaggaagggtctcggaaggttatgcacaaaacaaggggcggagcaggggcagtgagagggtgcaggtactatgtggccaaatccacattgggtgggcctaccgcgcggtgaaaaggacacctaaaaatggggggagtaactgaaagacacgggctggaacaccagtacttggggggggatggcacaaccccattttgaagaaacgacaacgtactatgggaggttacatactgtggtggtgcttgtgtggggacaatatacagtttatccaagagcggttccctgcgacaatggtcccggaaaaccaatacatggacagagacaacttcgttgtccaccgtatcattataaaaacaaggcacgcgggtaagagcgaatccacacagggaaaaatcgggtatgtaacgggagtgcgaggaccgtggcgatttataattacagtaacagagccatgcggaaagaaacagtcacgtagacacaccaatattggggatcgcggggcaggtgaaagtggacatttactgcgaaccatgaaagagcgtttgcaaacaaagagcagtggtgatgagtcggttcatcccagaatcaattagtgaaaggcaacactagggggaccan

SEQ ID NO: 636917 - DNA, 227 bp, Homo sapiens
  misc_feature (58)..(58): n is a, c, g, or t
  misc_feature (64)..(64): n is a, c, g, or t
  misc_feature (90)..(90): n is a, c, g, or t
  misc_feature (128)..(128): n is a, c, g, or t
  misc_feature (162)..(162): n is a, c, g, or t
  misc_feature (188)..(188): n is a, c, g, or t
cctcccgagtagctgggactacccgtgcatgacaccctatctggcccttgttttttgntgttgntgatgttctttcttttttcacgtggnttcgcacttgtcacccaggctggagtgcggtggtgtgntgtcggctcactgccctgtctctcgggttggagngattctcgtgtctcagtcttccgggnggctgggattgcgggcgtgtgccaccacgcctggctgtt

SEQ ID NO: 636918 - DNA, 461 bp, Homo sapiens
tggcggcgggcgggccgcttccgctcgctgggcgatggccaggtcgacttcaagtcgattttctccaagctggcccagtacgattaccaggcctgggcaacgttggaatgggaatgctgcctgaaggaccaggaggccggtgcacgcgaaggtgccgctttcatccgtgaccacatcattccggtcaccgacaagatcttcgacgatttcgctggtgcaccgatcagcaccgcacagatgcagcagatgctcggcatcgcctgagccccaacggagcagcccccatgaacaccctttcttccgctggcaccgccggcgacgatgccctgcgccatcactacctgcgtatcgacggccagcgcgtgcattgcgttgtcggcaggcagcggccagcccgtgctgctgatccctggctggccgcagacctggtatgcctgggcgccatgtgctgcatgcactgg

SEQ ID NO: 636919 - DNA, 371 bp, Homo sapiens
  misc_feature (57)..(57): n is a, c, g, or t
ctatgagggtttcttcagcctgtggaagggcttcacaccatactatgcccgactggnccccacactgtcctcaccttcatcttcttggaacagatgaacaaggcctacaagcgtctcttcctcagtggctgatctggcatggtcccaggactagtgtgccaggcttccaagccatccactgctattacagtcgctatgccctggaggacctggattctgctacccctgggctattctatttattttccctctccagtgtggttttctcctttgcggtaaagaacttagtctgttctccccctactccagcctgcctgctggtgcttgcctgatgcttagaatcactttgcccctggctcttcctgaggaga

SEQ ID NO: 636920 - DNA, 287 bp, Homo sapiens
aacgatggtcacagatcacctgaggcacttaggggaagaagaggttaccctcctctttggttttttttgagacagagtctcactctgtcgcccaggctggagtgcagtagtgcaatctcaactcactgcaacctctgcctccggggttcaagcgattctcctgcctcagcctcccaagtagctgggattataggcgtgtgccaccacgcctggctaatttttgtattttgggtaaagacagggtttcaccatgtgggtcaggctggtctccaactcctgacctcatg

SEQ ID NO: 636921 - DNA, 137 bp, Homo sapiens
attccagcccgggtgatagagtgagaccagtctcatatgaaaaataccaaaattatccagctgtggtccgagctacaaggaaggctgaggtgggaggattgcttgagcccgggagttcaagaacaggctgatcaata

SEQ ID NO: 636922 - DNA, 424 bp, Homo sapiens
gggccaacgagccgtgcgttttctgcatacaagtggctttactgccaaagccttccaagaagctcgattacagtcatgcgccaccaggctgggctgaatattgtatttttagtagagatgctttttcaccatgttggccaagctggtctcaaactcctgacctcaagtgatctgcccgcctcggcctcccagagagctggaattacaggcgtgagccagtgcacccggcggaatcttggaatttttatagacagcacctcagtttctgactccagccgcacacctcctgcctctaccagcaggggttgccgccagaccagagccagggccaggtccctgcgttcatcccccccggtaggatggacgtgagccatccttctaggggacttttttcagtgtgcgactcgtctctgttaggtggtag

SEQ ID NO: 636923 - DNA, 106 bp, Homo sapiens
agttgtgacgattacatcgcgttatcgaaagaactggatgtcccggtgcggatgagggtcggtactcgcctgtggttgggtgatgccaatgcttaccgtgtcacag

SEQ ID NO: 636924 - DNA, 314 bp, Homo sapiens
  misc_feature (146)..(146): n is a, c, g, or t
  misc_feature (158)..(158): n is a, c, g, or t
  misc_feature (160)..(160): n is a, c, g, or t
  misc_feature (248)..(248): n is a, c, g, or t
gctgctgctctccagtcaagtagcggaagtcccttaccacccagacacccaaacagccgtggccccagaggtcctgggcaaatatgggggcctgcctaggttggtgggacagtgctccttatgtaaactgagcctttgtttaaaanacaattccaatnanctagagtgagagggagagataacatggcatgcagcacacacggctgctccagttcatggcctcccaggggtgctggggatgcatccanagtggttgtctgagacagagttggaaccctcacaactggcctcttcaccttcacattatcccgctg

SEQ ID NO: 636925 - DNA, 200 bp, Homo sapiens
  misc_feature (19)..(19): n is a, c, g, or t
atgagctggcccgagttcnccatacagagtacacacaacatcactgtattgcatttatctacaatcataaaacgcttcagttgtatacttgaggaaaaattcacagtcaaaattaatgcaaacacacatacctttaccttttagtttatccttatcttattaaatgtcctcttaacaggatactctgtactgggggatct

SEQ ID NO: 636926 - DNA, 222 bp, Homo sapiens
  misc_feature (7)..(7): n is a, c, g, or t
  misc_feature (186)..(186): n is a, c, g, or t
  misc_feature (203)..(203): n is a, c, g, or t
tgacagngaaaaagcagtctggcccccgagggccaccccccataccccaaggtccagacggcggccaacgtgggtgaccaacgtagcacagactggcccccacagcacagcaagacgcctggggcaggccgagagaacggcacggagacgccgacgcacgagaacccggagcgggagaaggcccgncaggccccggccagcancagcaaggcaggagccgcc

SEQ ID NO: 636927 - DNA, 328 bp, Homo sapiens
  misc_feature (240)..(240): n is a, c, g, or t
cagtacctacatatatttattcaaaagatttttctcaggtgcaatgagggtaatacataaacactccaggattttccaatgtaatttgtaaggtcttccttccaaagtatcaggttttgacctgggttcttaaaaaactgaatctagaaaaggatacttaaaaagccagactttctagtgatgaatttttatcattttcttgggtgattagtttatgcatcatctctccctttcctgggntattttagcttttgggcgatgtctccctgtaggaacgagaatgtgtggaatttttaggggcatttgctttccaaaaacggtctgggct

SEQ ID NO: 636928 - DNA, 693 bp, Homo sapiens
  misc_feature (174)..(174): n is a, c, g, or t
ttggtgcctggccctgccggcgctgtctgtgacgatggagatcaatgcgggcctacctgccgccaggcgctgctgctaccaccctgtgacaatgaacaatggatgccctgtgcgccgagtgagaatgttcaagtgatgatctgctgcagtgcctactgactgttgctcagctgnaccctgctggcaatgctgctgatgcatcttcatgacctgcattactgtgtgtgatgtgaatgtgccttcaaatgtgtgtgatgttgtgcacccatgtttggcagtgtaagctgtgctgtgttgtgttgcacaagttgtgtacactctattcaagactacaacagtttccagtggatgacccatcatgccagtgttattgcgtgcagtatcttcagtgttgtgcagaagatcccattttgacaccattatatttgtgagcaatgctgggaacctggtggatgtgaatgtgcatgagacattttgatgaacccagtatctcttggacttcccatattggtgcatggggtaggctttcagccaaacatgttgaaactatagtgagcctggctcccctggcgtctttgggcgcccaagatgggaatgcgcgcttggcccagtgacgaatggaaactggccaaaggaatttccccccaccaagggttcagacatcaccaaactggaacccctgtttccagcagg

SEQ ID NO: 636929 - DNA, 949 bp, Homo sapiens
gctctctctctctctctctctctctctctctctctctctctctctctctctctctctctctctcatagagatcctgagagaatgtcttccgtgcacaaaaatgatgagggaggcgcacccgaggctgggaagcctgcctctgtgacacacatatgctagagagcgtgatacaacgcccccgccccactcgggtcgtgaaggaggagatagtcgtggacaagctagcatcgtcttgtgtagtagaccgcgccgacgtgtctcacttcgtcgtcgttaggagaaaacgggacaaggtggaggacctacttctcgtggaggtggtgtgccagctagttggagcgtccgtgattctgccgctgatgacgagcgagacgtgttgctatcataacagcgtgcaatttgtgatgagagtgaacctccggcgtcgttggcgcccaatataacagagaccaccatacaagaaacgcccacgcggctgttgttgtcgcctggaggaggcgccccttcctgaagatgttgcgtatgcgatgttgggcacaaataactctgcttctcacctgatgtcgttggttgtgtttttgcatccacgcagggtgggacagaatagcggagcagttggttgccccaccatattagtgttggtgatgaccacatgaacaaccaacaagaagattcttttggtcagggcccactctgtcgcgtggtctcttcctgtgtgtcgtgctgcaggcgacccagctgcagggggtggtctttgtctgaggtatgtgcctctgctggtggtgaatgttttgccgtgtagttttgggcagcggcccggaggttttctccgagaaggggatactggtggtttttgttgctgcaacctgttgtggcccctctgctctcctggctctcaccagagccgctgtgttgtttttgtgctcctggtcgcgtgtagtggcgcccg

SEQ ID NO: 636930 - DNA, 741 bp, Homo sapiens
ggcgaaaatttttccccccccaagagttttttttttaaaaagacaaaacccaaaaaggctttaatggccggggttaaaggccagttccccacaagtgtgtctcccccaggaactataaggccccctccccccggaggggaaggtcactgtgtggtggacacaggggctccccatcaaaacccctttttttgagcccccatacggcccttttggtaatagactaaaccaggggtttgttcccccaagaacaaaacatgttttccccttccctttaactagaaggaaaactagtaaggcctccacataatttttgtattacccatcaggggcccaagaaatacatagtaaataaggaagctgaaaactccgggcattggttcttaagctagatgattagaatgtgaaaaagattttccaaaggtaaaacttctatttttcgggagaaactttcttccctttgctgggcaaaaagacccggctttgctatatttaaaagggcttttttaaaaaagatttatgtatttgggaaaggtttggagccaccagttccccccaaaaagcggacccgggtttgatcaggtaaacccgtttgggggcccaagggggactttgttcccacccttgagatgacccttttaagaaaaataagttaatcccaattttcccccgaagggggggttttttttcattaaccaataaaaaaaaaagggacctttttatcaaagggggaagccaatgcta

SEQ ID NO: 636931 - DNA, 319 bp, Homo sapiens
tgtagcagcaacctagggatcagttttgcaggtggtaacagccatttaccaagatacttgtatgtaagaagggcagatttattagagaaattgtgaaaatgtgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcttacaataattgttcattattgttctcaacttggggctctccccaacctggggacccttcctta

SEQ ID NO: 636932 - DNA, 1100 bp, Homo sapiens
tgctttctcttcttgtttctttgtttctttgtttttcctttgttttttttttcttctcttttcttttttctttctgctttttctgttgtgtcttttttctattgtctttctttttcttctttttcttttttcttctgtttctctacctgagtcctatgtctcttcgtgtccttctcctagtgatttgccgttttttttttttttttttgttgtttttttttttaggaggaggcgaagtgtggggcggggagggggggagacgagacggaaggatctgtgaagacccgtcttctgtcgttttattccggctcttttcgcgggatgacccacggggtccaagccggcacttcgacacatgttgcctttggtttcccagagcaccctcccgttggatttggggggaccggaccccccgctccccttcgggcccccctctgaatccggcccgatttcccggcccttgtccgctccgggatggggattccactttaggggatttcgggcccaaaaaacctctagtgggacctggcttgtgaaaccctacgggtctcatcatggaacatggcttcccaccccggtcgttttggcgccccaatgggcgctttctctaagggggtcgcccgagaatctcttgtttatcttattgttttgagacggagtctcgcactgttgccccaggctggagtgcaatggcgcgatcttggctcactgcaagctccgcctcccgagttcaagccaattctcctgcctcagcctcccgagtagactgggattacaggtgcctgcccaccacaccccagctaacggtttgtatttttagtagagatggggtttcaccatgttggcccggcagatctccaacttctgacctcgtgatgcactcacctcggcctccccaagtgctgggattaccggcgtgagcccctgcgccctgcctgtttgtagtaatttttaggcacccaatctccctcatcttctagtgcccttttcctctctgttcaggtaaatgtcaccctgtgcccagaatggatgccccggaaccttcaagagtggctgaaaagattgccgagttatcataataaattgctaacctgccgtta

SEQ ID NO: 636933 - DNA, 140 bp, Homo sapiens
gtgttatcctactggtacttgttcctgttggtcacgctattggtgatcacaatgagtatagtagttacgctttgactggtgaagtcttagcatgtactgctaggaggtatgggttcttgctccgcggtcgccccaaccga

SEQ ID NO: 636934 - DNA, 353 bp, Homo sapiens
  misc_feature (1)..(1): n is a, c, g, or t
ngatatgttattagagaaagtgagcgtcaaagacatagaacaattagtagcagatgggacaatttatggtgggatgattccgaaagtaaaggcagcaacaaaagggctgcaaggcatcatacaagaagtaatgatcgtcgatggtacccattcaaaaatgaaaacagagacttctttgatgggaacgacaattacatctacctctgtacaatccaatgtaggaacatagaaaaggagcgaatgattgtggctttatttccgacttatcagcgatttcctctcgctgttcaacaagcagaaggtacaacggttgttgatacaaatggaaaaacatatttagattttggaagtga

SEQ ID NO: 636935 - DNA, 1132 bp, Homo sapiens
  misc_feature (612)..(612): n is a, c, g, or t
cagccccatgcaccccagtgcttggaggtcagcgtggctggctttgtgtagcccagagtggctggcatgtgtgtggcatagagcatgggtgcctggtggcctggatgtggacaactgaactcatctggccagacctgtgctgcatctcccagggtgccctacaaaggctacatctggtgtggtgaaagatgccacagagtccactggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccatgacccctcngtccccggtcaacccacaatacaacccgcagacgccagggacgccggccatgtacaacacagaccagttctctccctatgcttgccccactccccacaaggtacctacacagccacagacacccagcacacccaagagctaaccaaccatggtggcagacacaaagcaccagcaaaggcgtaccagaaataacccaactacacccaggacacatgctaagccaaacactaacaccagtacgcaccaatagagcacaatacagggctaagacccacagacaccgaagaccaccgtatgaggactaacaagtacactaataagaaaacctggaacgccatcccacagtccccacatgagtagagatacgaaaccacacaaccacccggcccgagagcatacaaggccatcgaaaccaggaaacatcacaacgcggaacagaagtaaacccaccttgcacaatacaggggtggaagggttgcgagaaaaccactaaccatggaatacaacaggatgactgaga

SEQ ID NO: 636936 - DNA, 1159 bp, Homo sapiens
  misc_feature (612)..(612): n is a, c, g, or t
cagccccatgcaccccagtgcttggaggtcagcgtggctggctttgtgtagcccagagtggctggcatgtgtgtggcatagagcatgggtgcctggtggcctggatgtggacaactgaactcatctggccagacctgtgctgcatctcccagggtgccctacaaaggctacatctggtgtggtgaaagatgccacagagtccactggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccatgacccctcngtcccccccccaaaaccccaaaaggggggggggggtcaacccacaatacaacccgcagacgccagggacgccggccatgtacaacacagaccagttctctccctatgcttgccccactccccacaaggtacctacacagccacagacacccagcacacccaagagctaaccaaccatggtggcagacacaaagcaccagcaaaggcgtaccagaaataacccaactacacccaggacacatgctaagccaaacactaacaccagtacgcaccaatagagcacaatacagggctaagacccacagacaccgaagaccaccgtatgaggactaacaagtacactaataagaaaacctggaacgccatcccacagtccccacatgagtagagatacgaaaccacacaaccacccggcccgagagcatacaaggccatcgaaaccaggaaacatcacaacgcggaacagaagtaaacccaccttgcacaatacaggggtggaagggttgcgagaaaaccactaaccatggaatacaacaggatgactgaga

SEQ ID NO: 636937 - DNA, 595 bp, Homo sapiens
tggtgatttttaaaattataagaaatcgctaataatttatatgtatataaattttaaaaatgagttttattttctagtgaattttttttttcaaatttgtctatacaagaaaaagaaaccaaaaaccattaaagaaattgaagctgtaataaatttccccaagaggaataggtggttttttttttttttaataacaactttatggaaattttcacttaccatattatttacctggttcaaaatgtcacaattcagtaaggttctaagtaattttttacagagtttggccaagaaattactaatagtcatttttaagaaactattttcatctctcctaaaccctctatccttaggcatctactaaatcttcctttaatttctgtagaatggcgcctgttctgggacagttcataaaagggaatttatcacacacatgtgttctcgggaagggatcggattcctttcacttacgcatggtgttaacagggttaatccgctttggtcgcatatggtcagtacacttcattctttttaatagccaaataataatacatcatcggaatgtggatataccacatttggtatatccatttag

SEQ ID NO: 636938 - DNA, 1178 bp, Homo sapiens
tggtaaaaacaccctcagcaaaataaaatcccgggttatggtgggacaactttgttccccccttccttcaaccgggccaaaaaaatataaacgagcaactttcatagcacaaaaagaggaacaaaaagaaaacaccttattatcgtgggcccttttatacccatctcatacaacccaactacttatagctccagctagagttccatacacaaaaagagttaccgtgaaagtgctcgaaattaagaatggtttcactgtggtgtgcgacaatgttgtggccttcttttttacacagaggttttattatactcttccatgtggaagaattctatattgaacactgtggctccaccccccacagagttaagagttcagaaagttgaggacaaagaaaaacacgcctccaaaaaggcgggtattggggccaatccgaagatatcatatatcaacaaggtgcgttgtgcacccttaaaacaatattgtgtttcccaaaaccatcttctaacacacggtgctccactatacaacaaatatcaccaacaaaatatttccccctttttcaacgagttacctttgtacaaaaaaaaaaagagagccagagggcccttggagacaagtttcgaggggaccacatatataatcacctctccccccgtgtgtggcacaaaattctctcacagtggcatcgggagacatggcggcgatgggctgaaaaacaggcgcgcgtgtgcaacacacaccgagcagaggagtgggaccaccgtcgccccaaggagattaggacaggcgagagcacccctcctaaatacctcgaaaagcggcaaacccacgggtaagaagcactcctcgaacaagcggggacaatggccgacgagggcaaacaacacagcggcaccaccgccagcgccccacacacgcagcactgtagcacgccacaagggcaacaccaacaattgcacgaggtgccaggaagcaaaaaacgacgacggcaatcgaacaactgggcgccaaaaggggcaaaaccgcgggataccagcgtgacccccagcgtccacctcgccacccaccaaccgggggccacaccctcgcgggctaccccccacagacggcaagctcgccactaaacaccaccaaataacccacgcgtgcaacccgtcaaaaaacacgcgtacgacacg

SEQ ID NO: 636939 - DNA, 366 bp, Homo sapiens
  misc_feature (105)..(105): n is a, c, g, or t
  misc_feature (273)..(274): n is a, c, g, or t
cgccgttgtactccagcctgggcaacagagcaagacccatctcaaaaaaaaaaattttttttcctgaggagggaggcctgtaggttgaccagctcttggggtttntaaggcaggtctgttttctcctaggccctgagttttctgaaatctctgggttttgctttgttggcaagggggccgaggaatcctgacctcggccaaaccttaagctctatggttaatttgagctggcccttccaggtttaaggcagggtggtgtcctcctgcgcactnnccatatgggggccccaaacacccacatacctggccaaccagatttctcctgtgggcaggcaaaggatattgtcatttcccactgctcctact

SEQ ID NO: 636940 - DNA, 202 bp, Homo sapiens
gtttaaaatcaattagggcaccacaactaggccaagaaaactaagtggagtattataatgtagaatacatttagggaacctttcacattaaaaacttgcctggagatacatgttataacatggataaatcttaaaaacattatgctaagtgagagacgtcattcataaaagactactatgatatcccttatgcaaatgccat

SEQ ID NO: 636941 - DNA, 190 bp, Homo sapiens
agtatagacgggtttcaccgttttagctgggatggtctcgatctcctgacctcgtgatccgcccgcctcggcctcccaaagtgctgggattacaggcgtgagccaccgcgcccggcctgtgagggtctttagtgccccctccttgtccctgactgcccactttagagacgaggaaatggaggttcaggga

SEQ ID NO: 636942 - DNA, 453 bp, Homo sapiens
agatcgagctctgtaccggtagactccaggttgacctaaccaggtagactcaggttgacctaacccaggtagacctccaggtagaactaacgtctttacgtgtgtatttgacgcttagtttgtagccttcatcagggtttgcttgaagatggtggtatataggctgatgcatcaggtggtgaggttgatcggggttgatcgattacagaacaggctcctctagagggatatgaacgcagtggcaggtcctttgcgtctgaagctgtggctcgtattgttctggcgaggcagtctcgttgatttaactgttgaggtatagggctaagcctagtggggtatctaatcccagttgggctcttacgctattgtgtgtgcaaatagttaggtctagctggctacctgggttaggtctacctggaggtctacctgggttaggtctacctggggggatcc

SEQ ID NO: 636943 - DNA, 505 bp, Homo sapiens
ttttgggatcagttaaactgtgtgctggtttccatctttctgcagtaacagcggtcagaaccatttcagttggcatgtgcctgactttaggaaagtcctgattgggaaaaaaaaacctgtcagcgcgaattcatgccttcaacaagcacttatgagtgcctggagcctgccgcccactgtgcacatgtatgacaggctcatactacttagagatctctactttattagaggagggactgcaggttttatttacaaccatggcccctaggatactgaaaataagcgaccagttataaaaaggctctttgcccagcttgtcggcaatactcctattagctaaagtgagggcagcctttttttttgcgcatagagcccgagctttttactctcgacaccaacaaattttaccgtttgagctattgtcacttttgaaggggggttcttaagccatgcccatttacttcccaaaaattaagccccttaaaaaattaacaccctctggccc

SEQ ID NO: 636944 - DNA, 268 bp, Homo sapiens
gtcatgttagctgagtcaccatttggcttcggctggaaatagtgtgattagaacactgatcgtgtgcgaggccaggagatcaagaccatcctgactaacaaacacagtgaaacccgtctctactaaaaatacaaaaaaattagccaggcgtggtggtgggcgcctgtagtcccagctacttgggaggctgaggcaggagaatggtgtgaaccgggagatggcgcttgcagtgagctgagattgcactccagcctgggcgacaggctca

SEQ ID NO: 636945 - DNA, 572 bp, Homo sapiens
  misc_feature (448)..(448): n is a, c, g, or t
  misc_feature (516)..(517): n is a, c, g, or t
  misc_feature (520)..(520): n is a, c, g, or t
  misc_feature (548)..(549): n is a, c, g, or t
  misc_feature (558)..(558): n is a, c, g, or t
caagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcatttccagatagcctttttgttttgttgaaaagttggggttttggggggagggggagtattagtacgttgcatgaaatagcttactttataatgatggaagttgctttttctttgtgtctgtgtgatttttttttattgaaagtgaaattataacttntttgtgcaagtaagtactatatatacccattcttcaagtgtacttacttgtacgtgtatacacattcnncantacccatcattataatttcttaataaannactgttcanccttgttaacaaca

SEQ ID NO: 636946 - DNA, 310 bp, Homo sapiens
gcatggatatccttccaataagcaactcatcgtgctcatgtttatttattttaaagtcacacacaattgcacttattaaaaatgaatttatggagacagaaagcattttggtggctgccaagggctggagagggcgaatggggagtgcgtccttaacggatacggggcttccctttggggcgatgaaaaagttctggcgctcgccagtcctgatggttccacgccactgtcactgtaataagtgtcaccaatggcacctttcatgtttcgcccacttccgcccactcaaaaactatacatttaaagcaaa

SEQ ID NO: 636947 - DNA, 169 bp, Homo sapiens
  misc_feature (4)..(4): n is a, c, g, or t
gtantcttaaaaagtgaattatcatcgtgtccgtcgtgaactctctgtcacgctttttccaccaattctctttcctccagaatgttcttctcttctcatcccaagagctctgggatcagtagcaccaggaagtgttaacgggaggcagcagtctgggaggtgccaggtg

SEQ ID NO: 636948 - DNA, 112 bp, Homo sapiens
  misc_feature (2)..(2): n is a, c, g, or t
gngacacacaggatgcagtggacagtattcattccatctggatgaatatctcagtgggggcctatgtgtgtccccaccagtcctgctgacccctacttatctcatctagagt

SEQ ID NO: 636949 - DNA, 1586 bp, Homo sapiens
  misc_feature (1)..(1): n is a, c, g, or t
  misc_feature (764)..(764): n is a, c, g, or t
nggcgttccatcacatgctgctcccagtcgcggacgaactaaacacactgtctctgttgttggagtgaggtatgtatgtatataaattcagggttagagttgttgcttccacacacgatgagtgatagtactcatatactatgtgtgtttttatcagacacccaccgggggagcaaaataatgttgttggcagcccactcgggcccccccttctgtataccccccctcttgtggtttctagataagggaagtgtggatccccccagggaatgtatatattggcgtggataaataaattagttcagtagagaggggtctagaacgtcgtggcccccaacagaaataattggcctgcgttgtaaatattagtaaagggtggagattgttatcaaagggaacaacccgccgtttgttattccccccccacaccagtggttaaagctttcatacacgaaagccacacctgtttaccaacggctgttttttataaaaaaccttccacccccttgttttccccctaatactttaaggaaccctttttgtcttttcgtggaacacaaagcacacatcttttgtgcaacaccacatagggtccctctcattatatgggtaataatatacatcacgaaccccacacaatgggaaaccaccattcttggaagtgttttttccatcaacagagagcaccacagaagagggggggcgttagagaaaacaaacacacccatctcctcgccgtggaatatattgtcgacacacagctnatgattacgacacagaggtggtgtttcacagagagagagagtgcacattatagataatgtgtgtaattcatagcggcgccccacacactctctctgttgtgtggggggtcccaccctgcgagagagaaattggcgttgagagcgagacacacagcgcacccaacgtaggtcacgcctcaacagcggagatacacatccacacacatgtcacagcccacacacaacttgtgtggcgacgtctcttggagatagcggcgagagaaggagtatagtgtgcggagataaaaagagtgtggtgtgagagagagagatactctcaccacacactgtgttgtctctctgttgtgtctctctggttgtgttataataaaagttctcgcgagagaggagataagagagataatttgtgcgcgccccactctataagaaattataagagagggctcggggtggtcgcgtggggctctcacacgctgctcgggaagagtcccacacacacacctcttggagagaggccccacaggcacggcacagagtagcacacccgagagtgtgtcgcggagagtttcggagagacaccacgcggcgtgagccacacacactgtggaggaaaacccccctttttatctataaaaatatcccaaaaattatagctcgggcactggtggtgcacatgcccgtgaattccacacctgccttgggagagcgttgaggcacggaagaatctacattctgaaactccacggagaggcggaaatttcggtgaacccagattggtcccttgcactcccgcctgggccacgagccgaaactacctttcca

SEQ ID NO: 636950 - DNA, 106 bp, Homo sapiens
cggggtggtcagatgatgacgtcggtgccttcgtgacagctcggggaggcagcgaggtagccaatacgctggaacggtgcaactgggaggcactctatcactatct

SEQ ID NO: 636951 - DNA, 481 bp, Homo sapiens
gtgagtaggaatctcttaggaagaaggagagatcatcagatcggctctaactccaaagttcactgctccagggaatctggaatgcacattgcagggcctagtccctcaggacggaaggagttaattctctcctgctcacctccagttctggtcaacaacattcacatcaaatccaaactgaaagaaaaagcagatcagagacggaaatctgctatcatggtcacacacctggcgtggtagtcaccagcgcactctctaggcagtattcttctaaaaagacgacgcaaaatacaccggagcacaattgttcagagccttatttcctcaatgactggagataagacaagatgcagggcgccaatggtctgaagtgagcactaaaagcctacaagtctctccttctcaattgcccactaacagaaatactttttcccctgtgtctcaactgcatttctacgactgtgtcagtatcccggggctg

SEQ ID NO: 636952 - DNA, 487 bp, Homo sapiens
  misc_feature (275)..(275): n is a, c, g, or t
  misc_feature (291)..(291): n is a, c, g, or t
  misc_feature (297)..(298): n is a, c, g, or t
ggtctgtgctaggtgcagctggagcgatagaggacgtcgcaggcccatgatgatagctgcctctcttacccgcgttaatcgtgacgaggtgctggtgcgtggtgattagtagagactctgagattcaatagcctcatctctcatcatcaggctggtcctggaggataagccaaagtgaagcttggacgttttggatccaggcactggtggcccgataattacactctatacttcatgagtgctggttgcatgggatgtgaccaggagtacaaatncagcaggatgtgaaanacgagnnggacagtgattcagcattgcagtcctgaggcatttactcttgggtaaaggagagttgagcctgaattaggaatgtgtatattgtagggatcctggtggttatggggaccacgtctgtgggcctgaggtctggccagccagggctggtgctgtccctgcccacatccgtactggcccggggtcacgagct

SEQ ID NO: 636953 - DNA, 936 bp, Homo sapiens
  misc_feature (1)..(2): n is a, c, g, or t
  misc_feature (16)..(16): n is a, c, g, or t
  misc_feature (48)..(48): n is a, c, g, or t
  misc_feature (56)..(59): n is a, c, g, or t
  misc_feature (61)..(61): n is a, c, g, or t
  misc_feature (64)..(66): n is a, c, g, or t
  misc_feature (72)..(72): n is a, c, g, or t
  misc_feature (87)..(87): n is a, c, g, or t
  misc_feature (96)..(96): n is a, c, g, or t
  misc_feature (102)..(102): n is a, c, g, or t
  misc_feature (106)..(106): n is a, c, g, or t
  misc_feature (125)..(125): n is a, c, g, or t
  misc_feature (129)..(129): n is a, c, g, or t
  misc_feature (137)..(137): n is a, c, g, or t
  misc_feature (139)..(139): n is a, c, g, or t
  misc_feature (145)..(145): n is a, c, g, or t
  misc_feature (166)..(167): n is a, c, g, or t
  misc_feature (172)..(172): n is a, c, g, or t
  misc_feature (181)..(181): n is a, c, g, or t
  misc_feature (189)..(189): n is a, c, g, or t
  misc_feature (199)..(199): n is a, c, g, or t
  misc_feature (204)..(204): n is a, c, g, or t
  misc_feature (206)..(206): n is a, c, g, or t
  misc_feature (208)..(208): n is a, c, g, or t
  misc_feature (210)..(211): n is a, c, g, or t
  misc_feature (217)..(217): n is a, c, g, or t
  misc_feature (219)..(219): n is a, c, g, or t
  misc_feature (221)..(221): n is a, c, g, or t
  misc_feature (232)..(232): n is a, c, g, or t
  misc_feature (247)..(247): n is a, c, g, or t
  misc_feature (252)..(252): n is a, c, g, or t
  misc_feature (258)..(259): n is a, c, g, or t
  misc_feature (267)..(267): n is a, c, g, or t
  misc_feature (291)..(291): n is a, c, g, or t
  misc_feature (295)..(296): n is a, c, g, or t
  misc_feature (298)..(298): n is a, c, g, or t
  misc_feature (300)..(300): n is a, c, g, or t
  misc_feature (312)..(312): n is a, c, g, or t
  misc_feature (314)..(314): n is a, c, g, or t
  misc_feature (316)..(316): n is a, c, g, or t
  misc_feature (335)..(335): n is a, c, g, or t
  misc_feature (344)..(344): n is a, c, g, or t
  misc_feature (358)..(358): n is a, c, g, or t
  misc_feature (360)..(360): n is a, c, g, or t
  misc_feature (367)..(367): n is a, c, g, or t
  misc_feature (370)..(371): n is a, c, g, or t
  misc_feature (373)..(373): n is a, c, g, or t
  misc_feature (375)..(376): n is a, c, g, or t
  misc_feature (378)..(379): n is a, c, g, or t
  misc_feature (391)..(391): n is a, c, g, or t
  misc_feature (423)..(424): n is a, c, g, or t
  misc_feature (434)..(434): n is a, c, g, or t
  misc_feature (436)..(436): n is a, c, g, or t
  misc_feature (443)..(443): n is a, c, g, or t
  misc_feature (448)..(448): n is a, c, g, or t
  misc_feature (461)..(461): n is a, c, g, or t
  misc_feature (494)..(494): n is a, c, g, or t
  misc_feature (499)..(499): n is a, c, g, or t
  misc_feature (501)..(501): n is a, c, g, or t
  misc_feature (506)..(506): n is a, c, g, or t
  misc_feature (526)..(526): n is a, c, g, or t
  misc_feature (545)..(545): n is a, c, g, or t
  misc_feature (836)..(836): n is a, c, g, or t
  misc_feature (931)..(931): n is a, c, g, or t
nnccccgccgcagagncccaccgccacaggcctcgggccagcggcagngagctgcnnnncnaannncccgtnccgcggcccccagcngcccccaancctgcnccangggcccggcgccatgagtnaacnggagcaantnaaaaangaggccgagcagctccggaannaaaancgggatgcncgaaaaanatgtagggantcaanantnanncaaaanananctgggctgganccagtggggaaaatncaaanaaaganncggaagancctccgtgggcacctggcaaaaanatanncnangcactgggggancnantcaaggctgctggtcaacncctcccaanatgggaaactcatnanctggganaannanannannaaaaaagtccangccatcccgctgcgctcctcctgggtaataanntgtgcctacncnccctcanggaantttgtggcctgtngggggttggacaacatctgctccatctacagcntcaananccgcnaagcaacgtcagggtcagcngggagctgcctggccacantgggtacctgtagtgttgccgcttcctggatgacaaccaaatcatcaacagctctggggataccacctgtgccctgtgggacattgagacaggccagcagacagtgggttttgctggacacagtggggatgtgatgtccctgtccctggcccccgatggccgcacgtttgtgtcaggcgcctgtgatgcctctatcaagctgtgggacgtgcgggattccatgtgccgacagaccttcatcggccatgaatccgacatcaatgcagtggctttcttcccaacggctacgcnttcaccaccggctctgacgacgccacgtgccggcctcttcgacctgcgggccgatcaggagctcctcatgtactcccatgacaacatcatctgtngcata

SEQ ID NO: 636954 - DNA, 115 bp, Homo sapiens
gactctgagcatccccgtacgtgagtctcggacgtggtaactttgttgcttcgcaccatgagccgcccacagtctgggctcggtcaccagttcaccacatgccctcttgcctcct

SEQ ID NO: 636955 - DNA, 971 bp, Homo sapiens
tggtctaagatctgatatgttccatagcctaagatgtacagctaagcctgctgaagaattgtccttatttttccatttcagatattcccaaggttaggtagagggggtggcgttgaagagcaggctctctagagccaatgctgtttattaataagctgtacagacacgcttcttccaggaatgtgcacttctgattctgctgtggtgataaagatactctgccttgcccattaagccatttgttggtggaaaacattacctttaaataaatgtctggttctatgtgagcaaagctagggctcccataatatgtgcattagatactctgaattcagctgaactgtttggcaactttgtcactctggccatcatttcagatagttcccacagtgtgagaaatgacgcttcctatagtactgtcaagagtgtgaaaagagagctctttagcaaacacattatttatccatccttaaaaagcttgtcacctccagggtgcttgttcagaagtaatctcattacttaaatcatatcctagcatgtggaaaagctccctgagttccccgcctgccccacctgctgatttctcaggaccgctgataacagcttttcatgtccaacttgggattaatatcaagcaagccatggattttgtctccactgaacttgggcatcatggacagtttccattccagcagttaagtcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgtaagcataacaaactgaaaatgtaatctgctttcaaatattctgttgagtaaagattccttttaattactttaactgggtttgtagagacaagggaccgtctctggttggcaacttgtcc

SEQ ID NO: 636956 - DNA, 547 bp, Homo sapiens
caccctaaatgtattatgctattatcagaatgccaaagtattatttgtctacccagaattcagtctggacatttactactttttagacttgttgacgttgaactttctgtatagagaaagtggctgggtttggagctttgggtaagaaataaaagccgattaagcactggccgccccgcgacaggtccccaatgcccgagtcactgtggcagcattcgcacgggtgtggggagtcctttcaactcagggaggctgggtttctggggcaccctcgaagctttctgggtatgtcttgttatatcttttctgcgtgtcgacctggcacttacaaagtgagaccagcccgcttcccaagccagccagacacctgggtcttgagccataaactggcgtagtacagcatggcagcttccagtgtatttcatttatactttggtggggttatggtaggtttcttcttgtaaaaatggtacagaaactttttaaaagaaatgggattcgaaactggatgtgtatccgtaacctcataataaatctagggttgatg

SEQ ID NO: 636957 - DNA, 1039 bp, Homo sapiens
  misc_feature (602)..(602): n is a, c, g, or t
  misc_feature (660)..(660): n is a, c, g, or t
  misc_feature (702)..(702): n is a, c, g, or t
  misc_feature (713)..(713): n is a, c, g, or t
  misc_feature (749)..(749): n is a, c, g, or t
  misc_feature (764)..(764): n is a, c, g, or t
  misc_feature (803)..(803): n is a, c, g, or t
  misc_feature (807)..(807): n is a, c, g, or t
  misc_feature (815)..(815): n is a, c, g, or t
  misc_feature (818)..(818): n is a, c, g, or t
  misc_feature (843)..(843): n is a, c, g, or t
  misc_feature (857)..(857): n is a, c, g, or t
  misc_feature (862)..(862): n is a, c, g, or t
  misc_feature (866)..(866): n is a, c, g, or t
  misc_feature (902)..(902): n is a, c, g, or t
  misc_feature (929)..(929): n is a, c, g, or t
  misc_feature (962)..(962): n is a, c, g, or t
  misc_feature (1013)..(1013): n is a, c, g, or t
ggctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacaatcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaantggagaggcaggtctttggggaggccaccaagcagccaggcatcaccttcatcgcagncaagttcgatggcatcctgggcatggcctacccccgcatctncgtcaacaacntgttgcccgttttcgacaacttgttgcagcagaagntggtggaccagaacnttttttccttttacctgagcagggacccagatgcgcacntggngggtgagntgntgttgggtggcacagattccaagtnttacaagggttttntttcntacntgaatttcacccgcaaggcctactggcaggtccacntggaccaggtggaggtggccagcgggntgaccctgtgcaaggagggctgtgaggccattntggacacaggcacttccctcatggtgggcccggtggatgaggtgcgcgagntgcagaaggccatcggggccgtgccg

SEQ ID NO: 636958 - DNA, 358 bp, Homo sapiens
ctcagcattatttaactcatcaggcaaatgcaaatcttaaccacattgaaatatcatatcagctcacacctcgataggatggctgttatcaaaaagatcagagatcacgagtggtagtgagcatgtgggaacaagggaacccatgtacactgtaggagagaatgtaaattggtatagtagtaaaggaaaacagtatgaaggtttctaaaaaaaataagatagaactcttctatgatctagcaatctcacttctgaatatatattcgaaggaaacaaaattactgtctcacagagatatttgcgctcccttatgctaaatgcagtacgtcagttacagaaagacaaatactgcatgacc

SEQ ID NO: 636959 - DNA, 1123 bp, Homo sapiens
  misc_feature (686)..(686): n is a, c, g, or t
  misc_feature (744)..(744): n is a, c, g, or t
  misc_feature (786)..(786): n is a, c, g, or t
  misc_feature (797)..(797): n is a, c, g, or t
  misc_feature (833)..(833): n is a, c, g, or t
  misc_feature (848)..(848): n is a, c, g, or t
  misc_feature (887)..(887): n is a, c, g, or t
  misc_feature (891)..(891): n is a, c, g, or t
  misc_feature (899)..(899): n is a, c, g, or t
  misc_feature (902)..(902): n is a, c, g, or t
  misc_feature (927)..(927): n is a, c, g, or t
  misc_feature (941)..(941): n is a, c, g, or t
  misc_feature (946)..(946): n is a, c, g, or t
  misc_feature (950)..(950): n is a, c, g, or t
  misc_feature (986)..(986): n is a, c, g, or t
  misc_feature (1013)..(1013): n is a, c, g, or t
  misc_feature (1046)..(1046): n is a, c, g, or t
  misc_feature (1097)..(1097): n is a, c, g, or t
ggctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgctgggcgcccattcccgaggtgctcaagaactacatggacgcccagtactacggggagattggcatcgggacgcccccccagtgcttcacaatcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaantggagaggcaggtctttggggaggccaccaagcagccaggcatcaccttcatcgcagncaagttcgatggcatcctgggcatggcctacccccgcatctncgtcaacaacntgttgcccgttttcgacaacttgttgcagcagaagntggtggaccagaacnttttttccttttacctgagcagggacccagatgcgcacntggngggtgagntgntgttgggtggcacagattccaagtnttacaagggttttntttcntacntgaatttcacccgcaaggcctactggcaggtccacntggaccaggtggaggtggccagcgggntgaccctgtgcaaggagggctgtgaggccattntggacacaggcacttccctcatggtgggcccggtggatgaggtgcgcgagntgcagaaggccatcggggccgtgccg

SEQ ID NO: 636960 - DNA, 278 bp, Homo sapiens
  misc_feature (157)..(157): n is a, c, g, or t
  misc_feature (177)..(177): n is a, c, g, or t
  misc_feature (180)..(180): n is a, c, g, or t
  misc_feature (196)..(196): n is a, c, g, or t
  misc_feature (198)..(198): n is a, c, g, or t
  misc_feature (226)..(226): n is a, c, g, or t
  misc_feature (230)..(230): n is a, c, g, or t
gctggagacgccacggtgtgcggacggtgagccgtctgaccccttctcgacgacggtcccgacccactcgtcggtggcgcgatgaagcgggcgacgtcagcgacgaaggacgctggtacaccgtgccgggcgagtcgtcctgcagcacccgcccctnaccgagcaccagcagacggntgncaggctcatcgcctcntnctgatcgtgcgtgacgtagacagcggtnaagngaccttctcgtcagcgccaggagctcatcgcgcaactggtacggcggg

SEQ ID NO: 636961 - DNA, 374 bp, Homo sapiens
tgatctaccggatctctcggcatggctttggggagcggaccacagatgtagcgaggggactccacaattcacttcaactttgcaggtgttcgaatttttttttttcccgagatgaagtcttgcccctgttgcccaggctgcagtgcaatggtacaatcttggatcactacaacctctgcctaccaggttcaagcgattctcctgcctcagcctcccaagtagcctggattacaggcatgcaccaccaagcccagctaatttttgtattttcagtagagacaaggtttctgcatgttggccaggctggtctcaaactcctgacctcaggtgatgcacctgccttggcctcccaaagttctgggattacatacaga

SEQ ID NO: 636962 - DNA, 268 bp, Homo sapiens
ttgtctgatacatggcttggaaatacttttcccaatctgtaggttgccttttttcacattttattttatttatttattgagatggagtcttgctctgtcgcccatgctggagtgtggtggcacaatcttggctcactgcaacctctgcctcccaggttcaagtgattctactgcctcagcctcccaagtagctgggactacaggcatgggccaccaagctcagctaattttttttttttttttttttggagatagacaaggggaaaca

SEQ ID NO: 636963 - DNA, 207 bp, Homo sapiens
  misc_feature (203)..(204): n is a, c, g, or t
caggcggaccttcaggctgattgaggcacccaccaccacgcacagctagttattgtctttttggtggagacggggtttcgccatgttgaccaggctggtctcaaactcctgactttaggtgatccacccctctcagcctgcgaaagtgttgggattacaatgtgtaatgccaccaatgcccagtcctggcaatcacagcctgnngaa

SEQ ID NO: 636964 - DNA, 746 bp, Homo sapiens
  misc_feature (38)..(40): n is a, c, g, or t
  misc_feature (42)..(43): n is a, c, g, or t
  misc_feature (53)..(53): n is a, c, g, or t
  misc_feature (57)..(61): n is a, c, g, or t
  misc_feature (67)..(67): n is a, c, g, or t
  misc_feature (74)..(75): n is a, c, g, or t
  misc_feature (84)..(86): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (113)..(113): n is a, c, g, or t
  misc_feature (120)..(120): n is a, c, g, or t
  misc_feature (127)..(127): n is a, c, g, or t
  misc_feature (141)..(141): n is a, c, g, or t
  misc_feature (180)..(180): n is a, c, g, or t
  misc_feature (219)..(220): n is a, c, g, or t
  misc_feature (228)..(228): n is a, c, g, or t
  misc_feature (253)..(253): n is a, c, g, or t
  misc_feature (262)..(262): n is a, c, g, or t
  misc_feature (277)..(277): n is a, c, g, or t
  misc_feature (301)..(301): n is a, c, g, or t
  misc_feature (311)..(311): n is a, c, g, or t
  misc_feature (331)..(331): n is a, c, g, or t
  misc_feature (336)..(336): n is a, c, g, or t
  misc_feature (358)..(358): n is a, c, g, or t
  misc_feature (378)..(378): n is a, c, g, or t
  misc_feature (380)..(380): n is a, c, g, or t
  misc_feature (383)..(383): n is a, c, g, or t
  misc_feature (395)..(395): n is a, c, g, or t
  misc_feature (406)..(406): n is a, c, g, or t
  misc_feature (408)..(408): n is a, c, g, or t
  misc_feature (418)..(418): n is a, c, g, or t
  misc_feature (437)..(437): n is a, c, g, or t
  misc_feature (445)..(445): n is a, c, g, or t
  misc_feature (468)..(468): n is a, c, g, or t
  misc_feature (471)..(472): n is a, c, g, or t
  misc_feature (474)..(474): n is a, c, g, or t
  misc_feature (482)..(482): n is a, c, g, or t
  misc_feature (493)..(493): n is a, c, g, or t
  misc_feature (502)..(502): n is a, c, g, or t
  misc_feature (514)..(514): n is a, c, g, or t
  misc_feature (521)..(523): n is a, c, g, or t
  misc_feature (553)..(553): n is a, c, g, or t
  misc_feature (557)..(557): n is a, c, g, or t
  misc_feature (571)..(571): n is a, c, g, or t
  misc_feature (661)..(661): n is a, c, g, or t
  misc_feature (735)..(735): n is a, c, g, or t
ccctgcacctttctttatcttggagcctctcccatctnnncnnccctcttccncccnnnnncacccncctaccnncccacttcnnncccnccnctcacactnccctccctccnttctctngtctccnccccactgcgcctncctccctcctggccttccttcccttccccgactttgcanatttctcttcccccatggcctccctcctccacttttccnncccctccnggcttggctctcccaggaggctacnactggagcnactggtcccgcaganccccgcgtcctcggtcgctgcgtncacgtccctntcgcgtccccgctcggcgcnacgcngcctcctctgggttcggcctcngcgcggtgcagcgcagtctnangcngcgggaaaagcncgaattaaatntntgaaatgganaaagaagcttatccttgtncgtgtganattggccacagatttgagtatgnagnncnaggcagtnaagttcaagtngagcacatnaaggcttatgtnaccaaannncccgttgatgcaggcaaagctgtgattgtnattnaagatatatttggntggcagttgcccaataccagatatatagctgacatgatctcaggaaatggatacacaaccattgttccagacttctttgtagggcaaganccttgggacccctctggcgactggtctatcttccctgagtggctgaaaacaagaaatgcccagaagatcgatanagagatcagtg

SEQ ID NO: 636965 - DNA, 232 bp, Homo sapiens
tggaccagcctgcctctgtgacgactgcagcaaacctccttgggtgttccaatgcccatcatctcccactttgacacctaaccctgactccttcaccaagaagacgggagtcagcagccaggagtacccgtggcacctctctctcttcgaggctccctgcttcccccttccctctttccaaggaaggggcaacctattctctctcaaagccgacccctatgccaattgcctg

SEQ ID NO: 636966 - DNA, 186 bp, Homo sapiens
  misc_feature (25)..(25): n is a, c, g, or t
  misc_feature (38)..(38): n is a, c, g, or t
  misc_feature (74)..(74): n is a, c, g, or t
  misc_feature (104)..(104): n is a, c, g, or t
  misc_feature (174)..(174): n is a, c, g, or t
aaatcataaaacgggcagaacaggntttggttagtttngaagaaaagaaagctctataaatataaatctatatncctgtatttttatttaataatttataaatnccaagttcatttgacttttatttttgtgtaatatgtaatgatcggtattaaaaacaataaataaagcccnaaagtttaatga

SEQ ID NO: 636967 - DNA, 801 bp, Homo sapiens
gacccacgcgtccgaaacaccaaatggtcggatgacgccggtgcagcgggggggcccgggggccctggtggccctgggatgggtgaaccgcggtgtgcttccgcggcaggtttcggccatgtgtgcatcctggtggtccggggtcgctgggcgtggaccgcgtgggccagagggcctgaaggcacgcaggagcatcgacggaggcaatggaccgaggataataggatgtggatagcccgtcaccaagttgggccgcattggatcaaggacatgaaagatcaagtcccttgtgatagatgaatctattcttcttctctcctgtcccattagacggaaatcatgaagacttcacttcgattttcttccgctagtgcgagggtccttcttctcaaacggaatcgaagggtatatttgatacgatttaatgcctaagtcgcatggagagccaatgacccctgtaagtccagggcgcagcgcaacccgagtgttatcaaggggcattttggttcgctatacgagggaacttacaaataggcacaaacgttccgtgtactcgagggtacgtgtaaacgttggcttaccgaaaggcaaggattggcacaaatcaggccaattccaagttgagtgcggcccattcccatttccatggcgcttcaaaatgcattcttcccaattacaggattcaacaccctgttgggcggccaaggtacaggggctcatcatgggcgggcgaaaccaaaatgaaatcttgggcaaaggaccaccacatcagcttgttccggcatatggtcaaagtgggga

SEQ ID NO: 636968 - DNA, 855 bp, Homo sapiens
  misc_feature (42)..(42): n is a, c, g, or t
  misc_feature (70)..(70): n is a, c, g, or t
  misc_feature (72)..(72): n is a, c, g, or t
  misc_feature (75)..(76): n is a, c, g, or t
  misc_feature (78)..(78): n is a, c, g, or t
  misc_feature (86)..(88): n is a, c, g, or t
  misc_feature (90)..(91): n is a, c, g, or t
  misc_feature (98)..(98): n is a, c, g, or t
  misc_feature (173)..(173): n is a, c, g, or t
  misc_feature (177)..(177): n is a, c, g, or t
  misc_feature (193)..(193): n is a, c, g, or t
  misc_feature (196)..(197): n is a, c, g, or t
  misc_feature (232)..(232): n is a, c, g, or t
  misc_feature (236)..(240): n is a, c, g, or t
  misc_feature (285)..(285): n is a, c, g, or t
  misc_feature (300)..(300): n is a, c, g, or t
  misc_feature (475)..(475): n is a, c, g, or t
ttacattttattataagtaaaatcttatgtatccctcacatncacacatccattcattctggtctatgtncnttnncntacatacnnntnnctttttnttcatacagacatattcatttttactcacaaagtggctgcatgcataggcataaaattgctaggtccaaagcganaatnattttttgttctattnaanngtcctattatcttagaaaaaaaaaccaaaacaatntttnnnnnttttctgaggaaattactacctcaaaaaaatgttctcaagatgantttgagatctaagcntactaaactgcttttgcaaaacagctccctgcagtccaaggtgacttgtgcaaatagaaggaatcaaatgaggctggttcctgtacttccttaaacaaggaggtgggatgctcgcaggtgcccaggggcactcccatcatgccaggtactgctgcagtgccatctttgccttgtnacaaaggtttgaatctggtgactgactcagtttgtgtagaatatctacgatgcccatgtctcgtaatttatcctggcgttcttgtgaaccttcctcttcattccatatgaggtttgatatacaaaacatggctgcaagctgcagtttaacatgtgaatggcccatgtaatacttgattttctgtaggatatcatcattggtcataataagatcttttgctgttgtcccatccgctatgttggctaagatgcacagtgtctgctctttgacctcaatgttatgttccccttctagaataagagtgacggcttgcataatttgctttccatgagtactcattattttatctatatgaggacgagtggagaggagatttctaa

SEQ ID NO: 636969 - DNA, 644 bp, Homo sapiens
  misc_feature (236)..(236): n is a, c, g, or t
ggaacatataaaggctatgtttacctacttaagaaattgcttttagccagtttagaaatgtctgcttactctttgtttttaaatttaaaaaattcttcagagatgggatctcgttctgtcaaccaggccggagtgcagtgccaccgtcacagttcactggctacctcagctacttgggaggctgaggcaggagaatcgcttgaactcctggcctcaggtgatcctcctgccttggnctccaaaagtgctgtgattgcaagtgtgagccactgagcctggttgaaatgtccacttacttttaacaaatgaattgtattttaaggaagagtttgcaatgcttaaataattttcatcagtttacttaaaaagtactaaagccttttttttttttttaagacagagtctcgatctgttcacccaggcaggattgcaggtggggtgatctcagctactcgggaggctgagcgcattgagaagtcgttgtgaacccaggagatggacggttgcagtgagctgagatctgtgccatggcacctccagctctgggcaacagagcgagaactctggctcccaaaaatacaaaattaacaattgattgtcctatgattgacggttaaatgggtcctcaaatggagctattccac

SEQ ID NO: 636970 - DNA, 426 bp, Homo sapiens
tacttagtgatctagtggattatagctatgtgctgctgatggaacacagactgatattttggatagattcgtgactgagacgaggttgcacggtgttggcaggctggtatcaaactcctgacctcaagagatccactcgccttgccctcccagggtgctgggattgcaggcttgagccaccacgcccggctaaaacattgcaaatttaaatgagagttttaaaaattaaactactgactgccctgtctctgttttagtactgtacctcctcagtccttcacctttgcacctgtctgccacttagtttggttatatcgtcattaccttgaatttgctctgtctagacttccactttaacgttttctacacggggagacaagtgttcaaatttctacaatatgttttccaggacacttcacttccaag

SEQ ID NO: 636971 - DNA, 180 bp, Homo sapiens
cgacgtattgctgatatcggtgatgcccaggtagcggccggttgcgaccgacacgacggcgtatttgtaattgccctcgatgatctcggtcagcatgggccgggtcgtgatcggctggttgctgcccgcctggcccaagagcatgctttccttgccgctgggcgccaggttgtcgtcaaa

SEQ ID NO: 636972 - DNA, 236 bp, Homo sapiens
  misc_feature (68)..(68): n is a, c, g, or t
  misc_feature (108)..(108): n is a, c, g, or t
  misc_feature (130)..(131): n is a, c, g, or t
aaaataaaactaaaaaaataaaataaaagagctgaaggtggtctagagttaggtcttgtgcagaggcngcaggctctggagacttgaagaaactcataggggtcgtgnggtgacgtctggctgctccccnnacactcagtgctgagaagggcttcccagtgtggttgctggtccctcttcggaggctgttggacatgggagctgatggttggacgactggtctgagaggccgcctg

SEQ ID NO: 636973 - DNA, 728 bp, Homo sapiens
  misc_feature (118)..(118): n is a, c, g, or t
  misc_feature (162)..(162): n is a, c, g, or t
  misc_feature (298)..(298): n is a, c, g, or t
  misc_feature (317)..(317): n is a, c, g, or t
  misc_feature (358)..(358): n is a, c, g, or t
  misc_feature (361)..(362): n is a, c, g, or t
  misc_feature (396)..(396): n is a, c, g, or t
  misc_feature (431)..(431): n is a, c, g, or t
  misc_feature (480)..(480): n is a, c, g, or t
  misc_feature (504)..(504): n is a, c, g, or t
  misc_feature (513)..(513): n is a, c, g, or t
  misc_feature (542)..(542): n is a, c, g, or t
  misc_feature (544)..(544): n is a, c, g, or t
  misc_feature (625)..(625): n is a, c, g, or t
  misc_feature (632)..(632): n is a, c, g, or t
gtgctaactgattaaatattctaagatgaccttctctggtgtgtgtgatgataattaaaaggcattcagaactgtgtggaccagactgaacctctgcactctagattttttttttttngaagcctctacaaaggataattaaaatttacaccatgactcttngtcctggggtgcactgtctgtaagccggtggagttatttcccaaaatcctggtccttcccagcttgaggaagtctgcaggactgaggggggggacctgtgctttttttttggttttttggagatggagtctctgtngcccaggctggagtgcagnggggcgatctcggctcactgcaccctgacctccgtgggttncanntgattctccgtgcctcaggcctcccaagttagcngggatttacaggcgtgtgccacttgtcaggcctcntgagcccaagccaagccattcgaattcccctggtgtgcctttgcaattnttacacccagatggcctgaagtanctgaagaantcacaaaagaggtgaaagggccctgcccngnctttaactgatgactttccaccattgtgattggtccctgccccactttaactgagtgattaccctgcaaatttcttctccnggctcanaagcaccccattgagcacttggggaccccaatcctgcccgcccttgactgtaatttccattacttccaatatataaaaaaggccaccttattcctt

SEQ ID NO: 636974 - DNA, 553 bp, Homo sapiens
  misc_feature (2)..(2): n is a, c, g, or t
  misc_feature (11)..(11): n is a, c, g, or t
  misc_feature (201)..(201): n is a, c, g, or t
  misc_feature (273)..(273): n is a, c, g, or t
  misc_feature (280)..(280): n is a, c, g, or t
  misc_feature (293)..(293): n is a, c, g, or t
  misc_feature (318)..(318): n is a, c, g, or t
  misc_feature (373)..(373): n is a, c, g, or t
  misc_feature (458)..(458): n is a, c, g, or t
  misc_feature (483)..(483): n is a, c, g, or t
  misc_feature (501)..(501): n is a, c, g, or t
  misc_feature (521)..(521): n is a, c, g, or t
  misc_feature (544)..(544): n is a, c, g, or t
cnggcggcggntcaaaggtcaaggggctgctccaagggcaccgcgtgggaactgcgcaccggggcccctggacgccctcctcttctctgagccactcaatcccctctactaaatcggctttgggagcaaggtccagctgtctgccgaggcgaggagcgccacacacgtaatctccctgcaggagcttgagctggggcagtngcttgtttcctctgtccttgggaattggcagtggccccccgggaaggggttttgttaaagctgtcaggtttngcccctnacttaattcgtancaagggcaagctgccgtcttttggntttgaagggtccgtttgctctacctccaagggtgaattctgtggtcaactcacancatgtcactcggctttttttcgcatggcgggtgaccagtaattgctgtctaacttggctgacaaatgattagctgtgttctctcnaaaggtcagaattggttcttggaanaaactgggccaaaggggnacttacacagaaagcgcgantttggttgaatccgtgcttggangtttttaaa

SEQ ID NO: 636975 - DNA, 212 bp, Homo sapiens
  misc_feature (166)..(166): n is a, c, g, or t
tccggaccttacccgtacgccaaatgatgtgccttctccatatgaagtcataggttttcctaccatatacttctctccagccaacgagaagctaaatccaaagaaatatgaaggtggccgtgaattaagtgattttattagctatctacaaaggagaagctacganaacccccctgtaattcaagaagaaaaacccaagaagaagaagaagg

SEQ ID NO: 636976 - DNA, 1377 bp, Homo sapiens
  misc_feature (108)..(108): n is a, c, g, or t
gctggtccgagctctaactgatagcagcatgatctacgtgtagtgtcttaacgtgtcccatttctttatgtgcggtgtcatgcgcgggtctctgggatttgtttttcnccctgtacgtcatgcgccctgctggtcccgggtatccgcccgttcgtgttccactctccgctggagtcccccgctggtggttgtccccgatttttctttgtggggccacaaaacccattgggggtcccaccacgccagatgcgccgccaaggtgccgcgatgtctccttttcgcgggaagcctttgtgtttatatggcacaaggacaccctgatgtgcacaggcatcttccgaggcactcttgggaccccactcccgctttggaagaacctgtccgtcatgtatatatcccgggggaattttgggcttttgggtttacacccaactgagggccttccctgaggactcacggggacaattgttgcctgcgccacatatagtgggcccagactctgtgcccgtggcttgggaccattggcccccccatggtggaagtcacctgtgggcccagccccaaggaacactgtggttcttcgggctctcgcaggaagagcctcgccattgtgtcccgagcgtcttttagggttattcaccccgcgtgagagtgtgtgcccggggcacaacccaagtggaaaatccctgagtggaattgtcgccgcctgattcacagactcggagacacaaagtgggaagccccgcgaagatccacccctgtctgagacacatgctcaaacagtttcgccccttttgtccctttgggactggtccacataccccccacaggttgttccgacccaatggcagcagcacttttatcacaccccctgagaagtgccttgagatatttcacccagagaggaaacacttctgcaccattttccgctttcctcggagagggttgtcccgccacatgtgtgccacgctgtctcgttctgcacagaattggctaacccacacactgttgcactccacgtatccccactttctaatcactcacacacgggtaccacaacacgagagtcctggccctctgttctgtggagagaccggagttatcacccttcccaccttgctgaaaaaggtcaggcctttttggctgagtccactctgcctttgtggctgctgcccccgtggctgctgccacccaccacagctgcgttcctgcgtgcgtgcgtgcacagccccacgctataggttgaagcccaggaagagtcgcgaggaatcggacgaggatatgggatttggtctctttgactaatcacccaaaagccacccacttagcccgttttatttgccaaaacaaggaaattaaaggcttactttcctttta

SEQ ID NO: 636977 - DNA, 314 bp, Homo sapiens
atgctctgttaacacacacacaacccacacacatacacacacaaacacacacatatatacacacaacatatatatacacacatatctacacatccacaccatatatacacaccccatacacacacatatatacacacaacatatatatacacacatatatacacatccaaaccatatatacacacaccatgcacccacatatatacacacaccatctatatgcccatatatatctacacccacaccgatatacacacacatacactatatataaacgcccaatatatatagagacacagtatacacacccaaag

SEQ ID NO: 636978 - DNA, 380 bp, Homo sapiens
ttctgtaacgcccgaacctagtatcattttgaaatttctgtagtttatgtttttagaagatagcctcccaggtcgaggtatttacagtttactgccactgtcaattatctgtactttgatcggaaccggagctgctgtcgagccacacatgctggaatatcagttcgtcttgcagcaccaagtatctggctcttatcaggcacgagtagacctacttcatgatcggattcttgggcgggctctggctcgtgctccagctagctctctgtctctatctctctctctctctctctctctctctctctctctctctctctctctctctctctctatctctctctctctctctctctctctctctctctatctctctctctctc

SEQ ID NO: 636979 - DNA, 1006 bp, Homo sapiens
cagcagctggtcttatagaccattccagggggccgtttgcaccaatgtataagtgcaatggtgtgtgacccaacagagagtttcagggagttgtcacaggattgcaacctggggctgttacgggaggttggaggtgatctgcaaaactggggcgaaatataaaggagcctgattcaggaggtagcctaggacggtctttcaacctgaaaggagggtgtgcacgaacttctatagaagcgtccttttccaggaaaaaatgttttccctaagcagtattcaaggaaatgaattcagaagatcatcaataaggaggatttcaagaggatgacggtggacagccccggaagaaacgcctcaaaagcattgaagacgccagttgcttaaataatatgcagcaccaatagcttgtgctggtttttagatttttccttgtctttcaaaaaaacattgtgtcagtaatttaacatcaacctagcaaaaagaagagtttgtgactattctcatctctcggcttctttggacgtttacttagactttgaatttccattaagtagcacaaatgtgtagtgttaaacactcttaatcactaagaaagaaaggaaagaaggagatgaatagaagaaagaaaatggaaagaaggaaaaaaggaggatagtttataaaggatggatagtaaagatattgcaattgaaaatatatagacattcttcccacttcttggatttattaaaccatcagttctggagtgatagctactgtagaaaggaaatagactttgtatgaactctttaagttgaaaagtaaaaatatatgtggtttggatgtgtgctttaattcagctttagaaattaataccactacccgtgaattatatggcctgacaatatgaattaggtgtactgtactgaagtacagtacgtccacacaccatgggtggtaacaagagttccatcccaggaggccaaacgtgcaacagaaggtaggttagatatacttctcggagaca

SEQ ID NO: 636980 - DNA, 211 bp, Homo sapiens
tattagacgtatcacggcatgtgtctttgtcccatgaaagtcgcgagacactacattgtagtcgtccacagacaatcggggctgctagtcgcatacccggagtaacagctgccgccatcatcaatctgctgcgattagtgaagaccactcaatgaagactgtcggctataaatgaatcatccaagactgatcaatactcatgtacagccag

SEQ ID NO: 636981 - DNA, 364 bp, Homo sapiens
cattctgaaaatgtagatgatgttccaaagacatcatgtgatatatgaatgttggatgccattgcatctatctctctttccctgttgcctgtgcaagatgctattaaatttacagattatttcctaataattatggtagtctaaattatatattgctttgcttatcttttgtttttatttacagcacaaaaactgggactcactgtcagatgcaccccttttgttaaatttaaaagttcaactgactcatgaaaattttgcccaccttttcttcttctagcatattgagtcttccacatcaagcatctccagtgtcacgcaccccaagcctacctgctgtagacacaagctatattaacacatc

SEQ ID NO: 636982 - DNA, 176 bp, Homo sapiens
ggcatttttacaatactttttattttactttaatcaaaactaacagctttatgaaaatgtttaattagccaaacgtctccaattctttatcagggtttaaaaaatattttatgatttaaacttttcccacattttttgcctaatgattccttactacattgttttatgaataacct

SEQ ID NO: 636983 - DNA, 339 bp, Homo sapiens
gttgtaccctatatgctttggagccctaacagtgctggtgctgcagtggctcacgctgtaatcccagcactttgtggagtgcctgatgtgggtggatcacaaggtcaggtgatcgagaccatcctggctaacacggtgaaaccctgtctctactaaaaatacaaaaaattagccgggtgtggtgtgcgggtgcccgtaatcccagctactctgtgtgatgtgcttgatgtgcagtgatgaatggcgtgaaccctgggaggttggagtgtttgcatgtgatgcctgagatttgctgccactgccactccatgccatgggctgacatgagctgatgacttg

SEQ ID NO: 636984 - DNA, 208 bp, Homo sapiens
aagttcgcatttaaatgctactcatcgtgccaatatcactcggcacaaaaaattgcccattaaaaataaatatgatacgcatgagtataattagagcagtcacgcccagtccatcacgttctagttcacgccaaaatttttcaagattttcgcaaacgctatttatcgttgccaagcgcctccttatttcacacgcatacgcggatca

SEQ ID NO: 636985 - DNA, 466 bp, Homo sapiens
tcctctatactcctgggcactggttgacagtactgaggcttaaggcagctggactctcttgctggtgacctggctggatggagtgtgtgtgcagtccaacatgctgctgggaccaatacacattccgttgtacttgcggatgacagccataggaagcagtcgatccttctcacgcagtctacgcgcagcttggcctcagtgagacgcaggtggcgaatgctgcctattcataccttctttaccatcttacacttccatacagagccaggatagtcaccgcctgctacatattcagctagcgcaggagctacctcctaccgaggtagcctgacgacaaggagtacgaatggtacggagccagtatcagggaagcccacatttcccctagccaccaccaactgggggcccatacgggcacacggcagaccgtccagacctgacggtagacagacctgtaactccgacg

SEQ ID NO: 636986 - DNA, 177 bp, Homo sapiens
agagtagcagcctggaacaaatgtagtcaaaagcctgtactctgtataaacataccacaattagctaggagacatggaagtcacatgcctgtaatcccagtatactcacggaggctagaggcaggagaatctcttgacacccaggcaggcagacggttgcagtagcagtagagactc

SEQ ID NO: 636987 - DNA, 198 bp, Homo sapiens
ggttcaccatgttgcccaggctggtcttgaactccttgggctcaagcagtcctcctgcctcggtctcccgagtagcttggactacagtgctcaataccacaccccactaatgttgcctttttttcctttttttttttttttgtgtgaaaaaatgaaatcatttaattgtggccaaggcccttctacaaacccgtggcc

SEQ ID NO: 636988 - DNA, 206 bp, Homo sapiens
cctgatcgggcttcatcgtcttggtgtggggacgtttcatgccttagcggtttgcactgagaatacagatcgaacccacaggaagcaaaggggatttccagaggcatctcccacagagcgagcctttgctcgattatctctattgccgaaaccatcactgcgaccttgttgtcgatgacactttgtttgcgtgaatcattctcatc

SEQ ID NO: 636989 - DNA, 495 bp, Homo sapiens
ggggaaggccttacctgcaccctgaagtttttcgttttcgccatggcttcgcatccgtgggcgcttaagctgcgcctcggcgctacttctttctttcttggcctgggaggcttatccaacgtacttctatagattcagagtttactccacggcattcccagcagagacatggaaagtcaaatttccttgatctgctatgggcctgggtctcatccatccgacattgaagttgacctaccatgaagaatggagagggaaatgcaaaagtggaccattcagacttgcttttaggaaggactgggccttctatctcttgcactacactggatccacccccactgaaaaagatgaatttggctgccgggtgaaccatgtgactttgtcccaggcccatgaagcttagtggggccgagacatgcaaggcgcattcatgggggttcggaggggccccattgggatgggatgaaaacccaaacctgcttgttttgtttttta

SEQ ID NO: 636990 - DNA, 156 bp, Homo sapiens
  misc_feature (5)..(5): n is a, c, g, or t
ccgcnacccaacaaaccaaggcacatcataatcaaattgctaaattttgtataaaaggaaaactgaagcgacagagagggtttggcacatcatatatagaagcataaagaaaagaatgacagctgggcacagtggctcatgcctgtaattccagtg

SEQ ID NO: 636991 - DNA, 1212 bp, Homo sapiens
tggaggagtgaaaaggggctgggacttaagataggacaatggtggagaaggggggggaaagaatggcaaaaggatatagtatcccttatggatggtacttgtgcaacagggaactcttacttcatatacccttggcagtaatcatccagggagggaagaaaacacctgggactccttgattgaaggcgctggatcttggtgttcggtggcactgggggccctgccaggcatatagtggaaggtcgaatgtcttctccctcagaaaacacatctgggtcccttgctggtcccagtaaaggggcatacgctttctcacaggcccctaaatctttacacaatctccaggtggggcgcacttaagtatgggcgaaaacgaatggcgggtcaacatcaccaacgcggtatcgcgccggcaccacccacatctcacggcggtcgggtggtcacctggtggcgccaaacggggcgatgtggggcggccccctctctgggggcagagaacctccccgtgcatagacaggcggtgtgctccacgccccgtgccctgttgaccaactgtggcacgcgcaccactctaccctgcgcacactggtgggggcgacgccaaggcgggctacagtgcgtgccctctccacttacttgaacacacacacacacgccgtcgatgctggtacaaccaccccccaattctggggaacgaaagggcccacaccctgtgggtcacaccatatacccccttttcaccacattaccggcgcatacggccaatacctcgcggcggcgcttccggccgcggcccaaacatctttgagctgctaccaacgaacctggtgcgctgaaacccatctcgacagaagtatcacgcgcctctacaccacactttcttcaaaaccaccgaacacaccattcgcagggggtttctcaactgttctattacacattactaggggggttgcgtactaacacacatatcatttgctcgccagtggtccaacgacaccataatgtatgatacggaattttcgcccccccccacaccacagtggacagggttttgccttccccaaataattgtgagtgaatagcgagtgggacaccgattaccgccccccaaagacgtctttatagcttcccacgtggagagtattgacagccccctgtaaacattttgtggaagaggctgtcggcatatgcgaagtttttcaaaacccg

SEQ ID NO: 636992 - DNA, 441 bp, Homo sapiens
ctcaacttggccatcagaatggaccaattaaagcaattggcaggaaggacccttgctcgggcccgataaccctggccatgttaggactggattatggaaacccgaaactcttgtgtaaccttgctgggcttcctaggcagaaattcatataaactgtgatactccccttccctgaagctatgagcctttaaaaactgttttcagcccccctaggggttccaaaaaatttggaataaactttgaagttttgggttttacttatttttatcccccaaatggtgctattttttagggtttgaaacaaaatctttttaaaaccttgttttagttgtcaaagccccccccggcccttttgggatgtgaaaaggaatttcttggaatctgtaatttgggcttaatatttccggcttggttttaatataataaataggggtttgttta

SEQ ID NO: 636993 - DNA, 218 bp, Homo sapiens
ctctgtctatctgtctctcctctctgtttggtggggcgtagagctgatccacagcacagatctgtttcgtgccttgcaagaccctcacccaagcttggcagtcgagctcgtgtatcctggggctcccttcatctccaggaagtcccctccccggtccctaccaccgcccgctgtgctgagcccctaccccactatagagccgccctacagatcggccg

SEQ ID NO: 636994 - DNA, 638 bp, Homo sapiens
tctagttagcttaaagaaaattggctggcactcaaatattctttaaggactgaatggtcaaattaaccacatgatcctaatagcaaataaaaagtagaacgtatttgacccttaacattggctgctgttcctttaggttatcaccccagtatgagccccttacctcggttgctagagctggttctgggcttcagtgtctgtttgcactcccccaaccaggcttgcccctgccccgcaggtgccagcagcagcagagggggcaccttttccctcaagtgccaggttctgacagcccaagcttcctctgctggcacctcccaaacccagacgggtggtactgttttgcagcagtatctctctgttctcatattgtgccttcttgatgttttagtccaacatcgattgtatcaacttcctatatagattatctgtgttgcctagtattgggtatcaatccaaaggaaattaaatcagaatctcaaagagatcatctgcaacttccacactcattgcagttatctcacaatagccaatatattggaacaacttacatgtcctagcgaaatattggcatatattaccacaatgaatatattcagccatgaataagaatccgccagtcggagaatgcttgaacc

SEQ ID NO: 636995 - DNA, 740 bp, Homo sapiens
ctccgtcacgcaccatctcccctcccccgtggcgaaggacccatcgagatcaatggaggacttatcaaatacatcaacacggtggtgtcctgcctggtgttcgtgctggggatcatcgggaactccacacgttctgagaattatctagaagaacaagtgcagtgccgaaacggtcccaatatctgtgatcgccagcttggctctgggagaccgtgtgcacatcagtcattgagcatccctatcaagtgtctagcaagcgtgctggtcagaggactggccagttggagctgagatgtgtaagctggtgcctttcatagccagaaagcctccgtgggaatctaactgtgctgagtctatgtgctctgagtattgatcagatatcgaggctgttgcttacttgtgagtaggaatggaaaggaatcggggttccataaatggatagtagtagaaatcgttatgattggatggtctctgtggttctggctgtccctgaaagccataggtttgatataattacgatggagtactaagggaagtcatctgcgaatctgctgtgcattcatccgcgttcagaagacagctttcatgcagttttacaagacaggaaagatggtggtgtgcagtttctatatctgcgttggcaatggcagtcagtggatgtgttatagatgaatgactgggaaatgttgagaaagataagtggctggagatgggtttaaatgatcactagagcagagacg

SEQ ID NO: 636996 - DNA, 228 bp, Homo sapiens
ggtttctggaaagttgtagcctactggaatgaaagactcaccaaatcagtttgtggtcttcctgaggcaagtcagtcagcttcctactctgggtatcttccatggctaccagctgggcacagaaccaagcactgactcaacaacctccaggtctggttccttatcaggctttttgggaaccctacaggccatagtacattatccattctggccatttcagatttcttc

SEQ ID NO: 636997 - DNA, 493 bp, Homo sapiens
gatcgctacagcaggatcgcttctcctgctatacttccacacaactggactataatagccatagatttcacagactgtttctttacgatgcctttagctaagcaagactgtcacaggtcgcatttacaatttctgcagtagacaaaatgcagccagctaagatattctcatagtataacagatgggtctcagtcaatggtccaagcttcttcattctggctatgaaaagtaacagtttatccagcacgcccaatcactttcagctcaaaaagagcttgtagctgtaattgaggtcattgcactgcttttgatcatgcctctcacatgggatttctgcatcttcatcatgtggttccattcacacaccagttaattaaaaatgctcagttattatttcatacagataaacaactgcatgacacaaaacaaaaccagggggagaactcggcattacgggccagcccatacaccactacctctcacattattaact

SEQ ID NO: 636998 - DNA, 856 bp, Homo sapiens
  misc_feature (26)..(26): n is a, c, g, or t
  misc_feature (28)..(28): n is a, c, g, or t
  misc_feature (48)..(48): n is a, c, g, or t
  misc_feature (50)..(50): n is a, c, g, or t
  misc_feature (52)..(52): n is a, c, g, or t
  misc_feature (55)..(55): n is a, c, g, or t
  misc_feature (58)..(58): n is a, c, g, or t
  misc_feature (64)..(64): n is a, c, g, or t
  misc_feature (66)..(67): n is a, c, g, or t
  misc_feature (74)..(74): n is a, c, g, or t
  misc_feature (76)..(76): n is a, c, g, or t
  misc_feature (78)..(78): n is a, c, g, or t
  misc_feature (80)..(80): n is a, c, g, or t
  misc_feature (84)..(84): n is a, c, g, or t
  misc_feature (88)..(88): n is a, c, g, or t
  misc_feature (93)..(93): n is a, c, g, or t
  misc_feature (109)..(109): n is a, c, g, or t
  misc_feature (114)..(114): n is a, c, g, or t
  misc_feature (116)..(116): n is a, c, g, or t
  misc_feature (118)..(118): n is a, c, g, or t
  misc_feature (125)..(125): n is a, c, g, or t
  misc_feature (129)..(129): n is a, c, g, or t
  misc_feature (132)..(132): n is a, c, g, or t
  misc_feature (142)..(143): n is a, c, g, or t
  misc_feature (156)..(156): n is a, c, g, or t
  misc_feature (173)..(173): n is a, c, g, or t
  misc_feature (187)..(187): n is a, c, g, or t
  misc_feature (198)..(198): n is a, c, g, or t
  misc_feature (208)..(208): n is a, c, g, or t
  misc_feature (228)..(228): n is a, c, g, or t
  misc_feature (253)..(253): n is a, c, g, or t
  misc_feature (271)..(271): n is a, c, g, or t
  misc_feature (286)..(286): n is a, c, g, or t
  misc_feature (327)..(327): n is a, c, g, or t
  misc_feature (352)..(352): n is a, c, g, or t
  misc_feature (356)..(356): n is a, c, g, or t
  misc_feature (359)..(359): n is a, c, g, or t
  misc_feature (381)..(381): n is a, c, g, or t
  misc_feature (389)..(389): n is a, c, g, or t
  misc_feature (403)..(403): n is a, c, g, or t
  misc_feature (414)..(414): n is a, c, g, or t
  misc_feature (486)..(486): n is a, c, g, or t
  misc_feature (503)..(503): n is a, c, g, or t
  misc_feature (506)..(507): n is a, c, g, or t
  misc_feature (514)..(514): n is a, c, g, or t
  misc_feature (516)..(516): n is a, c, g, or t
  misc_feature (518)..(518): n is a, c, g, or t
  misc_feature (533)..(533): n is a, c, g, or t
  misc_feature (599)..(599): n is a, c, g, or t
  misc_feature (662)..(662): n is a, c, g, or t
  misc_feature (689)..(689): n is a, c, g, or t
  misc_feature (710)..(710): n is a, c, g, or t
  misc_feature (770)..(770): n is a, c, g, or t
  misc_feature (783)..(783): n is a, c, g, or t
  misc_feature (855)..(855): n is a, c, g, or t
ggtgtcgtgaaaactacccctaaaancnaaaatgggaaaggaaaaaantnanatnaanattgtngnnattgganangnanattngggnaagtncaccactactggccanctgancnanaaatccngtgncancgacaaaacnnccatctgaaaaanttgagaaggaggctgcngacatgggaaaggnccccttccagnatccctccgnccttggctcccctgcccccnccccgcccccgcggtatcccccttnccccccccctgtggccancccccccccgccccncccctgcccccccccttcctcccccccgccccacccccttncccccccccctcctccccggccccncccnccnccccccgtcccgtcccgcttcncccccccngcgccccgccgccncccccccccgncccccccccccctggcccgccccgcccccctcccccccccgcctcccccctccgcgcccccccccccccccntcccggcctcccccccnccnntcccacngnanccacccaacacccanaagcgctctgcggcccttgttccggccgtccgcccttctcttccgccccttggctctccccccgcncccgtcgcctttgtgcccctttctggttggcctggtgcgcccctgctggcgccccgtgctccnctgccttggttcccgggctggcccgtnccccgtccggctggccctgcncgtggccccccgctgcttgcggctctggcgtgcctcctccccccccctcgtccccctgcnccgcccttgcgcntgcctctcccggctgtctccccccttggtggtcttggtcctgttcctgttggtcgcgtggcgcttggtgttnt

SEQ ID NO: 636999 - DNA, 280 bp, Homo sapiens
gcagagaccctgtctcgacttatcgccagcattgtactctatcacacgcggatatctaccttgtctcaagatagacaacgcactgggaacatttcttcgatcccaaggttacccagatcaaaccagagcaggaaagctgatgcaagctacaggacaggccctctgctatttactacccagcaaaggttggactatacacacatcctttgtgtcgatttcaccaagaagtggagacttaacggaatcaggccatctcaaatacttagcttccaaagtatcc

SEQ ID NO: 637000 - DNA, 150 bp, Homo sapiens
cgatactcagcttcttagtagtatgatttaccttttgtgatgcctgcatgtatacagcacctctgctgggccctgtggagtgtgctagtgagcagctggtgccttgtgcccatgctcaataccttctataagatgtccagatgaatgcgt

SEQ ID NO: 637001 - DNA, 1277 bp, Homo sapiens
tgccagacctgacctgccagcatccgggcgtggggtgaaatctcgtatgattcctagtcctctcgatatggcacctccgcatcagatctattgccagaggcttaccgcaggcccagcctgtcctaggctcttctaagctcactgcctgacttcacgggaggatccggacccccgcaacggtcaaccctgcggagctgggcagcaatatcgcacggatgacatgccactcccctggagctcccgccagctagctgccacgaacagctgcgagcagaacgacttgcctacactgaccaaatacgccctaaactcacgcagctatcctcgccaactccttggagcccctgcgcctcgagcttcacggcaccctgctcagccctctcctcgctcctcggccccctcagcgccggcactgcacacgccccacgccaccctcacacggcacccacacccccgcgctaccgcaccgctgctcgcaacaccctcccgcgcccgcgcgaaccacgcgctcgcacctctccacactctcgcgacccctcgcatcccctcacgccacgctcatgcgctaccacaccggcacaccaacacaccaaccacaccaaaccacacccctgaccccactgctcgctcccatccaaccaacccctggcgaacacatccacaactgcctcgtgctatccctcgcctgccctgggccccccccacccgcaccactaccagcgcacccctaactccgccctaacctgccccccagtcgccccgccaccaccccaccccccgacccccgcgccccccctcaccaccgcaccctcccccctgcacacatgactcctgctcccccaactggcctcccatgcaaccacacactcccacccccgcaagcccccacctcacacgccccatggcgccccaacaccacccgccaaccatgcggaatacgaacccccgaacctccccgccaagcccacgccgccgcacgccccgcaactcggcccacacccggccccatcgaacccaccaccccgcgcgactcccaagggactacccccccacaagcccaacaggaccattcacgcccccaaaacacagcagcagcccctctcaccccactctgggcaaccacccaggccagcacgcaagcacctccccgaccacgacccacaccccgacccccacacccaggccgccccccgaaccgccgcccacccaacgcacacccccaggtaaacccaacacctgcgccacgcgaacctccccgccgcacaccacccgagcac

SEQ ID NO: 637002 - DNA, 1181 bp, Homo sapiens
cacatcttctagctggttctctgcgtgcacagctccgtcgaagggagggggtggaagatggaggaactatgactcagagttgagaggagaggcaggtgtgtgcaggtgccatcacctggatcatgaggtcacccctctgctggctcctcccacttctcatcttggcctcagtggcccaaggtcatccaacaagacgagcaagacccgggactgggctcgggcgcagagccaggcccaggccctaggctcgaaactgagactttacctcagcctgatgaactctaagcagagcctagatgatgagcattgcctcctcccctccgcgtcctagtgcctcgtcctatctaatcttcctcgtgacttggtccctcggctggaatgcatacatgagctccgcacatggatttcccaatctgccgctctacatgatgatagccagtggattctgcgtaaatggtccctgtcatcccgtcccagcataccattacagtctatctccagaactaagcttacatcacttgagcatcccggtggacgttcctttccatgtaatgccagcgaggccttgacgagtggtattatatccgtggacaaggtaccgagaatccggctagaattagacctataggggtgcctggacgaaaacgtgaccggcctttggctgattccatcgtacactggcagaaaggaaggcaggtcggaaaagagtgtccccttcggacccttgtccccccgggatacttctggaaaggaggtctggagggacttgaaagccgaagataacagcggtaattacattccaaaggaaactactccgggcagtgggttgtcatttcgcaggcaaaaggccttgggaccgaacatacttggctggcataccgtggggagtctcccgaaggacagcaattgaaaggggctttgaagctaaccgggacggttctttcagaagccaccaggaagacccttttcccaaatgggccctccgatgaaaccgtcaaatggtaagtatgcgaaacttagtgccggctactaataattccttgaacgaaaaagaatttccggggccacagggtttcccacaacagggcgagattaaagccaggtctttagcgtggagacagacacacaagagttcggaagacagccctaaagggtgttatttcaaaaggaggtatccacag

SEQ ID NO: 637003 - DNA, 784 bp, Homo sapiens
agcgggggatccaggagcgaggagccggtgagcggggaacagggagtcggggagccgtgaaccggggcatggcagtaggcacgctcagtgagtcacaggctggactcttgcctcgcgctgggctgccgtgcatccatgaagcattgcggtgaccggggaggccgtggagctgcggagcctgtggcggtgaggcactgcgttgcgtggtgtgccgggatgcggtagcttcgggtgcgtggtgtgctcagttggtatctgtccatggactctctagtctagctctatgcattgggtcatccctgtgaccaatcggccgcgtagtgacgccgatgtgatgggccgtagagtgtcccagatggaacctgaggtctgcaggagttcctggaacggcgactacttcgcgggagagctctacctggatgagagcaagcagctttacaaggaggctaggcttcaagcggtacaacagtgctgagcatcctcgcgcagccagctctggggaagcccgtgcgtgatgtggctgccaaggccaaggccgttggcatccaggggaacttgtctggggacctgctgcagagcggagggctgctggtggtcagcaaaggtggtgataaagtgctcctgcatttcgtccagaagtccccaggcgactacgtccccaaggagcacatcctggaggtcctgggcatctctgcggaggtctgtgccagcggaccggctcaggtgtgaccagagaggtgtgcagggacggcgaaggcgctgggctccgacggatctgggtggc

SEQ ID NO: 637004 - DNA, 850 bp, Homo sapiens
tctggcgttttcatactctttatggccaagggtttaaaagggtcaacataaaaaaaaagacatttggataataactacggctcttggggctgtaataaataaaaaatttattaacaaggaagtgcacttttccagccacaagtatcttcaaaaatcaagtgacaaaaaattatatagtggccatagtgcacagtatacgcagccaaaagcgtgctccaatttacagcctttaaacaccagtgggagcttccatcccgttctcccctcccctttcgaggaagctatatccacagtctccaagagatcctcgtggccctgcaaagtggctctcaacagaagagaattccaacgaatcaaggcccccgttgccggcaacaatgggtcggacaaacacctttaaaacaccagcggtcatctcagggcaacaccggccatccgggctcccacctcctgggattggctccaaagctccaagaaacgggtagtgcctatagccggctcgtggtccacccagtccagcaggcccacgagggggcacatcgtcttccggaaccaccccacagtgtccaaccctcccttccgacaacatagctctcagaagtccatcccttggggctctccccgtgtaagatcctccgcaggggaaccacgacggatgtccccaaccgggtccaatcgaacaacgctcctcccaggaaccatctctggctcaggaggccatgttccgggcaatctccatccgaccacaacttctgcatgacaccgcccgacatcagacgaagttgcacccggaccgtggcgaacccaaccccacgacgacggaacaggcatccaaccggcacccaacgac

SEQ ID NO: 637005 - DNA, 490 bp, Homo sapiens
  misc_feature (109)..(109): n is a, c, g, or t
  misc_feature (113)..(113): n is a, c, g, or t
  misc_feature (120)..(120): n is a, c, g, or t
  misc_feature (136)..(136): n is a, c, g, or t
  misc_feature (156)..(156): n is a, c, g, or t
  misc_feature (172)..(172): n is a, c, g, or t
actcgggacctctataggatccgcaagccattcattgcagtttgtgtgtctatgtaaattctaaccttgaaccatttttctttccacacaaacgtaggtttcccaatgntctngcccatntggaggatttcctctnacctctgcagtgcagctacngtccattttatggctngcaccagtgtcctgatccaacccagtcatgaaccaagctcaagctttttcccactctttcagttggtcataaggcaagcccacgcaaccacaggtgtgagagaagggaaagtacttatgtaacagtgatggtctgatgatgctgacactttgatctcagacttctagcctccagaactgcaatcccagcactttgggagcctaggcaggtggattgcttgagctcaggagatcgagaccagcctgggtaccacggtgaaactctgtctctgaatgccccagcaaagggcacgactacttccggagccgcaccggaccc

SEQ ID NO: 637006 - DNA, 474 bp, Homo sapiens
  misc_feature (331)..(331): n is a, c, g, or t
tttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatcgcatcgggagaagggagggagagaattttattaaatgtgacgnaactgcctccgcccggagcagctcagaaggagagctctatattttatgcacatgtctgacggcggggaacgttgcctgccttgattaggagtcatgagtgtgatgtggagacgggaaccctgtggtatcaacttgcgggaggc

SEQ ID NO: 637007 - DNA, 224 bp, Homo sapiens
cgcattcagcactcttctgtgctctggaaaaatttccttccccttccatttagtgtctttgctgaaatactgtcttggcatctgtatctttccctcaattcccttgagcatttatgttcttgttcccctagctgatttctcagcatataataatgcttactccagatatattatctttatgctctgaaaaatggtgccgacttagacccaaagtgacctactat

SEQ ID NO: 637008 - DNA, 104 bp, Homo sapiens
agtgtcttttcccctcaaacagaccccctactatctcttgggactctctctccctgtccctctcccgactgtgctaccgacgtttctctcgctccagctgcgtt

SEQ ID NO: 637009 - DNA, 354 bp, Homo sapiens
ggccctacattcgaaaggcaacattaggagacggctctgtatagcaagaggggcctgatgactgtgggaccgagagctagcagacgcactttagatgcttatagctcttcctgctaggaggaggaggtagtggatgtacataatgtgtggaactgccgactccaacagagctgaggccacccccaatggctactgccactgctggaactgaagccacctccaactgccaagaccactgccataggagtagctgcttcctccacccaggcctaagccactgccgacaccactggcaccgccatagccactggagacggtggactgcaacaaagagatgtagcctttcggagaaga

SEQ ID NO: 637010 - DNA, 134 bp, Homo sapiens
  misc_feature (87)..(87): n is a, c, g, or t
gctcggtccatctcatggcgtgataggtcacaagatcgatggttttatagggtttccgcttggcatcttcctcattttctctgctancaccatgtaagaagtgccattgcctcccgctatgagatgttggaagg

SEQ ID NO: 637011 - DNA, 3459 bp, Homo sapiens
  misc_feature (2441)..(2441): n is a, c, g, or t
gagaccacctacctgaagcccactttttgtgacaactgtgctggatttctctggggagtgatcaaacaaggatatcgatgtaaagatatcaggatactgcttctgatgctgagattcactgataagggctacatcaagagtgtgagctctgggcttcaccaagtgagaagaatgctagcttcattaggaatgttaagtgtcttagctccagaagatagaacagacatgtgtgacaagaaagcactgcatgaatttggttgtgagacacactggggaagagagaaaagtgaaagacttcttgacccaggatgtcttgtccacagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccantagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctacaacaaaaaaaaa

SEQ ID NO: 637012 - DNA, 959 bp, Homo sapiens
  misc_feature (17)..(17): n is a, c, g, or t
  misc_feature (19)..(19): n is a, c, g, or t
  misc_feature (59)..(59): n is a, c, g, or t
  misc_feature (73)..(73): n is a, c, g, or t
  misc_feature (82)..(82): n is a, c, g, or t
  misc_feature (236)..(236): n is a, c, g, or t
  misc_feature (293)..(293): n is a, c, g, or t
  misc_feature (305)..(305): n is a, c, g, or t
  misc_feature (352)..(352): n is a, c, g, or t
  misc_feature (389)..(389): n is a, c, g, or t
  misc_feature (397)..(397): n is a, c, g, or t
  misc_feature (414)..(414): n is a, c, g, or t
cgccaggcctcgccgcngntctaagctgtccacatccctggcctcagccgccacatcancctgacctgcttangcccagatnttcttcaatcacatctgaataaatcacttgaagaaagcttatagcttcattgcaccatgtgtggcattgggcgctgttggcagtgatgattgcctttctgttcaggtctgagtgctatgaagatgcacacagaggtccagatgcattccgtttngagaatgtcaatggatacaccaactgctgctttggatttcaccggttggcggtagtngacccgctgttnggaatgcagccaattcgagtgaagaaatatccgtattgtggctctgntacaatggtgaaatctacaaccataagaagatgcaanagcatttngaatttgaataccagancaaagtggatggtgagataatccttcatctttatgacaacaggaggaatgagcaaacaatttgtgatgttggatggtgtgtggcattgttttactggatactgccaattaaagaaacgtgttccctgggtaggagatacatatggagtcagaccctttcgttaaagcaatgactagaaagatggatttgtggtgtatgtgtcagaaggctaaaggtcttgttaacgttggaaaggactcgggaatccctttttataatggtggtgcctatttctttccttggacactatgcagtttggacttcaaagccagatgggcaaggttgcatccgtcggaaatggttaatatcatcactggcggcatgaaacccttgagcctctatgaaatgtgggaaactccttccgggtttgagctcaactgggggaacactcaggatcttttcatacgctgcacgaacgtcgcgcggacgacgctggggctaacaggggggacccaaggtgggccctgtaccttgcaaccaacaactccgaagatgggaaacccagg

SEQ ID NO: 637013 - DNA, 3317 bp, Homo sapiens
  misc_feature (1)..(1): n is a, c, g, or t
  misc_feature (18)..(18): n is a, c, g, or t
  misc_feature (2299)..(2299): n is a, c, g, or t
nagtggagagctccaaanccagggtccaaatgaaactctgtggcactgaggcaggggcttcaacttacctcccaaaacagaaaccctctaagcaaccgtgcaaacagaagatgctctttctcagggtggatgtagcttgacaccagtggccatgtctgggccaaagcccctggatttagccctcaccccctaaactgggtgcctgaaaatgggtcctctttgaacatatggaactccagtaccaataagaaaggtctcattgaaactaatgtctcagtcttgagtctctgctttcctgagctagagtactagcatgtcctgtatcttcctacagcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccantagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctacaacaaaaaaaaa

SEQ ID NO: 637014 - DNA, 120 bp, Homo sapiens
ttctctcgcgaactaatcacgaattcgtgattagttcgcacggagaatccaagcttggattctcaaggaccggcagttgcgcgcagagcaccctgatgtgcccggcaccacgggcactca

SEQ ID NO: 637015 - DNA, 124 bp, Homo sapiens
  misc_feature (78)..(78): n is a, c, g, or t
tgagacccctccaagatgaggaatggtgtatcatactgataattcgtgttgaggaactgccatagtttcccatagtgnctgcccattttacattcccatcaacagtgtacaagtattccagttt

SEQ ID NO: 637016 - DNA, 276 bp, Homo sapiens
gtccgacgtcatcttcggctcggctgcataacgacgtcgtatccgcgaagaggcagtacgaaagagacactgcgataaacgcaatgtcggtcgggcaaaggcatccaagcccgtgcggcgaaaccgaaacgccgctttcagaaaggttaaggacaacgaataaagcaatcgccgaagacgagggcttcgcgcgacgatgcgctcgacaagaaccatatcgataccctcactagacctcggatcgaaataaatcagagcgatcacatcgctcgtgaa

SEQ ID NO: 637017 - DNA, 143 bp, Homo sapiens
catggcgtcgtcttagatgtcgtgactgggagaccctgtgtgacaaatagcagcaattggtgagagacaagagacagcagttggcaatgacagcaatgagacggtgaatgcagtctgtgattgagtgatgttggtgaaacttg

SEQ ID NO: 637018 - DNA, 983 bp, Homo sapiens
  misc_feature (227)..(227): n is a, c, g, or t
  misc_feature (250)..(250): n is a, c, g, or t
  misc_feature (277)..(277): n is a, c, g, or t
  misc_feature (340)..(340): n is a, c, g, or t
  misc_feature (371)..(371): n is a, c, g, or t
  misc_feature (387)..(387): n is a, c, g, or t
  misc_feature (394)..(394): n is a, c, g, or t
  misc_feature (767)..(767): n is a, c, g, or t
gattttctttggaaacgcacctgcgcattaaatccaggcttcgtggcacctgcgggaaaagtcaagatgggaccagtgcccacgagtcctgaccgggcaaccctccgcttggacctgcaagagatcaacaactggttcaaggcagcagatgaaacgggaagctcgccaggtccacaaaggaaattcccgatgagatcagcattctccttctcggtgtggcgcacttncaagggcgcagtgggtaacaaantttgactccagaaagacttccctcganggatttctacttggatgaagagaggaccgtgaggtccccatgatgtcggaccctaaggctgtnttacgctatggcttggattcagatctcagcntgcaagattgcccagnctgcccnttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaaagctgaagctgaagttacgaagggcgaagtcaccaagtccctgacaggagatgaagctgcaatccttgtttgattcaccagactttagcaagatcacaggcaaacccatcaagctgactcaggtggaacaccgggctggctttgagtggaacgaggatggggcgggaaccacccccagcccagggtctgcagcctgcccacctctaccttcccgctggactatcacncttaaccagcctttcatcttcgtactgagggacacagacaccaggggcccttctcttcattggcaagattctggaccccaggggcccctaatatcccagtttaatattccaataccctagaagaaaacccgagggacagcagattccacaggacacgaaggctgcccctgtcagattttcaatgcatacaataaaagagctttatccctaaaaaaa

SEQ ID NO: 637019 - DNA, 504 bp, Homo sapiens
  misc_feature (71)..(71): n is a, c, g, or t
ataaaccagagtaagtgctccctgctgttcgccttgttcctgttggtgtttaaagatcacttacactgcangaggcagaactgatgcccaggagaggggcagtaactagcagaagggaaacagcccgggtccagtttacttcccctcaatgtgggccaaggacgccaggcaggatcatagtccggctggattgtggctttcctcaaggtgatcttgacttgcccaggtgggatttcacccccacttccttccaggcttcccattttagacttgaaatgtaggcctgttggggcctcctccagtagatgtgtgcccttgagcttggatacccccctgccaagatacgcctttcaaaaacagataaacttatcgcaactgaatagaaggggctcccaaggggtcccaccctgctccggaagtctcagtgaggaatcaatagctgttaattccaatgtgctgcccccctcttaatactcaccaataaattctacttcctgtccacct

SEQ ID NO: 637020 - DNA, 301 bp, Homo sapiens
gtggaatccgctagtggggttcttggaactcatcacccattggggcacctataggacgaactattgtaccgtgattgatttcctattaattcagggttccgtttacagtctacaactaaaatctaatcatttaatcacagttgtacaaacaactgggaatataacagctacataattctttccaatatattagctatccgcatttgtgtttctagaattaatctatagacacataatgtgtccatttttcaagtctagtactacattgacgatgccctttttatttgaaaattaatttctt

SEQ ID NO: 637021 - DNA, 148 bp, Homo sapiens
tgtactcctcccccgcctttattctcactgtggaggaatcctggaccaatgcacaaaaacttaacaaaagtgatgtaaaaatgaaaatgccaaataaaaatctttggaaaagatgcctggatggagtaccaccatgaggcaatgggga

SEQ ID NO: 637022 - DNA, 476 bp, Homo sapiens
  misc_feature (250)..(250): n is a, c, g, or t
tttcagaagttccaatcagccaaaacagcaaaactgggcaacaactgtagtgtcatgctcaatcacaggcagcatggttcaaacatcatgtgccattctcacgcatggcaataatggctcactaaagcagtaaacacccagaccatttccaagataaccgcaatcccaagggcaaacataatcatcaacacatcacaggccggtcatgcatgcccattgtgttcatgtcacgtacagcacgtcccatgcnccatcaaacacattcatgtcacaggcacttcatcagccaacactgctcaatgtttaaccctgggcataccagccagcacatttgaacacaagccagagcacaatcccaagaacagtttccactttcaattcgtgtactggtttgcagctttctatggtagtgcaggatggctttacattcatccctgctatggcaaacttctcaaaactcagggggatcctctcaa

SEQ ID NO: 637023 - DNA, 378 bp, Homo sapiens
  misc_feature (72)..(72): n is a, c, g, or t
  misc_feature (92)..(92): n is a, c, g, or t
  misc_feature (107)..(107): n is a, c, g, or t
  misc_feature (119)..(119): n is a, c, g, or t
  misc_feature (151)..(151): n is a, c, g, or t
  misc_feature (289)..(289): n is a, c, g, or t
  misc_feature (358)..(358): n is a, c, g, or t
tctcgaaactccctgtccctcagggtgatctgccccgccctcgggccctcccccaaagtgcctggggatcanagcccgtgagcacccgtgcnccagcccaagtgtgncatgttttcaanctctcccctgttcctgatgcctcagagttganaactacacaaacactgcaactggctttgctttttgtcctgatggtatctcacaaggcttccctaatgcaggcagtcttgttttctagacaatctaccaaccctagcccacaacacccttctggtgccataataagggnacactttgtaaattaaatgtgagtgaaatcaaaaaggtttcctgcaaggttgttttctgagacttgggnaataataaaattctgtactg

SEQ ID NO: 637024 - DNA, 981 bp, Homo sapiens
cgatcgcacgcgtccgatggcacagtatatacatacaatacaagaaagtactcaattggtaataagtatagctcagctgaatttcttcataaaatgaaatagccatgtaagcaagatgtaaaacaagccacatgtatgagaacaaagaaataaagaggataggggctaccagatgaatgtgtgcgcgtggatcccatcgggatattactaaatgtttgtgaccgaggataagtaaatgagatgaaagaggactgttctgagtggactatgtggaagattcaggatgatctatagtataaatgcgccattgatgagatcttcggatctcatgattctaaggagtgtatcgcctgtctaatggtagtgactagaaggatatttgggatcgttctgaatgtgaaatttgggcgctttaatgtttatcagaattttctcaattgggggctttgtcccctcacctctagggccaaggtaaattctaggactagggacataactatgtcaatggaagttcccaatactagagggttttcctaaaaggtcaggccaacaatgaccttatcagatcaaatgcttttgaacacagctcaatcgtagatgtttgctagaagtacaccggtgcattcttagtcgcgaaagtcttttatttgcagcgtgggcgcagaggtttacacacacctgtatatccccgcagctctggcacaggcctagagggctctagaaatgaagcccgaagttcgaagctagcggctcaagtgtgaaacagcccgggtgctagtagcacctaaggacaaactaacataaaaaacagatccgaaatacacaaaacagaggggggcgcggacagagaggacaccgcacggggagcaatcacgcgccgccaggttcccaagggcacaagagaaacaaaaacaagagggggcaaaacgcaggagaacaccgggcacgggagacacaccgtgggccgagcagagcccaagg

SEQ ID NO: 637025 - DNA, 568 bp, Homo sapiens
gggtgactggtaaggaggctccgcgggcttagtgagagtgattgtgaaagtggccaggctctctggatcagaacgccagctctgtattccactagctgcgcaatggtgagcaggctgttcatcttgatgtcctcagtcccctatccccaaaaggtggctctcagtagtgtgtccccagggcctatggagggatatgagggaacatgatcatgagacacctcatggctctgaggcatctggatcccggctcagcagtaaccatggctgtcaaaagtgctggtggtctctgcccacagagcatggaagatgtccatcgatgtggctcactttatagaactcttacttctcggggaaactcttctccatcctagcccacgttgggcgagtcattattctgccaagtggttgtgatgggcaggggaacactgaagctggtgaggatggcagcagggtccaatggtgggcaattatagaccccatgggagaccagtgaccagagcttctgtgggaaacccctagaggctggacggaaccagcaagaacccaggtgcccctctacgtagaagca

SEQ ID NO: 637026 - DNA, 151 bp, Homo sapiens
agcagctgctgagcaggagctgagctgccaatccatcttgaatattgacatcatcaggtgtcaagtattgacctggagcctgtagggaggagagagtccaaattagtccaatataagtaaataatttaagacttgtcccacaatcagcacc

SEQ ID NO: 637027 - DNA, 300 bp, Homo sapiens
tatctagagatccccgggattgcagagagaggttgtacccatctagttatctacagagtggactgatatggctaggatctgtgtacccacaccaaatctcttctaaaattgtcatccccatgaggtgagtggatcatagtgggcagttcctgcatgactgttctcatgcatagtgcgggagttctaatgagatcttatcatttaaaagtgaccatttcccctgcatgtgctctcgctcgctcgctcactctctcgctcgctcgctcactctctcgctcgctcgctcgttctctctccact

SEQ ID NO: 637028 - DNA, 1044 bp, Homo sapiens
  misc_feature (1044)..(1044): n is a, c, g, or t
agcggattcttgctgatgctggggcaaccacgcggaggtcgagacatgcaggccggctcaccgtggcacagcgcgggatgtgtatgagcgtgtcaggcgctgagagggagctggtgaaaacattcgaggggactatgcgcgttgcgaggccttcatagtcacgacccaaggtccagtcgaccggatcctgtatcgatggtacgtggatgtgcttgtgcggaaacctcctgtaaacttgaaggtcacttgctgggtcctgtatgaaactcgactctatgaaatttttgtcgctcataatagtccccagagggctcgcaacgagactatagtccccctgagcaagattggctagcttcatcgagcaaggtgtaatagaccgtaatcatcccgttgctttcatagacgccgacgtgtgcgagcaagtccgattagatacgaaccttgttattttgaaacgtaagaggaaacagcatgcatgggacagacgctactggggggacaggactcccataggtctttagtctagttgaccttgagaacggaagctatggagggccgggggaagcttctcattgttccccattcagcttagtggaggctcaatctgtttcgcatttgttgcatcggcgatacttttggggcagagatgaaataaataaccttgaacgcaacacattttaaaacttgcctatcaattgatagagcagcgaaggtgattagtccgggcggttggataaagcccaaggccaattgaaaccctgtcggtgccctgaattaaccggggggagaatttcataccaaggattgatgaatcttttcggaacgattatagtcattgggggaaccttttggactcccccgattgtacttccccttgggataggcgagtaaggttgcaccttgaaccaaggattctagttgcttgaccggacgacttccctagaagttttccaccttgtccagacattagggcggaactttcccctaggggtccaaatggataataccgagtcacggaagggcatatccttaaatatggcggcn

SEQ ID NO: 637029 - DNA, 152 bp, Homo sapiens
cttgatcacatcggcttcgagcatgactcctctatctcgatactgaccaggctgatattggcgcctggacggccacaatttccgaactacagcgaactttcggccagctcggccaagcaagataaggtatacggacaggtttctgctgaatc

SEQ ID NO: 637030 - DNA, 606 bp, Homo sapiens
ctactagatagcatacaggccaagagaatcaggaacaaagcttgagtaatcttcagggaagatgcgcaacactggattacctagagtcatcatcatcatcattttcaagttcttcatcactttctttagtaatacactgggcacgtgtattagctgggttcctttgcatcttatgaagtagtatgatgagttatttttctcttagatctagggaggtaagttagtcatcgttacccttaccaaagcatgctgtaggcatgtgtaaaatctctcaattctttctcttgtttacctccattttttgagttcgccacatttaacaggaagtcaatatattcctctgtcaccatcagttttcccttatggcttaatggaacttctaagccatgtgtactccggacagacaacagtagatttttcctctctttcccagcgttatgccagagttcctgaaaccagaatctatgccacggaatgcagcatctgtgcatcctgccattgtcgacactgcacatgaagaacaactggttcaaatttcaaagtggcatcaccatttggtttcttcagagctacaatcacatcatcttttacacaaagtttgcgtgc

SEQ ID NO: 637031 - DNA, 84 bp, Homo sapiens
ggctcctcgccgccgcttcctctcgagaaggcgcggggcgggctgtccggcccgcagggcggtcgagcccgcggcgccatggct

SEQ ID NO: 637032 - DNA, 228 bp, Homo sapiens
  misc_feature (20)..(20): n is a, c, g, or t
  misc_feature (33)..(36): n is a, c, g, or t
  misc_feature (42)..(43): n is a, c, g, or t
  misc_feature (70)..(70): n is a, c, g, or t
  misc_feature (88)..(88): n is a, c, g, or t
tcttatttgaatcactgatntaatctcctgtannnnaggatnnctggaccatctgcatttaatgaaaggngtataactcctccaggancacccgcctaggtgaggacctccaagttatctcttcatgcagtgaggtcagcaaggttgcaaaaactagcaaggtggaaacagtcccggactctgactgctgacatgcagaaggcagatctatatccttcgttctagagt

SEQ ID NO: 637033 - DNA, 131 bp, Homo sapiens
gcggctccaaggctgaattcattgtcggaggggcatataaactgtacggagcatcgggtctggctccttcgggacatctatttggcgctcaacatcaccaacggcgaggcagttgcagtgcagctagatct

SEQ ID NO: 637034 - DNA, 961 bp, Homo sapiens
cagcccttggggctcccggtgcccagcagtgccgggcctgtcactgaccttgctctaggatgattcacagggacgtcgtgggtggccagagggctcgtgggtggccagagggccccttgcctgcagcagcaagagcagaatggctggtgtgccaagcttcggggcaccagtgggcaataggagaattctgtcagtgctggggaagggagtaaggaagcaagaacagccttcaggcgtgggtctcccagccacaggggctgtaggggagaccccggaaggaggatggggcagctgtcttagaataccaatcacccaaaggagcccatattccatgtttaccaggagtaccagggtcctcaatatcgtcttcacttgcatttatttgcattttttgcttataatttgtcatttggtggggtctcatttcatatcacagtctctactttttcctccctatttgggcacagggagaggtggaccttcagctaagtcctccttggggaatttcattttaactctcaatataccttcagactccattagacccaattttaattttaatttttaaccaacctttctttcttctttcctttccttcgttctttctttctttctttctttcttttttttgacggggtctcactctgtctcccaggctggagtgcagtggcacaatctcagctcactgcaacctctgcctcacaggttcaagccatcctcctgcctcagctcccgagtggctgggacaacaggttcgtgccacaacgcctgggctaattttcgtattcaggaattctaaattttagtaccagaaggggggttttgcccatgttgctcaggctgggccttgaactcttgaagctcggatctgctccctcgagctccccaaaggctgggcgtacacgcataagccaaatgcctggttgagttctatttgagcacgtacaagattatacgagca

SEQ ID NO: 637035 - DNA, 348 bp, Homo sapiens
agctgattaggaatgctatttctttcttatctttctttttctatctttctctttcttccttccttccttccttccttccttccttcttccttccttccttttctgttcttttgtctttttttgccttttctagggctgcatatggagattccagactaggggtccaatcggagctgtagccactggcctacgccagagccacagcaacgcgcgatccgagccatgtctgcaacctacaccacagctcacggcaatgccagatccttaacccactgagcaaggccagggaccgaacctgcaacctcatggatcccagttggattcgttaaccactgccgcttttgtgtt

SEQ ID NO: 637036 - DNA, 383 bp, Homo sapiens
  misc_feature (268)..(268): n is a, c, g, or t
ggaggatgcactctgtagagcacaggctaacagagcatggttgagcaggcaggagttgggagctgcacccagcactcacacaatgttatcatggagctggggacagagcaggttccagagctgggtttgagtcctagctcctccgatgatgatatgacaccccagacatgtgcagggatgtcctctaagcctcagcttcctcactgcaatttggggctctgtctctttctggcagggagttattgggaagaccaaatgagatcatgtncccctcccaaaccctgcaaggcctttgcgtcacagttagaatgaagtctacatatagccctgtccactcgcagcctgcctcccttccccattcgcacccttacacacggagcccc

SEQ ID NO: 637037 - DNA, 842 bp, Homo sapiens
  misc_feature (93)..(93): n is a, c, g, or t
  misc_feature (97)..(97): n is a, c, g, or t
  misc_feature (259)..(259): n is a, c, g, or t
ggctgatactcactccgatacgccgcagagtgcgccgtcattggctgccgctgaaaactggtctcatctcatgctggtcttcctctgaggagnaccntgtggctctgtaacgtagatgctgggacttgttcaccacatccaatgaagcgtcatgtgcggacaacggcagctgttcctggaaccaggatcgaggatggagcctccgtgattgactcagtccacgtggggactctacagtctgagcacagaacagactccnagagtctcggaggcgctcggatcagtcacaagactgtaccgcccgcgaaagcctgagcaaggaatggaagccggcgggcagcgcgtgagatacgcagcaggcacggggcccgcgagttattggggacccaggaggacagcggcaatcatgaaaggctccatctctacatagcactgactcagagcgaaaccatgggtgaacccttgcagctggtctacgttactaaccaagaagcgacggaacggcttgctcacaatccagtcgcacgataatcgttagtggctgcaagacgtgcgggcctggactgggacgtcttccatccagcgggttacccggcagcgtacgccatacagaacgtgcaaaggagttaccatctgcccttggaactgaggaaccttgcgcctctttggacccgcgtgcggacagtggcagcctcaagatcaccaaagcgccaagtgggacggcgggtccatgcggcgagagcaagcgagagagtcatacctgggaggggccggtgcgttggaccgggctccgcaaaatacctggagaacgggaaacgagacgctgcagcgcaagggacccc

SEQ ID NO: 637038 - DNA, 899 bp, Homo sapiens
ctggtcgctgttgtgtgttgttcgccagcgtgcctgttgccgaggtccgttgactgtgctggttgtccgctggggccgggttcgcgtgacgcgacagtgtgaccgtggccggtccggtggtttggtttgggttgcccccccctccttggccgtggcctctgaaacccgtccgtgctgatgtccgcccctcggtcgcattacctgtcagggaccttaatcccataggctatccacagtgcagttgatttgttttcgcaccttctctgtcactgggtgggtttaaaaaggagttataattattcaaccgtattctagttttacatcctgatttatgttttttccccaagctaagtagccctcagattcaggctgggccctttgctcatgtgactcccgtatttgagaccaatccaatgtgtatatgtgatctattttatggcgttagaataaagtatgtttttcttcccttatttgctgttcatatgtattatagattttggtatttattagtaataaaattgtagattttattattacttgattaacattggaatttagaatccaccctaccaggagagtaccatagtatttaaagtggtttccatgatataccctgaagtcagaatcacctgatttactcctggctcagttatgtactagtcatgttgcctcaggcatgttacttagcctcatctataaaggaggtaaaggactatgtaacttgccggattattgtaggattaatgagataattttgtacagcctttagccccgtgcccaatgaagccctgtgtccaccaatagtgatcattttcattattaatatttgtgctactatttaaatatctttgatactaaagaaagagataaagtaataaaatggagtttttaaaaaccca

SEQ ID NO: 637039 - DNA, 295 bp, Homo sapiens
  misc_feature (3)..(3): n is a, c, g, or t
  misc_feature (180)..(180): n is a, c, g, or t
agncctgtgggagagacacagagagacgtggagagacacagagagacttttagagagacaaagcatgacaggacgggagagcaaggacaagctcaggtaagcctcagcttcctcactgcaatttggggctctgtctctttctggcagggagttattgggaagaccaaatgagatcatgtncccctcccaaaccctgcaaggcctttgcgtcacagttagaatgaagtctacatatagccctgtccactcgcagcctgcctcccttccccattcgcacccttacacacggagcccc

SEQ ID NO: 637040 - DNA, 314 bp, Homo sapiens
  misc_feature (42)..(42): n is a, c, g, or t
  misc_feature (67)..(67): n is a, c, g, or t
  misc_feature (72)..(72): n is a, c, g, or t
  misc_feature (80)..(80): n is a, c, g, or t
  misc_feature (91)..(91): n is a, c, g, or t
  misc_feature (101)..(101): n is a, c, g, or t
  misc_feature (104)..(104): n is a, c, g, or t
  misc_feature (119)..(119): n is a, c, g, or t
  misc_feature (127)..(127): n is a, c, g, or t
  misc_feature (157)..(158): n is a, c, g, or t
  misc_feature (197)..(197): n is a, c, g, or t
  misc_feature (236)..(236): n is a, c, g, or t
  misc_feature (248)..(248): n is a, c, g, or t
  misc_feature (259)..(259): n is a, c, g, or t
  misc_feature (294)..(294): n is a, c, g, or t
  misc_feature (302)..(302): n is a, c, g, or t
catcttccagtaattcgccaaaatgacgaacacaacgggaangcggagaggcacccgatatatgttntctcngccttttngaaaacacggngttgttcctnccngccacatatatgcgnatctatangaacggtgatattgtagacatcacgggaannggtactgttcaaaacggaatgccccacacgcgttaccanggcaaaaccggaagagtctacaatgttacccagcatgcngtcggcattgtngtaacaaacangttacgggcaagattctcgccaagagaattaacgngcgaacgngcacattaagac

SEQ ID NO: 637041 - DNA, 411 bp, Homo sapiens
tgacacatcgaggagtcacaaataatcctataccactcccctatggtgctttagtccccgaacttcagcactaccccgtatagatttgaccatccatttgcctccgccacaggaatacgtatgtggtttacctgtgtgcgggagggccgctgcgtttccaggctgctcctccagtcagcagcagtggtggagtgagaagaaacagctgataggcccgctaacctcagtttttgcccggagaagttatttctctttaaaccctttttttccctgtgacctgctttagagaagagttcataggaaaagttaaagtctgtctcaaagcctggtagatgtctcacctcattgtgaataaaccggaagttcctgtgtgtaacatccctccaaataagatactaaggatctctttcg

SEQ ID NO: 637042 - DNA, 726 bp, Homo sapiens
  misc_feature (4)..(4): n is a, c, g, or t
  misc_feature (74)..(74): n is a, c, g, or t
  misc_feature (106)..(106): n is a, c, g, or t
  misc_feature (125)..(126): n is a, c, g, or t
  misc_feature (137)..(137): n is a, c, g, or t
  misc_feature (149)..(149): n is a, c, g, or t
  misc_feature (156)..(156): n is a, c, g, or t
  misc_feature (164)..(165): n is a, c, g, or t
  misc_feature (173)..(173): n is a, c, g, or t
  misc_feature (189)..(191): n is a, c, g, or t
  misc_feature (197)..(197): n is a, c, g, or t
  misc_feature (207)..(207): n is a, c, g, or t
  misc_feature (215)..(215): n is a, c, g, or t
  misc_feature (223)..(223): n is a, c, g, or t
  misc_feature (228)..(228): n is a, c, g, or t
  misc_feature (250)..(255): n is a, c, g, or t
  misc_feature (257)..(259): n is a, c, g, or t
  misc_feature (275)..(275): n is a, c, g, or t
  misc_feature (280)..(280): n is a, c, g, or t
  misc_feature (282)..(283): n is a, c, g, or t
  misc_feature (293)..(293): n is a, c, g, or t
  misc_feature (302)..(302): n is a, c, g, or t
  misc_feature (304)..(307): n is a, c, g, or t
  misc_feature (309)..(310): n is a, c, g, or t
  misc_feature (314)..(315): n is a, c, g, or t
  misc_feature (319)..(319): n is a, c, g, or t
  misc_feature (324)..(324): n is a, c, g, or t
  misc_feature (327)..(329): n is a, c, g, or t
  misc_feature (339)..(339): n is a, c, g, or t
  misc_feature (346)..(346): n is a, c, g, or t
  misc_feature (348)..(348): n is a, c, g, or t
  misc_feature (354)..(354): n is a, c, g, or t
  misc_feature (356)..(356): n is a, c, g, or t
  misc_feature (358)..(358): n is a, c, g, or t
  misc_feature (361)..(361): n is a, c, g, or t
  misc_feature (370)..(370): n is a, c, g, or t
  misc_feature (374)..(374): n is a, c, g, or t
  misc_feature (378)..(379): n is a, c, g, or t
  misc_feature (386)..(386): n is a, c, g, or t
  misc_feature (433)..(433): n is a, c, g, or t
  misc_feature (436)..(436): n is a, c, g, or t
  misc_feature (440)..(440): n is a, c, g, or t
  misc_feature (456)..(456): n is a, c, g, or t
  misc_feature (461)..(462): n is a, c, g, or t
  misc_feature (464)..(464): n is a, c, g, or t
  misc_feature (481)..(481): n is a, c, g, or t
  misc_feature (502)..(502): n is a, c, g, or t
  misc_feature (724)..(724): n is a, c, g, or t
tggngtagcaaatgaatatatcaaaacaaagaaaaagcttgcatccaaatatttacattttaaaaagacatttnaaaaataggctacttattaagtgtgcttgaanaaaccatgtgtggaattgnngtccattcatnacggagttagtntctgctnaatacttnntgatgctngagcagacccctggcnnntggggntttaagagtncaactgtnctcaatcnatgcngaaaaaaaaaaaatgacaaagnnnnnntnnngcgtttccggggcgcnaattngnncttcagaggngggggggcngnnnngnngggnnagtnatttnggnnnggggggggcnggcagcngngactcngngnggntttgcaacngccnacgnnagtaccnggtattccataaaactctgtaggggccatttacatttcgtaaattcngtnattncaccttactgtatcgngcccnngnggtttcccaaacttagntattcacaaaaatgttttggnatatattccttgggaatgtgaggggtctcctatattacattaaacaaaaaaccatgcagttacttagagctcatagagctttctcaaaatcaactactgatcataacagccccattaaaaactcaaacactttatattacagatatagagtttataatccagcaatgccaatataggtaatttgatagcccctatttgcaaagtgattaacaattatacaanaa

SEQ ID NO: 637043 - DNA, 293 bp, Homo sapiens
  misc_feature (147)..(147): n is a, c, g, or t
gtgagactatctgggatccatctgggtgggtccaatgtcatcacaatgttccttataagagagaggcaggagagaaagaatcagaaaggcggcagcatgaggaaggctcagcctgacattgctggcttagaagatggaggagtgagnccatgagcgaaggaatgcaggaagcctctagaagctggaacacacccctgctgacacctggacttgtacctagtgaaacccatttcagacttcagacctccaaaactgtgcagtaataaagctgttttgttttaagccaccacaaa

SEQ ID NO: 637044 - DNA, 358 bp, Homo sapiens
gtacgcgcaggtggatctcttatttggcacgttaatacttttcttgtacagaatgattgtatgttcactggtatattgggtctactcttagaaccttccttcgcattgttgtttatgggacccatgaatggttagccttatcttttctatagtagaaggaaataaagtaggagtgtaaagaccattgtagtagagttagttcaaggggaacttgggaccagaaaccactgttatgtacaaaaaaatggcaatttccataaactcatgactaaaataattttttaattaacagttatcataaattttatatttcatacaaatagattgcttagaatggttctcaagaattataagagaa

SEQ ID NO: 637045 - DNA, 152 bp, Homo sapiens
acgatcccctttcatccttgccagcaggaccgacagcgccaggtggtccgggaacacctcgctctccagccttgccgggctctccagcagcacctttaggtccagggaatcctatcacaccagcctgaccacgggcaccaggtgggcctggg

SEQ ID NO: 637046 - DNA, 700 bp, Homo sapiens
  misc_feature (1)..(1): n is a, c, g, or t
ntaaggaaagcaaaatgggaggctcaacatggtgcgagcggtatattacccgtggcccccggggcaacaggtgttgaacattctaggagaaagccgatttttgcccaagtgtttccctctggcagaagcgtgtgcgccaaatgtttcctcctgctaatctccacaccaaaggtctcaaccctgggttataaagtcggccacgtcagcaacgaccactcgtttttctttaggttcccatgaaggttccgggccgcacaatcgtatcacctcacgttctccgcctgttcagcaagtgttctcatttggcgtacgctgacagtgcactgcaataaaagacacgagattagctctcccatgtaatcagtctaggttcttaaggcctgtcaagcatatagtattctgtggtatatgaggtaatgcagtgagtagagagttattttccgctttattttgctgagccaccataggtccacactccaatctgaatgtgtatcccccccgtgtaaggctgacatcaccacaattctagtttcctgcagcccaatatgtcttgtgtctgtgagacaggccggcgtaagcatggtaatcttgcccgggggcggtggctccccctgtaatcccaactctctcatgagttatagggaggtgtatcccctgcgggtgtaatgttaaccctgtcttaccgccgtgcaaaccccgt

SEQ ID NO: 637047 - DNA, 827 bp, Homo sapiens
gagggacccgcagatcaggtacggaacagatcagcatcatgaaagcttgtcacgggcctggttttctgcgtccttggtcctgggtgtcagaagcctgaagcttctcttctctgttccatttggtggaggctttagaatggggatcgggaacaatgtggagagccttacttctgtaaatgaagagaagccaattagattcggctcaagagataatactgccagagtcttcggggaactatgtatgcatgccaaagataggggaccgtgtgggggtgctctgggcggtggagaatgctgatcatgaggagtggcaaagagaggaatatccaggaaggattcttttgggtcgaatgggtgcgggagggactcgctggtttgaatctacggcgatggaaattgatattgagggcaaggaagtgggtaaaacgacctgcataatctatttgttacggtacctgaatgggtcgtgacgatgaaagaattattaaagtattgattcgtttagtctttgattctcaagggggatcatggtattgtgaaggctctgcagggacaagtggtatacaatacgcggtggataagggtaactcgatggggtagtctagaataaagtgtctttcacgaaggtggaagtttggggagacaaggaaaccttggcaaaagaacaacggttgacaaatctcggtgagtagtcaactgggcacagataagcaatgacaatagccaatgagggaggctgagagggagcgggctttaacttaatttaggggctctgagaaggtcacagggaaacttgaggcaatggaggtcggggtctgccaatgatg

SEQ ID NO: 637048 - DNA, 339 bp, Homo sapiens
aaaagagaggagtcactatttgctaatacaaacgctagtacagactgtcacaatttcttttactaaccttgttccaatgaggaaggggagaaaaagctagttcacatgccacttggaactttacaagtatactagggcccttttgattttactcagctatttagcatgctggagccagtttccttgtcttagatccaaaattaatcagttactaatgactccctgaccttttcctcatgcctgctttcaaagtgacctctccaagtttggccttctccagctgctgttgttccttcaaagagctattttctctactttcgtatacacccaaaagaaaaa

SEQ ID NO: 637049 - DNA, 385 bp, Homo sapiens
tgcagtgagctttttgtgtgccagtgcactccagcctgagtgacagactgagaccctgtctctaaaaaaaacagaacacaaacaaacaaaaaaataaaaactgaaacaaacaaaatatgacaggataaatgaagaagttagcattgggaaagtagtaactatcaaatatctagtcctgcagagatgaagataaagaagtagacctgtgggatcatgtagatattgattaatgaagagagttaggacatttgcatgggaggtattttgtgtttttaccaccccttttccccactataccataaactgcttaaagacaggacctgtgccttggctaccgttgcatgatacttctggaattatccttccatagacatgtccaaaaaaa

SEQ ID NO: 637050 - DNA, 126 bp, Homo sapiens
tctccatcctcacctgggctccttcctcggccctggtgaggatggaagacccccaaggcttggtgtaaccttgttccgcacagaagtgtttggaatgtgctgtaagattggaggacgtcgtttcca

SEQ ID NO: 637051 - DNA, 129 bp, Homo sapiens
ctgattaggactaagagagcagaacagaaccttccaccagctgaaactgtatctttggggctatataaaactggaagaatacctgaaaagtattcaccattcactacataacttcagaaacaggtacac

SEQ ID NO: 637052 - DNA, 933 bp, Homo sapiens
  misc_feature (625)..(625): n is a, c, g, or t
gcgcgagccccccagccgctcttcttagaagtgtgcaaccttgcaccagtagtggacttacacataggctccgttaggacctggcttatgtgctcggctgtggcttagacgctgccgtgccccagtggactcactgtgcctccccccacgacggacggaaatgggcccctccaggacaggcggcgcagtgcgcttgtggggcccgcgggcgggggggcgggagccgggagcacggtggagcggtggagggcgtcactgggttcggcgtctgcaagcggttcagctgtctgtccctagcagccggcttcgggtcgggcgtctccgccggttatgcgctttcagttctcccggtgtggccacgagtcgggtggcactgttgtgatccaatcctcaatctcctaaaggatgatcctgattatctccaattgtgcacattgaagaatgaaggtcttggattaatttgcttaaggaatgtcacaaaaatcacaacattctgaaatttttgggttatggtactgatgtgatcgggagtggagaaaatgcctgaagaatgagtacgtagaaaacaggaccaagagcaggagcatgcatgggaaatggaaagaaattttataatcctcagagnaattcggaaaaataaatgtgtattttcactcgatgctttggtgagagaagacctaaagattctggttgatacctgaaagaatctgtttatggggtctcatatcctttgaatggaaggtgcctgtggagaggttgaccttgggatatgaaaccgggttctgaattgtggaagggtaagatgttcctacaggacggttccagtatcttgtacagtgattggatttttctaatttaataaaaaaatgggtttggggagggaagaggaatttgccttgagggggcttgtatatttgacatatattataagag

SEQ ID NO: 637053 - DNA, 583 bp, Homo sapiens
agagagagagagagagagagagagagagacagagagtgacagagactgatgatgactgctatacatgaactcatgacactatttgttgcttttaattcttgcccatcatattactggtaaatctcacattgttatctgaattgatcacatattttttaacaaagcttacaaacaatccttagatccaactatcacgccctactatatcactgctctctcttaatttctccttataatcatactcatcttttttccctaacagtcctactactaccactgcatacaccagttatcttccttccatcaaatcctttctcacatgctgctactacttctatttttaccctatttgaactccttcccattcacatacaacccgtacttgccttctattctaacctgctcgttctttaactatccttattacttactcccttcactgccacgtctcctgtctatctttcaactcatcttaccttctactcatcacctccttttttatccacactctcccccctctttcccttctgtacccttcctcttcccctttctcacccttcatctcctttcctcttcccatcct

SEQ ID NO: 637054 - DNA, 139 bp, Homo sapiens
ccccctgtttaagcgacgagagggacagcgagacagagacgaccagagagacagacgacacagacgagacgacgaaccccgagaaacccgaaaactgttttttactggcaggtttacaacaaacgtcctcaagactttc

SEQ ID NO: 637055 - DNA, 102 bp, Homo sapiens
  misc_feature (7)..(7): n is a, c, g, or t
  misc_feature (9)..(9): n is a, c, g, or t
  misc_feature (19)..(19): n is a, c, g, or t
tgtgccngngccagcagcntagagcagggtcttggaaacaccatatattttggagagggaagttggctcactgttgtagaggacctgaacaaggtgttccca

SEQ ID NO: 637056 - DNA, 165 bp, Homo sapiens
ccataaatactatcatgctgtttgagccatgtcagcacaagtgctgtgatgtatctatgggagagaagctccctcttcgattggctgttgatatcagagtaaacagaatgcttcattttctctaagtcgttacagactttctcagaagctaaacatttgtaagtt

SEQ ID NO: 637057 - DNA, 165 bp, Homo sapiens
aagccgggtgttccagccagtgagcggagcgctacaagctggagcgctaccgaggcagagaagtccaactaattatgcaggcggaggcagaagccgcgtctgtgcggatgcgtgtgggaagctgagtgcctttgccatagggtgcccgagcccgagacctgaggc

SEQ ID NO: 637058 - DNA, 163 bp, Homo sapiens
gggtctctaggagctttaataaccaattccgggggcacttctggctgcccaactcaagggtgcaaatgtctccctgcaccatgccaggtgtgacgcagaatgggaggcagggggatggagcaaagaaaggcctggactgcctgtggcctttgtcgagtcactg

SEQ ID NO: 637059 - DNA, 120 bp, Homo sapiens
tatcagagatcccagtaagcgtcagggatacctagtaggcaggccctgaattggtgaggtgatggctgtcaccattgttgcctgagcaggccatgtcatgggtcaaggacctctgtccac

SEQ ID NO: 637060 - DNA, 271 bp, Homo sapiens
  misc_feature (181)..(181): n is a, c, g, or t
caattcaggtcacactacaattatgatggaagatattttttatacttaattgcagtagggactcattcccaggcaaagcaatagtctcgacctcatggaaccaatcaatggatcgttctttgaagatcgcgcaataacgctgtccactccattccccaccccggctctaaggtataagctntgatattttttcatgtttagaaattccttctgttattattcaagaaaatgtttttaatcatgctaataaacttttttggagatgaaaaaa

SEQ ID NO: 637061 - DNA, 392 bp, Homo sapiens
cagtcgcactgtgttaccaggtagtctttggctatgcttcgatagtcagcataatcccggacatcctcaagatgtagtcaccagagtataatgccctgatcaccgaagccagtgtatagcgcttaccactcacctctcatgttacaggtgaaaattgtgaggcagaaagtctgatgcatgacagaactcactgtcaggcagatagggcctcacaacgtcacgcagtctggaatgcagtggtacagtcttggctcatctgcagcctcaacgtgctgggctcacagtgatcctccagcctcagcctcgtgagtatctggggcctctgcagatgatacaggtttagatggtgctggcaggcagtacctcaaatataataaaagtggtcacttcag

SEQ ID NO: 637062 - DNA, 287 bp, Homo sapiens
tcgtgcggtgatcttgagtatccccaatgtcatggcagccggacaattgggttagcatttgtctatgatcttagcatttcctgccgttttgatcgatgaacgtgcgtgccctttgctccgggaacgtgaacgggtagtgatctttgaggatacttcgagatctactacggctgctcctcgggattcctacactatcgtgagcgtcttctagatcgagcacctggatctgcttccagagtaagcatcgcttggggttgtagcaacagcatttggtttggggggtccgg

SEQ ID NO: 637063 - DNA, 113 bp, Homo sapiens
tatagaaggtagcgatgaaaatcatgtcatctcatctagctgatgcaaagtaggtgaaaggttaggagatgatccaggtcacgtgactgtgatggagggtataaggtgtgaat

SEQ ID NO: 637064 - DNA, 1244 bp, Homo sapiens
agcgggctggtcgaggcctgtcagcctccgcccgttcagcctcggggccggggccgcctgccacctctgcccgcggaggccggggagcccctgcctgggcccgcagcctcccccgcgggggtcgggcccgggctggggtgtcccgagcagctgccctcctcgccggcatcctgagcctcatttcctgctttttcagtttccttggggaggggcgggtgggtctggatgaatttgtctcggggtcccccgatgaggcgaccctgggcgtgcctgccctttttagagggtccctcggggcccggttggggaagggggttgtctttgcatgggtgggggacttcccgaggtctgccggggaccatgactgaaacttgtgcgagcggacgtgtccgaagcccaaagaaccagctcatctgagccgtccccctccccggcagcatggcatctgaagaaagcctctctcagggcattggaacgtctgatgacagaatttttgcacggattgtacaaccaatgaaagaaaaccgtgagaatagaggagcttcttaataacttttgcccagccaaattagggaagcctggagaattcttgcctggttactttctctccagcactagcgaattgactattgtaatgatgtacagtttaaccagttttgagaatcttggatcaatacaactgttggcttgggggtcccatctcaggcatacagatgcgaaactcccgtaagctgttctggaccccaaaacatccttttgggcctccacccataaaagccttacctctaactttaatcccggaaccaaggctctgacaaaaggtacttggtggacaattggaacggtccaggatatgggcccaaggttctaaccagcgaactttttaaccacacgctttttcaccagttgagtaccacgtatcccgtgtgtgaacgagcccccccccatgtggggccgggatcccaagtgttgtcgacaacaaacacactatgcggacaagacagaccggggtgtgggttcaccgcggtgagaggcaacacccaccaagtggttgacttgcgacaggcgcgagcgatgtggcgacgactggtcatcgtcgaccaggggactgagcaacgaggtcgaggccaacggagagcgaacacgtggagaaccaggcagtggcaacaaagacggcgtggatgctggcccaccacggcaggcccgagactcgatacagaggggtcaatgacgaaccacgatcg

SEQ ID NO: 637065 - DNA, 416 bp, Homo sapiens
aatcacatctctatagcttccaaggatctggctgacttaaagggtggcatttactgggacaccatttggtgccaaccactccctatttcttccaattctcataataaccctgacagataaattacagcaaaaccaaacagttgtagaactaagatttagtgaggctaggcatggtggctcacgcctgtaatcccagcacttggggaggccgaggggggtggatcactgggaggtcaggagttcgagaccagccgggccaacatggtgaaaccccatctctataaaaatacaaaaattagctgggtatggtggcgcgtgcctgtaattccaccggctcgggaggctgaggtagaggttgcagggagctgaggtggtgccacggcactccagccggggcaacagagcgagactatctc

SEQ ID NO: 637066 - DNA, 199 bp, Homo sapiens
aggatcccatcgctgtatagcatttataaaatggtgttctgtatactttaacatgccccatactttgtattgtagagtacaataatgttaatcctataagcaccactattttatgcataatattaagaaagtccaatagagtctccatatatagaactactccatcatgacattcgctatctttagattacttgtagct

SEQ ID NO: 637067 - DNA, 596 bp, Homo sapiens
  misc_feature (596)..(596): n is a, c, g, or t
catgttcaagagaaaatgacacatatttttttttctttaaggatacatgttaagaatcggtatgctcgaccatcagtattaaagacgcaacttagatcaaatattgaccaaagtacatgggctgaattttgaatatagtataaatcatacttagtgagaggcttttgaactaacggcttacatttaataggtaattagcatgtgcacagaatatagtttatgacatattagaaaaatgaggttaaatcaatacttgggagacagagtagttatgagtgcagtatgttttctcctaatattgataaataggtggatttatgtaaaagaggtacagaaagaaaccggttactcgttgtgaaaaaaacaagtgcacattgcatcctctggtggcagatttgaacggaaacatcctcattgatgttgaggaaagacagcttatattgccttccagctattgacacatagccaaagaactgaagccatattgtaattataagatgcgcgtgtgtatgatacaggcgtggatctactactaggtccactatggttagattgagtgagctctaacttgaaatgatgagttagcacacaggagn

SEQ ID NO: 637068 - DNA, 527 bp, Homo sapiens
gtcagtggcgagatggacaacacagaaacgcgattacatgtgcagtccggcacaagccgccaccttgtgttatctcgtgtgtcttccctgttgctggccacatcctttacccaccgtgtctctcggaccactgaaggtatcagaaattccaaattttcaaagcagttgcagtattttcagtatatatgttggagattattataactggttcatggccagaaaaggttcagcacctcccacacacagacattggtccagattcctgtacttggcatctctgtactttgtaggtccaactcagacagcaactttaagattgttcagcgcagccatatcatggcaggactccacatccttgccgataccatggctgatcagaggtggctgagaggagcaattgataagagatacaaattcgttcttgtagtttatggggaagtctttgtattcaacctggaatccctggactctggaaagatagtccagttgctcagagggtctcgtgagaggtccatggggtacgtggc

SEQ ID NO: 637069 - DNA, 123 bp, Homo sapiens
tacgaggggaccctgtccacgtatcctgacaattggagggccttcaaggctctcatcgctgttcagtatagtggggctcaggtccgcgtgctctccgcaccaccccacttccatttttggcat

SEQ ID NO: 637070 - DNA, 328 bp, Homo sapiens
agtgaactgacctacataactagcatcaagatcaagataaagggccggacgcagtggctcatgcctgtggtcccagcagtttgggaggccgaggtgggtggatggcttgagccaggagttcgagaccagcctgggcagcatgacaaaaccccgtctctaccaaaatatagaaattagctggatgtggtggtggatgcctgtggaccccgctacttgaggcactgaggtgggaggatcaactgggcccgggaggttgaggctgcagtgagccatgatcatgccactgcactgcagtctgggtgacaaagtgagaccctgtctcaaaaaa

SEQ ID NO: 637071 - DNA, 186 bp, Homo sapiens
ccttacagcgacaaaccgtaggtgccacgttcgcgaaacacgctctgcgcacattcagtgactccttggtcttctcttccacaagggtctacgatttccttcataaggttcccaaactcctgaatggttcccagcgggtggtgataggacggcgtactctctagaccacgcagtgtcagagaagct

SEQ ID NO: 637072 - DNA, 215 bp, Homo sapiens
agtgagaccctggaaatagcctccctgggcagtgtacagcctgggctccctgctgggcagccctgagtaggctctcaggctgggatccaggatgacagtcccaggctccagagttggcccagcaggcgactcttctggcaacctttgcccaccctcatccatgagcaccttcacacacacacacacacacacacacacacacacacaccccaccc

SEQ ID NO: 637073 - DNA, 825 bp, Homo sapiens
  misc_feature (11)..(11): n is a, c, g, or t
  misc_feature (133)..(134): n is a, c, g, or t
  misc_feature (151)..(151): n is a, c, g, or t
  misc_feature (160)..(160): n is a, c, g, or t
  misc_feature (242)..(242): n is a, c, g, or t
  misc_feature (248)..(248): n is a, c, g, or t
  misc_feature (296)..(296): n is a, c, g, or t
  misc_feature (320)..(320): n is a, c, g, or t
  misc_feature (442)..(442): n is a, c, g, or t
  misc_feature (476)..(477): n is a, c, g, or t
  misc_feature (489)..(489): n is a, c, g, or t
  misc_feature (683)..(683): n is a, c, g, or t
  misc_feature (724)..(724): n is a, c, g, or t
ctgtttttcgntataaagaaaaccattatgtggtccatctataatacattctcctttccttctgaaggttttattgtatgtattgttatcattaatcctagtcttttactactaaacttaaatggccaattgnnacaaacagttctgagancgttcttcnaccactgattaagagtggtggtggcaggtattagggataatattcatttagccttctgagctttctgggcagacttggtgancttgcnagctccagcagccttcttgtccactgctttgatgacacccaccgcaantgtttgtttcatatcacgaacagnaaagcgacccaaaggtggatagtctgagaagctctcaacacacatgggcttgccaggaaccatatcaacaatggcagcatcaccagacttcaagaatttagggccatcttccagctttttancagaacggcgattaatcttttccttcagctcagnnaacttgcatgcnatgtgagctgtgtggcaatccaatacaggggcatagccggcgcttatttggcctggatggttcaggataatcacctgagcagtgaagccagctgcttccattggtgggtcatttttgctgttaccagcaacgttgccacgacgaacatccttgacagacacattcttgacattgaagcccatattgtccccatntttttgcttcactcaaagcttcatggtgcatttcgacagantttacttccgttgtaacgttgactggagcaaaggtgaccaccataccgggtttgagaacaccagtttccactcggccaacaggaacagtaccaataccacc

SEQ ID NO: 637074 - DNA, 928 bp, Homo sapiens
aaacaagctccggcgacgtgtccgagtgacccggataatcccgcccttatagcagaggcggaagatggcgggacgaaccggaagagggtgaaaatgctttcgtgtcgggaccaggtaagcgtagctcgctgccgaccggtccaatatggcacagttcgcgataccgcgccggcggagaaaaattcattggaggttgatgcgatacaagatcctcttcagaaataccactatcttcctgacgtcgatgggagaaccctgtgtgaccttgtcttcgacttatcagcctggatagttctgagaaacgcgctgttttgttacaatgggagaatctatgactctcaatggtccgaggaagttcaggcgtgtctggaataacacttaaggaaaaaaggagggcttgtttgggaaatattgaacatgatcaaatagttgttccagatactgcagtgaactctttattatgacagagcttggctggaggatgatatgcatcgattggtctgttagtgagagcaacatggaggctaacggagaagtggaacgtagctgaagacttgtattggtgacaaaatcgaatggatgaaacattgtaaacttggaatgatggtccatacatttttggttgtccatatgggtatttcatcctgcaggggaatcctcgaaagacaattccttggcgttctccttttaccatggacttgtgcagtggacgggtcctttgaatactccacacctgcagaattgccctgagaattttccgcacacgggttgcaacgcgaccggaaggagccagagccggcagaccggcacggaagacccggaaatgcgggcgcccaccggagggtcgcacctcgtaggataaaacgcaggcccgcgggttctcgatacacgcccgtcgagggcagacaaagacacagaggagatgcac

SEQ ID NO: 637075 - DNA, 1107 bp, Homo sapiens
gcttttccccctcagagggcaaaggagacattcagatcacaatggaaagaatctcagaagggaaagaggggaagtagaggggtctgcgtaagtctgaatgtctccttttgccccctcagagggcaagagacggtgaacataaaggatttggtgaaacatttgtaagggtaggagttgaaaactgcagttcgcagtgccacggaagtgtgacttggagccgtgcagataagtgcccagacaatccatcccatactgcactataagccagctgcagggcgggcaaggcaaggaaagctgattccatggaagtgtatcactttctccggcagctgggaagtctagaaccagcgcagactgggcttaagggagtctgctcaatgcaatagtcagcaggttatacacccggcacggatgacagcagaccagttcccagggagcacgggcatgccttgtgaatattgccaagcttccagctgcctcgtttctcctaagagcattcctaggaatatgttccccgccaatgctgggcgtacatcctagccaacggtgcaaatcctagagggtatacaatcatctctggtcacgatcagtcatgacttagtcaagaattaagggcagtaaatcctgttggcttaacgtcactgttccaactggtgttatatctctcatgaacagtgacaccaagggaaagtggactaatgtcacatgtaaatctacgagtgtctaaaagaatgcgctaaatgtgatactgactgggccgaaagctggtatagaaagatcgaaatgcggcatacatacagcaccacaggtaattgcaaagggtacgaaagaagcaaaggacagggcgagaacgacataaggcggcaaagacgcacgagctagggtctagaaggagaagagaataaaaacaaagggaaaatgtttcgcaacagcagagaagacgacataaggttagacaagtgactcagcagacggccacagcggagagtagaagcgagaacacgaacgaagtgccaaacgatcagtagtagtgtggcgccacacaccagtgagaggagtaaacgagcgatggagcgcgcactgtcactgaagaggagaacaaacagt

SEQ ID NO: 637076 - DNA, 115 bp, Homo sapiens
gccagatggtgttacctggagcttaaaaagctgcacgctagttttacacttctgacaatggccaagaccagattaagagggccgcagtccaggctgtatttcacatagccagcca

SEQ ID NO: 637077 - DNA, 349 bp, Homo sapiens
  misc_feature (7)..(7): n is a, c, g, or t
  misc_feature (83)..(83): n is a, c, g, or t
  misc_feature (170)..(170): n is a, c, g, or t
  misc_feature (194)..(194): n is a, c, g, or t
  misc_feature (337)..(337): n is a, c, g, or t
ggctggngcgggctgtttcctgggaactctactgggtctgtggtatggggtgattgattctttggatccaagaaaccacagcnagaaactgccactttttttcagtttggtacagcatcactcctgcgaaattttgttggacaaagaagtaacaaattctgcccaaattnaagaggaagggacaaaggacccanaagcccctgcctttattggttggttttttctcactccatctagacacgctgttataagttctggagcctgagtccactgtaatggcttaaggtggtgagcggcgtttgctcatgccctacactgcagaatgaaaaaggaagcnccaaagcaagca

SEQ ID NO: 637078 - DNA, 338 bp, Homo sapiens
tcagaaactgaaaataagttaacagctctcctgaggacacgaataatcaacagtactaataaagggatagagagatcagatttattctgcatagaccatcaggggatgattattccttattgaattactcagtgcttttcaaaggagctttcctacctaaaagtgcttaataggaagctggctgatgtgtcagaaatgttctacacgggtggagttcagaatatacgatctgaaagtccccccagtttcatttacttcagaaaacatcttagaccacaatcggggactccaagtagatcattctataaacctacctatttcacaatcggggtaccgag

SEQ ID NO: 637079 - DNA, 260 bp, Homo sapiens
  misc_feature (72)..(72): n is a, c, g, or t
ggtcgactctcaggatctcggtccgctcggacatgtgaggtcaggagttgagaccagcctggccaacatggncaaaaccccgtctctaccaaaaacacaaaaattagccaggcatggtggcacacacttgtaatcccagctactcaggagactgaggcacaagattcgcttgaacccagcagacggaggttgcagggaggccgaggctgcagtgagcctaaatcacgccactgcactccagcctggatggtccgagcgga

SEQ ID NO: 637080 - DNA, 904 bp, Homo sapiens
  misc_feature (61)..(62): n is a, c, g, or t
  misc_feature (74)..(74): n is a, c, g, or t
  misc_feature (132)..(132): n is a, c, g, or t
  misc_feature (139)..(139): n is a, c, g, or t
  misc_feature (141)..(141): n is a, c, g, or t
  misc_feature (173)..(173): n is a, c, g, or t
  misc_feature (205)..(205): n is a, c, g, or t
  misc_feature (280)..(280): n is a, c, g, or t
  misc_feature (291)..(291): n is a, c, g, or t
  misc_feature (335)..(335): n is a, c, g, or t
  misc_feature (346)..(346): n is a, c, g, or t
gtggcggctccgcggttcgcaggtcgttcgctgagcgtctctgcttagccgcggtcatganncggcacagggtncagaggcaggttctagcctgtaccgcgatctgctgcgcccggggtgggaagcgggccngaggcgngntgcgggcagagttccggcagcatcgggcctgnccggtccgacgtgctgcgcatcgagtacctgnaccgccgcgggcggccagctgcagctgctacgctcgggccacccaccgccatggggccttcgtacgcccgcgggncccgaccgggnagcctggcggcgtgggtcccagcctgacgacggcgacagtccanggaacccccangacagcacggggggcaccggagacccggcccgaaggacggtgacaggcgaaagaagcgaattcgttcgatggcgtgttgagccaggaggctcgctgattgcatggggggactggggaaccgcgctaaggtgagaaggtctaagagactaggttgaggatttggggatgtcagagactctccttgggggacgcaggggggcttaagagcccgtgatggcacggcaaggggagggcccgccttttccggatgctgggaaacaggtcggtgctcatcccccatgagggctgggggcggcttgggacgcttgagggcttgacagtgtcaggaccaagaagctattggcccgaaggtacgggggagcccaggacgacccccggggtggaacaggggagagccttgaagacggccctttttttttgaccccgtgagaagtattacccagtttgtggctcctcagggagttcccccttctccggtatttaactcttgagaattgcagacttttggctgaaaaagtttgggaagggtcctgattacggtgaaagccgggaatccct

SEQ ID NO: 637081 - DNA, 995 bp, Homo sapiens
cgcgtggcagcaagagtcgcatgagatgatggaggttgacgaggcagggtcgagtctgcacagaatccggcgatgaaccaagggcacagaaacacgagcagtggccatcgtggccgcacctctagtgaacagagcctgcaaggcatggggcaggagcggggggaggaggacccagcaagaagaacatgagctgcctgtggacttggcaaaccatcgaaccgtggacagagatgcagaggatgttgatttgcaatcgactatcggcatagggcaagcattgaaggatttgaggtactgaagacaacgtgaagactctctgcctccggcaaaatttaattaaatgcattgagaatctggaggagctacagagtcttcgagagctggatctttactgagcaaccagagtcacgaagattgagaagtctggaggcgctaacaggagctggagacttctagatatttgcttttaagtctgctgagaaacatcgaaggggttgacaagttgtacacgacttgcagaaaactcttcttggtcaacaattaacatcagtcacaattgagaacttaagcaacttacttcagctaccagatgctagagcttggggatctaagcgcagtccggggcaatcggaaacttattcgaagacctttaatcaaacctggcagacaggtcggatgctgggggaaagaaccagaattacttaaagcttcagaacctggattgcgctcaccgaacccttggaagtccttaaggaattgctactgcgaacccggggttgaccccagtaattgtaagggggcccttgaggagaacctgtgtggtaaaccccttttggtggaaacggaggttcccttttagccccacagggggcgtttgaagggcagtattcagaggggccccgttggaacaccacatgtgttctagaagaacagggcttgacgggatagtacaagcggagagagaaggttttgatcgtagaggggcgcgcgaaagt

SEQ ID NO: 637082 - DNA, 428 bp, Homo sapiens
  misc_feature (23)..(23): n is a, c, g, or t
  misc_feature (64)..(64): n is a, c, g, or t
  misc_feature (415)..(415): n is a, c, g, or t
actggcacccagcttgtgcccanctgacgagaagtccaattgtgtgccttcctccttccccaantctgccatcaaatttgcccaattaaaagacaaatggtaaactcccagagaatcatgttcatagcttgaaatctgcatcatggtccgggcgtggtggctcatgcctgtaatctccagcactttaggaggccgaggcgggtggatcacctgaggtccagaggttgagaccagcctggccaacatggtgaatccctatctccactaaaaatacaaaattagccaggcatggtcgtgggcacctgtaatcccagctacttgggaggctgaggcaggagaatggcttgaacccgggaggtgaagattgcagtgagccaaggtcgcacctttgcactccagtctgggtaacaagagnaaaactccatctc

SEQ ID NO: 637083 - DNA, 382 bp, Homo sapiens
gggatttacagaacccaaaactggctggcccaaaaacccccaaagcttttagctttgcggggtaatcaccaggccccttttttttaaacaaaacgaggggggggcccccctttttttaaaaaaaagtcctccccccgaaaaaaacccccggggggggggctgtttaaaaaaatttttttttggggggttatccccccccccccccccgggagatttttttttttttttgtgccccaccccccctccttctctcacctggagagggggcgcccccccttcctttttttgtgggggggggccccccccccccctcctctgtggaggggggaaaccattcttcttccttggcggttttggggggggggaggggggcgcgccgaag

SEQ ID NO: 637084 - DNA, 290 bp, Homo sapiens
acccatcatgggtctggatcaggtggtatctaaggccaggtatgtggcgtgcattggtagtctcaactacttaggaggctgagcccaggagttccaggctgcagtgagctgtgattgcccctaagaaagccactgcactccagccaggacagcatagtaagaacctatctctaaaataaaaagaaaaaatcctcaatcgaaaatcaagagatacaggtatcatagggggtggacagtacaatcctcttgtattagctaggtttaaaaattggcgggggggggtttacatc

SEQ ID NO: 637085 - DNA, 900 bp, Homo sapiens
  misc_feature (47)..(47): n is a, c, g, or t
  misc_feature (61)..(62): n is a, c, g, or t
  misc_feature (64)..(64): n is a, c, g, or t
  misc_feature (67)..(68): n is a, c, g, or t
  misc_feature (70)..(71): n is a, c, g, or t
  misc_feature (88)..(88): n is a, c, g, or t
  misc_feature (99)..(99): n is a, c, g, or t
  misc_feature (123)..(123): n is a, c, g, or t
  misc_feature (393)..(393): n is a, c, g, or t
  misc_feature (410)..(410): n is a, c, g, or t
  misc_feature (415)..(415): n is a, c, g, or t
  misc_feature (436)..(436): n is a, c, g, or t
  misc_feature (497)..(497): n is a, c, g, or t
  misc_feature (503)..(503): n is a, c, g, or t
  misc_feature (564)..(564): n is a, c, g, or t
  misc_feature (585)..(585): n is a, c, g, or t
  misc_feature (612)..(612): n is a, c, g, or t
  misc_feature (618)..(618): n is a, c, g, or t
  misc_feature (634)..(634): n is a, c, g, or t
  misc_feature (636)..(637): n is a, c, g, or t
  misc_feature (651)..(651): n is a, c, g, or t
  misc_feature (662)..(662): n is a, c, g, or t
  misc_feature (668)..(668): n is a, c, g, or t
  misc_feature (678)..(678): n is a, c, g, or t
  misc_feature (680)..(680): n is a, c, g, or t
  misc_feature (702)..(702): n is a, c, g, or t
  misc_feature (734)..(734): n is a, c, g, or t
  misc_feature (745)..(745): n is a, c, g, or t
  misc_feature (776)..(776): n is a, c, g, or t
  misc_feature (783)..(783): n is a, c, g, or t
  misc_feature (787)..(787): n is a, c, g, or t
  misc_feature (791)..(791): n is a, c, g, or t
  misc_feature (794)..(794): n is a, c, g, or t
  misc_feature (810)..(810): n is a, c, g, or t
  misc_feature (820)..(820): n is a, c, g, or t
  misc_feature (823)..(823): n is a, c, g, or t
  misc_feature (872)..(872): n is a, c, g, or t
tggaatcatgagggcttcactggtaaaatgcttctgaattgactggnaatccattaggggnnanggnngnngttattcccagagaggngcctcagtggnggcgctgtgtctcctacgcaactnctgagggctggagggtgccaagggcagctgctgaccgcctggtgcttcaggagctgggtgctggggaagccacatgcactgcggcgtccagaggcagaagcacaaccaacaagaaccacgaaggaggcgcctttcctcctataatgcctgtttggtgccctctactgacaaagcttatcccctttcaaaaaacagccaactgaaaaagctgaatttggaacataaagtcaataaatccataaccagcaatactatggggcctggggtgcnctggcctttagtgagtngagtngggcgaaggatgctgcatgtnctgcagtgggcacagcggccctgcacgggggagaaccatccctgtaaagtgtcagttgttncccctntttcagttagggtccctgcaagatatggcagttcactcacataaggtcagtttgatatgantctcctgacaaggtgagtttngctctctgcggctactaacagcctgancctttncctccccaggcctgancnngggcatggaaaggnctgcctgatanggtganaggtgctgtnanctttagccaagggcagccaggnataaatactgggaactcacgctctctcctgtnattggccagcnccactcccccaccctgacgttgagtgaaganaaatggnagcnagangtntggtgagctaacaganattccatgcngcncgctgagaagccacgtgagtggggacagggctaaaggctaggcaggganagggctggctgtgtcccgaggcttctcc

SEQ ID NO: 637086 - DNA, 164 bp, Homo sapiens
gcccggctccgggctagaggcaataaataaacccgattcctgcgcggcacagtccgcgtccgtccggcgccgtccccgggctgacgggggagggagcggagaagcgacgccagattctgcgtataaatcagctctggagcagacacagcccggctgtgaaaagc

SEQ ID NO: 637087 - DNA, 112 bp, Homo sapiens
ccacatctccgacttactcagtaacacaagagcaggaggagacaatacccccacgaagtctgcagccgtgtccacccttgacagaaggatgcatggcctgctgataacatca

SEQ ID NO: 637088 - DNA, 433 bp, Homo sapiens
aaagacgaacgaggggcgagggggcacccaaggcaacacagcagccacgagcggcatacgcaccgtggcaagagcaaagaagccaccagaagcactactgcgactacagtgtataatcagccaaatatagctcgcatctcaccctggagcccaccttagagctaacttactttacaccacacacaagatagagaaacaagttaagtaacactaaagggaagcaaacagacaaatccgtaatatagaacagtctacaggacaactgactcagttaacaaaaaaaattcactggcatacccctatgggcttaaacacagcactaaaacaactaataacctaatataaggtgtggatctttttaggatcctgatccacccaagcaatgatcacaagaccttttagaacagtcaaagcacttgactactgcattacg

SEQ ID NO: 637089 - DNA, 639 bp, Homo sapiens
tgatcatagaggacccccctagaaaggtgctgacagtgtaaaagctaactccacctcctatactatagaaatcactattacgatataatataccatattaccactatttatagaccatccttttgctatatatagctagatattttctggtgagggaagggtagtgtctacaggggtctatattgtatttgaaatactacaggatggggagaggtaatttaagaacgaattataattataggtctacactagttgcgagtaaaggagcatttttacaccccttaagggtgcttaattctagttgaaaccaaaaagatttgtctacaaatgctatctatttttagaaactatatagaaatgactccctttcaaagtcaatctttggaaaatatatgaggaggtcactaatatagttggtgcagttaatataatacaagatagatattggatagatgggaagtttgagaccgctgcattttgtttttaaattatagcacctatctagataaacccccaaatacagaaatgttctaacatctctgaatgacctctgactttaaaaaagtttttatttgcataggtgtattaactaaacactgacatattcttctactcttctccttctatctcttggggtgg

SEQ ID NO: 637090 - DNA, 844 bp, Homo sapiens
ccaacgaccggcctgcgctgttactcggccgaggggcactactagtatagagtagaaatagccctagggaaatctaccttgatactcttatttccaacgggaaactatactaaagaaaaagctgatataggatgctttcaaacttcacctaaacttgctattcctcataatcttaaccagtcatacggaaatgacataaagagaatgcaaaacaattggaaaatggttaatttcatccacatcaaatatgtatattagggcttaccatgctgcctaggcacctgtctcttagcaaacagcatcgtgaaggactgtaactgtattcacttatcttttattcctggctactaaccataatgtatagaggttgagctctaacttattctaaacacaatgtgtaaacttaacgtgtttaactttatataggttatacaaggtacattctcacatcatcctgatacattactcaacttctgctgcacggctgaggccacactcgtctcaccacagcgcctgattccctacctaacgcgaggccacgcatgcctaggcacattgaaactgccccgcccccactcccacacggctccaatggctccttctaccactcctaacctgtcgggcatatcaaacgcacataaacacaacgcacacgcagcatcgccacctggcactacgggacccagcaataataagcgtcacgcagaaaatacgaattcgacgagctctaacccgccgaagaccacatacccttccataactccgcccgaatttccgacccgcagctaacaccgctcaaccgccaaaccgatagcttttggcgtgctgcccaccctaacctgct

SEQ ID NO: 637091 - DNA, 152 bp, Homo sapiens
caactgtagactattgtctagtataggatccatctgtatctctgttaagctaaacgtgagtacatagtgatgttggaaacatgatcttagcttctaggaaaaattatactaacattctagaagtcttgaaaaataaaatagcagtctacctc

SEQ ID NO: 637092 - DNA, 382 bp, Homo sapiens
ttacactttttcagaagccacatttgggcaggcctcccgccttggtaaatgctgtactctttgcatcaagtgtgctagtcatccttccccacttggaaaattcctatgcattttgcaggcctgacataagcatttcctctgtggaacctcctttgctccactccaggagagttattcaaattcccactttggggtccccctggaaattccacccacctttaatggaaggcaactaaattggtccggaatggtttatttttccaaagtttttaatagaatgtgagctccttaagggcaggaaaaggaacctttttattttttgcatctccatagcatagtttttggcatatgaatgtttaataaatgtttgttgaataaaaaa

SEQ ID NO: 637093 - DNA, 1188 bp, Homo sapiens
tctcatttaactttttaaatggggtctcaaaatttctgtgacaaattttgggtacaatgtggtttccattaaaaagttacgtgattttaaaacacttaattacactttaacaccgtgcccaccacgcaaaaaacagaaaaaccaagaggtggctccacaacacactttttcctttctcctttcgtgagaggtttatcacgagtgcattgtgttatcattacaccgagctctttttcacttcacttacaactttaatgtgcgcccaatgtgacacacaaacgagtctcgtgaagacaccgatctcttccaccacacgtgcattaagacagtgtgggggtggccgaggctattgaggcgatcaataatctcatattaagcgcttcctgtgaagcacatatcccgtggggcccgcgaacttgtggggtagaccttgtgtcacaagactctcacaggacagcgcctctctcgtgtgagtcaccaactgtgacttgtgtgtatgtgacccacccacaccgcgagcaaacctgtgtgtcgtgctcctccatatatgttcaccagaaaaccaggacgaaacacgagcagaccacccccaagagacgggtagtgcgcactattcagattctgttggcacaccaacaggctcttctctaccacacaaccaaccacacagaatgtagggcagactcgtatgcaccaccgagagagaagcacccgctcttttatttccaccaccacacatgtggggcccgacgtgtcaatctcacaccgcctaagaaagtctctccaacacgcaactattttctagggggggacacgatgtttcttctccaccaggcataatctttaacaccccccgacatcaatacaggcggggcgaggaaagatccgaccacagctgcgttcatcatatcactattcaacaaaggactacttccgagagaccgacaaacgctttgttggccatgtttgccaaactagtgtatttgatgcccccggttggttagggcacaatctccacaaacataaaccaaggggggtaccatatatagactcgggcagccataattactatgggaggccaatggagaattagtggttaccagagagcattatcatctcacctcgtagacgaagcagtattcacaaccgccacagagtcagctatcacaccactatggaaaggcggac

SEQ ID NO: 637094 - DNA, 244 bp, Homo sapiens
ctagaggatcccccttacaatcgacagttaagccattgtttaaagaaacggtgcttctgttctgtgtttgtgctcctgatttccctgagaggttctaggatgaaggctagaacacaggcttgttaactgtcagtctagtgctgatggacctcagaggacttgagtgttgcatttcttgacgcatggggtgcagagagcctttcctggatttggatagtggctatatgattagattattgtggac

SEQ ID NO: 637095 - DNA, 676 bp, Homo sapiens
gtggagagtgcaggagcgcagcggtctatgaagactggcccatttgcagagcactccagaccagctgtggaacatcagcgcctgtcccttcctgtgtccatagatgtgatacctagcgatctcatccggcgatgtatatggccgaggccagtccctctgacacttggggcctcggtaatctcccatcttgtggcatgggcagtcagagtaagcaccagccaccccagccccgaaaagctgcagtccagctctgtcctgactgagcttggacggctgagtgcctggagaagttccctgtgatccagcacttccagttcgggagcctgctgcccatccatcctgtcacgttgggctaggaggggccaagccgaagagccacccaggccacagttcctgtgcctgccttccccatcccggggggtggcccctccgggtcccctccctctgtgcgtcccgtgtgatgaggaggctgtttactggtggtgggggtggcgagagtggtgctatgagggggctcagagcagtagggcttgcagggtcccggcgtggggagaatgtgaccaaggagtatccagtccccggagttcccgtgttgctagactggccagaagagagggtctggggcctggtcactcggacactctctcctgtttctggcctcttctccctttcatcc

SEQ ID NO: 637096 - DNA, 165 bp, Homo sapiens
aggggaagctgggcttggggtactcaagaactctgctggttctacattttttttttgagcctaaaattccttcaaaacaggtaaaacaaaagacagttatgctacccttagctggaatgccttactagtgtaggagaagagaaaattctcttcataagagttagc

SEQ ID NO: 637097 - DNA, 437 bp, Homo sapiens
aactggggctcagcatatggaggatgcttctttacatttccctacacccgtgatccaaaacctatttgctctcacctggactgaccctgacaccctccagtcacaacaactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacgggcactgctctcttaaactttctcgctatcaaagggtatagggtctccccctccaaggaccaactctccatctccatgatgacttacttaggaattcaactttcccctggggcccaggctatgaatccagccaggtcagcattaatagaaaatctagccccaa

SEQ ID NO: 637098 - DNA, 212 bp, Homo sapiens
ttctttttgaggcatcagaacacatttcatggagatggtattcctttcctgcctgatatgaagaggagctgctaagggagggagaacaaactttactgcttataatttttatctagggccagcctcaataacagaaatgaaaaattttgtgattggataatgaggcaaaataaatttgtttaaaaaggttttatttattcattcatgagaga

SEQ ID NO: 637099 - DNA, 611 bp, Homo sapiens
gcacgagctatgtttcgtgcttttgccgattagacagtcaggacattgatatgtgctagcgttagaccattcaatatccgattctttcaaatatgtaactgcattcttcttaagagacttctgaatacttcggaagttagcatgtccaagcattcgatgtattaacggatatggatatttatttacgcttttgcttttgttgacgttgtttattgttagctttgaaatgtgcgaaggaattaggtattttttagataaccagtaaaagtctccatgtttgactatgggagctagtactgtaccatccgatctttctaaagtgtttctggtaaagcaggcagtaatattttgattagccagctcactcaaacttaatagatcataggctatgtttggtgtgtgtagtgcttttattgatgttttggtgccgttctgaaagttgaagtgaagattaccaatggcatttataggaatgtcttgtttttgagcatcgactatgtttatttcagaattgggtgttgcatggtgtaaataatgggctgatctgacaagcgtttgcgaagctcctgaatcaataagaaggtgatcaggtagttcgtcattcgagtcta

SEQ ID NO: 637100 - DNA, 519 bp, Homo sapiens
cacgagggagcacaggatcaaaccctgtttctgggtcgggcaccacggccacccgcgcaaaatacgatgtcccgaacccgtgcctccgtggttggcggctctcgttgcggtctgtgggctggtactggaaggccggccttccctcccacagcccctcccaggtgacgaagcccacactgtatggcgggatgtagcccccctgcacccgcacccccgcgtcccctcggcaatccgtcggctcgtacgtggtgcggtgtccgttccccggaggactgttgctactcccactaccatccccggatacccacgagggccggaagacggggtcagccggatcatcactgatcacggcataccagtcattcgccgacaagaacccgtcaaccagatgccaaccatccggaatggtcaggacatgcaagaaattcaggaaggaaaattggcgcatctgttcctcataccaggcattgagcgccatctggctgctgtacaccgaatccccataggcggtgtacggcc

SEQ ID NO: 637101 - DNA, 179 bp, Homo sapiens
gttgccaggaggctgactgtctctgtctgggcaaaggtgatgttggcattgtcatgcagtgcaaagatctcaggcatatcatggagtgggaggtcttgatgtagtgagaggtagccgtggagtgtctgtaggtaggcgggatctggtggtcgatgccctgagttgctgtagctagcgca

SEQ ID NO: 637102 - DNA, 428 bp, Homo sapiens
tcttctttttaacagtacactttttataatgccttgaacttgtttctctgtggcagaggaaaacagcctcatgcacctggacaaacaaaggtgttccttcaaaaacagactttcagaatcattaattctggtttagaaataattatgaaggttaagtggactctcatgcgtaagattttagagctggtgagtggctaatctgtgctttacttccccttgttttcatccttcttataccaccggtattaccgtgcctcctcttaacagttttgttccctctgtagcaagtgagccagagacagtgcttcagcttcctatagcctcctggtggtatgcagggacagctggctgagatcatatgcacttctacccaaacatatcccaaggtaaggctacaggtagtaaagctgtgaccagaaggtagattt

SEQ ID NO: 637103 - DNA, 376 bp, Homo sapiens
tggtatactacgtaaggaagcccctacagcagattgagctatcaacggacaagtaggtaggccctcccttactagtcccaacctatctattgcggcggaagtagaagaagctggatagggttgctcacacctattaacccaagtgcttgggaagctgaggctagaggattgcttaaacccaggaagtcgaggctgcggtgtggtattatcacaacactgcactaccagcctgggtagcagaggtagactccatcttcaaaaataattaggtataacaaaaattagaaattgccaataagccaaaataactggaaagtgcccacagtttgccccttgccccagaggcatcgttgctgtttcgccgtcccaagcacag

SEQ ID NO: 637104 - DNA, 411 bp, Homo sapiens
  misc_feature (393)..(393): n is a, c, g, or t
gaaggccgggttgggtggcttgtgcctatgatcctggcactttgggatgccgaggtgggaggattgcttgaggccaggagtttgagaccaacctcagtgacatagccacaccttgtctctacaaaaattaaaaaattcactgggtgtggcagtgtgcacctgtagacctagctactcaggctaatgtgggaggattgcttgagcccaggagttggaagcttcagtgagctgtgattgtgccactgcactccagactggacaacagagtgaaaccctgtttctctaaaagaaaaatgtatggccaggcatggtggctcatgcctgtaaacacagcatttttggaggcaaaggttgggcggatcacttgagatcaggaggtttttgaccagcctnggcaacaatggtgaaccc

SEQ ID NO: 637105 - DNA, 270 bp, Homo sapiens
tctcttaaatcaagatccaaagtgcaagagcagtgctgctggcatatggtcgtcgtatatacacacaactctcccttcacagaagctggcatattgttctaattgttctattttattcttagctatcgttgctaatctcttatggtgcctaatttataaattaaacttcataggtatgcatgcataggaaaaaaacatagtataataggattagatactattgtggtttcaggcatctgctaggggtattgaaatttatccccatgaagg

SEQ ID NO: 637106 - DNA, 484 bp, Homo sapiens
tctgtctcgtattcttgcttcagtagctttgaatgcgtattgtcttgcttctctagttctattgtgatgttagggtgttgattttagatatctgctgcttcctcttgttggcatttagtgctataaatttccctctacacagtgctttaaatgtgtcccagagattttggtacattgtgtctttgttctcattggtttcaaagaacatctttatttctgccttcatttcgttatttacccagtagtcattcaggagcaggttgttcagtttccatgtagttgtgcagttttgagtaagtttcttaatcctgagttctaatttgatttcagtgtggtctgcgagactgtttgttgtgatttctgttcttttacatttgctgaggagtgctttacttccaactatatggtccattttagaataagtgtgatggggtgctgagaagaatgtatattctgttgatttgtggtggagagttctgtagat

SEQ ID NO: 637107 - DNA, 633 bp, Homo sapiens
  misc_feature (458)..(458): n is a, c, g, or t
cgaacatgtcgcggctgcagagatagaaaaacctctggcccatttggataaaaacttgtagaaacctccagctcactcagataaaggaacaagaacgacctagcacagaaatgcctttgtttggccagccacggtggatcatgcctgtaattccaacaatgtcggaggcagctgtgggcggatcatctgaggtcgggagtttgagaccagcatgaccaagatggacaaaccctgtctttactaaaaatacaaaactagccaggcatggtgctgcatgcctataatcccagctacttgggaggctgaggcaggagaatcgctagaacccaggaggtggaggttgctgtgagccgagatcgcgccattgcactccaggctgggcaacaagagcaaaactgcaaaaaaaaaaaaatatatataaaacgaaagtacatctcaaaaaaaagaaagaaagacangataaagaaaaaaaaagaaacacctttgtctttgtacagtcagtgggctcccaggaaaatgttccttctctttttgttggcatgggcactgtgggatctggtgcattccggtcgacactctcgtttatttggactgtaagtctgacctctatgaataattacttcagcccctgat

SEQ ID NO: 637108 - DNA, 292 bp, Homo sapiens
ctggaagcgaaggcagacgactctcacagaggagatcacttcctgagagcttgtatgatgcagagctgtcccagatgcagacccacatctcagacagttctgtggtgctgtccatggacaccaaccgcaaccgggacctggacagcatcatcgctgaggtcacggcccaatatgaggagattggctcaaagaagccaggctcccgggggtcagccgttctggcttcagcagcgtctccgtgtccggcttggccttctggagtgcatcctccagcccttccagtttgtgcttg

SEQ ID NO: 637109 - DNA, 293 bp, Homo sapiens
cctggaagccggccggtggagacagacgattatcttgagcccaaccgaagaggtgttttctaagccgagagccgtcaactacaaactagcctgtgctacaaaccttaaaggtttcacacagaaaatcccaggcctagatggctgcattgttgaaatctgccaaacattaaaatgagcactaattttttgcacactgttcctaagagtaggagagggcacaacacttcccaacttactctagggcagtatgaccctgatactagactaggcatcacaagaaaactataagccaa

SEQ ID NO: 637110 - DNA, 208 bp, Homo sapiens
ggggttttttttccccccccccccccgtttaaaaccgggggtcccgggaatttttggggggggtttttgttttttaaaaaggggcggttccccgggggggggaataaatttttaggggttcccggggcccaaaaaaaagggccccgggccccttttgccccccttggggtttttttttaggccccaaaaaaccccttttttttgggga

SEQ ID NO: 637111 - DNA, 333 bp, Homo sapiens
aagaacttatagattattacataccactgcctggtcatccaagtctttgtgtcagggaggaaaatgtctatacaataatggtgtaactcggaagttcaggtcaaaaaaaaaaaaaattcaaaaaagggtgccattgacccaattgagatttttaaaatttaccttttcaaaggccgggtgcggtggcccacgcctgtaaatcccagcatttgggcagaccaggtcaggcagatcacttgaggccaggagttcgagatcagccgtggcaacattggcgaacccccgtctctataaaaattccaaaaaaattagccaggagtgttggcgaacacc

SEQ ID NO: 637112 - DNA, 696 bp, Homo sapiens
atcttgtggttgtgcaagtggctgaggcactgagcagttggtgggagcagaggtgccgcgtccttctctcagcactaccaccacgggaagagctggctctcctcacttactcatgtctgcctgcatttcagtgcctcaggaatggcccgggcgctgtttttgaagggttccactgagtcaggagagtattgggagggagaggcaggtcagcgctctgcctcttccagttgcagcctcaagtgtaggtgagaacttgctcaccacacaccccatgtgcctacgcaccaggagagtcccacaccatgacatgcagtcatggcaggagctgaagcaaaggtggggagctacctacctcccccagcttcttttagagcaagtcttcagcgaactccactaaacaatgcaaagctggggtgcacgccaaagcaggcccaacactgggataacaggagtcacccaggacagacccagagaatgcagaatgtatggtccctttatccacaggctctagcaggtattccggtttcagatggattgacgacaggttctcagttgggggctccacttttgggtggtgcgagaagttaggcctgcatgagtaggcggcactggttgcaaggccaattgcccaccgctgccttggcgctaaccacgtgttgctggagacggcgctccctgctgttggctaaggtgggg

SEQ ID NO: 637113 - DNA, 111 bp, Homo sapiens
gcgaaagaaagaaggaagctccttcccctcctaaagctgaagacaaagcgaggtttttaaaaaacaatttattttaagtttttaaaaggtgtccaaaaccaaaaaaagaaa

SEQ ID NO: 637114 - DNA, 283 bp, Homo sapiens
cggacctgacagtgtgcatggtgtagctgctcctggaactctgagcaaacagttgtctccctcttccctcaggaagacgcgaatgagggagggtctctgacttagtgggctcagccagcaggggccttttccaaggacaggctttggagagtaaggactcttcagtctggaaagatagaaacaagagagttgggagtcaggcccctcaaataatcgagggagaggttagggccaaccattgccttggtctccggagtctcagaacacagaacttagagcctgc

SEQ ID NO: 637115 - DNA, 511 bp, Homo sapiens
ctagacttttatttacagcattacgatggtaggggagcagcgcgggtgaatgagtacgagccttaatatcactgtgatgtctgagatgcttcggtgacatagccctcttatatctatagatgtctactatgactcattaaattacattcattacaggctattaatcagaattgcaccctgcttgtgtgaaaccgatgttgcttatgcttcaattcgggagctagatccatatacttggaaactgaggtatatagccactcatttccatgtaccttgataacgcacatcatgctaccattgcagcatctgagatggtgatctatttaacatctgcaaaagtgacaatagctatatgtgcgaactaaaggttgaacagctgtatcctagcagctcagattctataaaattgagatagattaagcattcatgccttagatcaagagctgcagctaggattatattcgatatggacaggtctgctgatggtagccggtatgtcattcgatgtcgc

SEQ ID NO: 637116 - DNA, 604 bp, Homo sapiens
cggtggaggaagaggatcttagggtgtgagaatgacagactgtgcgttcgtggagaggagatatgtggaatgtatcgctatggtggttgttgcttggtgtgagcccagtggatgtgaggtggaatatgtggagctcagaagaatggctaatgatgcgatcatgtgaatgatgcgtaagcaattgatgacaggagtgagtaagctcatattcgaatgtttgtcgaagttacatcagatcatgtgtgacaatctcttgtgtgattactaattaaagtggaagtaatgtatttgtatgtgcaccgatccccatcaggttcctctatgactgtgaagtagcggccatagtatctattgcaagatgccatgacatgtgtagttgttcaatggcaagtgcacatcgaaaccaggacgtcaagccatatgggcttgagagctaagagtagaatcaactggaggaaataatagcttagttggagagtgggagtcaatacaaagaggtgaggggatatgaatgttaacaacgggagttggagaaattcatctatgcattggtggagctgaggtcaaattggcagaaataatatgtaaaagagaactttcatgt

SEQ ID NO: 637117 - DNA, 101 bp, Homo sapiens
tgtgtggtcagtgggatctgtaccagccatgtctgggagaatccacaaccacatgtgcgatctctcaaggatgggagaatgcttggtaatcaattaggtcc

SEQ ID NO: 637118 - DNA, 658 bp, Homo sapiens
  misc_feature (208)..(208): n is a, c, g, or t
tggcagatgatcaaagttttatttaacattatagaacacttaaaaataaacaatatgatggcattctgtggtgtaacttggaaaaatgtttcaagcacacataaaagcaacaagtttacccccaacaagtatgctatgcagccagttccctaactgcgggggtcagcacggctctcaacagacagcgggggtaggaggtaggctgctnggtgtccctgcaggcagggggcttttcctactcggaatgacgatgtcttttctggtagggttctcaatggcccttctaagtgcgttcatccgggataagatctgactttcttatatccgtgtggctacacgccaattggagggcaataggcctttttctcccgcttatggccgggactcaatcatgcgaacaagggggtcctcttcataggtgtggccacacacttaattttcacgggcttcttcatttcctccttggtaagggggcaggtgaagtgggtctgacttggggtcacaattatatcttcatccactccttctgtgccgcagttctctgtcagtgtgaagaccacatagttcttagttcttacaggtgtggtttaaactcctttcctacagccccttagctgcgtgaggacggggtgggtcgacccacgcgtccggttagatc

SEQ ID NO: 637119 - DNA, 324 bp, Homo sapiens
aaattttttttttgagggttccccccccaccccgggggcccaaaaaaccttggccttttccccttttttaaaaaggggaaaaaattttttggggtggggggaaaaaaaccttcgccccttttaaaaaattagttttttaggggtcacgccccccccgaaaaaaaattccgggccattccccctttggtttatggtttatttttcggcttttgtttgctaaaaaaaaaggggggaaaaacgggggtttttaaaaaacccccccctttttggaatttttaattttttcccccttttttccttgccattttaaggttttggggttta

SEQ ID NO: 637120 - DNA, 376 bp, Homo sapiens
gagtcagggctggacctatgacttgcttctaataaacagaatatggcaaaaatgatgggatgtcacttccaagatttggtaactgttgtggattgaattgtgtctgcccggaaaagatatgttgacgccctaacctctagtatcttagaatgtgaccttatttgcaaatagcatctttgcagatgtggtcaagagaaagtcattagggtgggccctaatccagcatgactggagtccttacaaaagggacatctggggctcagcatagtggttcatgcctgtattcccagcactttgggaggccaaggtgaaaggatcacttgtggccaggagttcaagaccagcctggggaacatgtcatgatgtggtctctaca

SEQ ID NO: 637121 - DNA, 105 bp, Homo sapiens
gctacctagagttcccgttacagtgagcaagatcatgcattacattccagcttaggggacaggtcaagtctgtctcaaaaaaaaaaaaggcattgggattccctt

SEQ ID NO: 637122 - DNA, 810 bp, Homo sapiens
attctagaggccgaggcgggcagatcacctgaggtcaggagttcaagaccagcttggccaacatggtgaaaccccatctctaccaaaaatacaaaaattagccagacgtggtggtgcacgcctttaatcccagctactcgggaggctgaggcaggagaatcacatgaatccaggaggtggaggttgcagtgagctgagatcttcccactgcactccagcctggcaataagacctgtctccagcaagaccctgtctcaaaaaaaaaaaaaaaaattggcttttggactccggaagaatttcaagccatgtggagatccattcattggatgggccattttctacggtcaccggtgagccgggtggctggccatttcaaagtctcttcttaccacgctcctcaggggctagactttttcacggtgggccagaaagtcccgactctggctggggcgtcccgggacaagtgggcttcctcctctggagctgggggctccccatctggtctcggggagacccttggggccccctcgtgtagggaaagggccgatgcaaagctgcagttaaaaacggccaccattggccttagcctcgtgcagtcaggagggggagaacaggaccggtggacattgtcgacggcaatggttgggattgacgcatcatcggggtggggggcccagagaacagccacaggtccgggcaaggaagccccaggtaaacaggctaaggagggctgacaaaccaggggggaggttgactggcgctcgggcccctacaagatggaccggtgggtccgaacacgcaaggggcagg

SEQ ID NO: 637123 - DNA, 229 bp, Homo sapiens
agagctgaggcacgaggatacttgaacccaggaggaggaggttgcagtgagctgagatcatgccaggcaacagaatgagactttgtttaaaaaaaaaaaaaagtgacttgatttaggggaaaaaatgacgtggcgcctatttttcagtcagattttggcaaaaagtctcaaggtgtaaatgtgaatgattaaggtcttggggggggtgtccccttatcagactacaggt

SEQ ID NO: 637124 - DNA, 1027 bp, Homo sapiens
  misc_feature (1)..(1): n is a, c, g, or t
nccattttaattgatctgtgaaaaaacttaagaaaatcacaatttcagctaacagcaattgtgtcccaaagatgaagatactataacctcaaatggtgcagatccagaactgggctggatgacatccctactgtgccatgtcctggggcatttggaagggactggacctctttcccctcatcaaaggaaacagcagtctttgcctctttctgttggttgtgcccaagggctacagtagctctgaaataacaagagctctgtaataacagtaataaatagctctgaaataacagtcctaagaactcctaaagtcctgagaacttttcttgtaatgcagctttttctcttcctgagaaacagtgtgttctaatgggattcccaggcagttcctacacctacggtgtgtgttccagcagggaggagttatgggctgggctgccttttcccatgggtcttcattcccaatggaaagttcactctgcttagtttggaattatttttctttcagttgttctggaacctttgctttttattgatttatacaatacaattggtgggagggtggacttgggatgggagtgggaaaagcatgtaagagctccttttgtgatggtccatctacccaaaagagatctgctttagtgaacgatactctttcatttttctaaattagatcaagttgttattgattttagatgacttgtatgcaaatttgaaaaacttttttttttaaagctgattgggaactacaaacaatgaatggaatctactgacacagctaattggaaaacagatgtcttcttctgtcctattgatgctggtgtttaaaaaacatcacttaaaaaaaaagaataaatagttctaaaagcaaaaaaaaaaaaaaagggggggggtcaaaatttcctgggggcaagttagggtaccgttttgacaaggcctaaggaggggttaaaacaggcggcgggttaaagtcggagaaaggcgtgattgggagacctctgggggattggaaaacaggaaaggcgaa

SEQ ID NO: 637125 - DNA, 191 bp, Homo sapiens
gaggcctgctgggaacgggacttctaaaaggactatgtctggaggctgtggtccaggccattttgctggctataagcgggtctccggaccaaagggagcacacagctctctaaaatgaggtgtttacgccgagatgaaacagaatctatttggcagagatgcgctatgtatatatagcaagacacacagta

SEQ ID NO: 637126 - DNA, 309 bp, Homo sapiens
  misc_feature (15)..(15): n is a, c, g, or t
  misc_feature (18)..(18): n is a, c, g, or t
  misc_feature (78)..(78): n is a, c, g, or t
  misc_feature (134)..(134): n is a, c, g, or t
  misc_feature (140)..(140): n is a, c, g, or t
  misc_feature (174)..(174): n is a, c, g, or t
  misc_feature (206)..(206): n is a, c, g, or t
  misc_feature (302)..(302): n is a, c, g, or t
gggagagcggcgggngangagcgtgactcgcccgctccggctgcttcccccgcgccgcctccccgcgccgctcgccancatgtccgaggagaagccaaggagggtgtgaagacagagaatgaccacatcaaccntgaaangtggccgggcaagacggcttccgtggttcaagtnaaagataaagaggcacacgccgcttgagcaanctgatgaaggcctactgcgagaggcagggcttgtcaatgaggcagatcagattcaggttcgacgggcagcaatcaatgaaactgacactccagcanagctgag

SEQ ID NO: 637127 - DNA, 1117 bp, Homo sapiens
  misc_feature (501)..(501): n is a, c, g, or t
tcacacataccttagggaaagtggaggttaaagtgtaaacctaaaggtgggttaccatgacagacaacagccagcacatcactaacacgtatgagagctatcctcgtggcacgggttagttgcacgtaggagaagaatataaaacctacaacaatgagaccccgtgcatttgggcctgtgacactatcatgggactacggttccgtgtcttccatgtgtcagtgctgagaggaaaaccttcagcctgtgttgggcactggcttgcttatgccaggttagccctcaaaacgtctggcaagaaatattacccgcccagaaagtacgccagagttggtgtcacatttcacagatgcatacccttaacaccaaagaacacacagttctgagacagggacgcatctagtcctggacaagtccttaccttcttggaacttagctgctaccaacagtaccctcacgttccttaaccccaatactttctggcatcaggcagcccggganaaacctgggcaaacggttagacacaagttatacgcaacggtctcaggggggacgacttacagttgcgcatacgactgtctgacccaattaccctcaagatatcggcccaatcaagtctattggctggaagcttgccttcacatctaagaaactcttacaaccagtacactggggacaaacgctgggtcctggaattccattgacctaccgcacacagacctgggatataaccctgggaaaggtccctaaagccactggttcgcatggacccttttagccagagactaacctaaaatgcaaccaccgcgtggccaaacaaggcaagtacgggagaacacggtccacgcaattcccaccgcaccaccgggggggcccagatacatgaaggcagccccacgaccacgaaacgcgtagtacccctagcccaacagccctggtccccacgggtaactcatcccgtaatgtgtaaacatgcacaatcaagttccaggtaccatctgtctgaaaaaaattctgtccagtcaaaacggcccatcctacagaggccacgacccgtgcactaacggaccaaatacaacagctgctagccatatacccacgaccaaaagaccggaca

SEQ ID NO: 637128 - DNA, 871 bp, Homo sapiens
  misc_feature (1)..(1): n is a, c, g, or t
nccattttaattgatctgtgaaaaaacttaagaaaatcacaatttcagctaacagcaattgtgtcccaaagatgaagatactataacctcaaatggtgcagatccagaactgggctggatgacatccctactgtgccatgtcctggggcatttggaagggactggacctctttcccctcatcaaaggaaacagcagtctttgcctctttctgttggttgtgcccaagggctacagtagctctgaaataacaagagctctgtaataacagtaataaatagctctgaaataacagtcctaagaactcctaaagtcctgagaacttttcttgtaatgcagctttttctcttcctgagaaacagtgtgttctaatgggattcccaggcagttcctacacctacggtgtgtgttccagcagggaggagttatgggctgggctgccttttcccatgggtcttcattcccaatggaaagttcactctgcttagtttggaattatttttctttcagttgttctggaacctttgctttttattgatttatacaatacaattggtgggagggtggacttgggatgggagtgggaaaagcatgtaagagctccttttgtgatggtccatctacccaaaagagatctgctttagtgaacgatactctttcatttttctaaattagatcaagttgttattgattttagatgacttgtatgcaaatttgaaaaacttttttttttaaagctgattgggaactacaaacaatgaatggaatctactgacacagctaattggaaaacagatgtcttcttctgtcctattgatgctggtgtttaaaaaacatcacttaaaaaaaaagaataaatagttctaaaagcaa

SEQ ID NO: 637129 - DNA, 714 bp, Homo sapiens
  misc_feature (59)..(59): n is a, c, g, or t
  misc_feature (79)..(79): n is a, c, g, or t
  misc_feature (125)..(125): n is a, c, g, or t
  misc_feature (194)..(194): n is a, c, g, or t
  misc_feature (201)..(201): n is a, c, g, or t
  misc_feature (235)..(235): n is a, c, g, or t
  misc_feature (250)..(250): n is a, c, g, or t
  misc_feature (367)..(367): n is a, c, g, or t
  misc_feature (381)..(381): n is a, c, g, or t
  misc_feature (419)..(419): n is a, c, g, or t
  misc_feature (424)..(424): n is a, c, g, or t
  misc_feature (440)..(440): n is a, c, g, or t
  misc_feature (442)..(442): n is a, c, g, or t
  misc_feature (450)..(450): n is a, c, g, or t
  misc_feature (492)..(492): n is a, c, g, or t
  misc_feature (511)..(511): n is a, c, g, or t
  misc_feature (533)..(533): n is a, c, g, or t
  misc_feature (554)..(554): n is a, c, g, or t
  misc_feature (558)..(560): n is a, c, g, or t
  misc_feature (565)..(565): n is a, c, g, or t
  misc_feature (568)..(568): n is a, c, g, or t
  misc_feature (611)..(611): n is a, c, g, or t
  misc_feature (710)..(710): n is a, c, g, or t
agagaatccaaaatgtccgtgctctgtgtagcattgagctgacgcacccttggagttgnggttgattttcagatcagtncatgctcattaatctggtagaatgtgacatctaccagatgtaacanctgcgcattcttattcctcattttaagtatttcgtgctttctcacaatttttttttttttttttgaganggagtcncactttgtcacccaggctggagtgcagttccgcnatctcggctcactgnaacctcctcctcctcctcccgggttcatgcaattctcctgcctcaggcactcgagtagctgtgtgtattataggcatgcgccaacatgcgcgtagctaatttgttgtatttttagtngagactgggtttcnccatattggccaggctggtcttgaactcctgacctcanggganccgcctgcctcgaccncnaaggtgcngggattacaggcgtgagccactgtgctcggccctgtttctcncaattaaaacatgatcttnttttagtgttatagaaggctgnaaattacgagctctcagtggncaannnctganaanatcatgaaagcctttagaaggcagttagtgcccaaatggagtntttttgccaagacagcctttaaaatgtagctctctggtggctaagtccagggtctgggagttctagatgtggggctggctcagatggtcttggccctcntttg

SEQ ID NO: 637130 - DNA, 890 bp, Homo sapiens
  misc_feature (887)..(887): n is a, c, g, or t
ttagcaaagcatatgtatttctcaatgagtaaaatggggataataacgtctattgatgtagagggtcaaatgaagaacaaatagtagctgctgctacttgactggaaaggtaaatgtgtttacatcatgctgtggaacactctaaacagtctatgtagaagaggggcatgttctcatgggcttctcatggtaattgtgaatgaagccctttgttaaggtcttgttgaagaaagaacactgtataagttcaggctttagtacattttccttagcaaaatgttggtagtgaatcaaagagttgatttttccaggtttccagtttttactttagtttatgttgtgcctgtcttggactttctgtttagtttggatggaaaatacctgcttgaaattttaaaaatgatttctttagtgcatctatttagctagtttctgataggtggtatgtaatattttccctttttctttccttctgtagacacaataagtcattctccctcttctttttttctttttctattttcttattctttactctaacctgcttcagagaaagagccctcttccttcttgtcttcatcttagtcttttcaaaataaaagatgactgtgagaaccccaagaacttccacttctgggaggcagccacaggacagggaacatatttatttgggtctcttcagttccccctttgagaacaacattaaatacatgttagctggggctccagggcattctccttccacagtagtgcggccaaattcccagtctggccagtctctttgttgagactgaatagaaggactgcaggtttttttggaggatgagataatttttcctcgcaggcattttttcccttggccttccttatgcatgaatggtcccttntga

SEQ ID NO: 637131 - DNA, 223 bp, Homo sapiens
tctacgacggtccgtgaagcggcttgtgtattggtgcggatgatccggacgcctgcggccgccccataccccaccaggtcaccaaccatacacaggcagcggagtaatcggggcatggggggaggttgcttaattgtgggcggtcgtatagtcccccctctcccgggtttgccgtgggtggatacacaagccgctcacgggatacccgacgctcgacagttcg

SEQ ID NO: 637132 - DNA, 778 bp, Homo sapiens
gctgtttcctttgatgaagggaaagagcagtctttgatgaagggaaagaggtccagtcccttcatcaaagactgctgtttcctttgatgaagggaaagagcagtctttgcctctttctgttggttgtgcccaagggctacagtagctctgaaataacaagagctctgtaataacagtaataaatagctctgaaataacagtcctaagaactcctaaagtcctgagaacttttcttgtaatgcagctttttctcttcctgagaaacagtgtgttctaatgggattcccaggcagttcctacacctacggtgtgtgttccagcagggaggagttatgggctgggctgccttttcccatgggtcttcattcccaatggaaagttcactctgcttagtttggaattatttttctttcagttgttctggaacctttgctttttattgatttatacaatacaattggtgggagggtggacttgggatgggagtgggaaaagcatgtaagagctccttttgtgatggtccatctacccaaaagagatctgctttagtgaacgatactctttcatttttctaaattagatcaagttgttattgattttagatgacttgtatgcaaatttgaaaaacttttttttttaaagctgattgggaactacaaacaatgaatggaatctactgacacagctaattggaaaacagatgtcttcttctgtcctattgatgctggtgtttaaaaaacatcacttaaaaaaaaagaataaatagttctaaaagcaa

SEQ ID NO: 637133 - DNA, 1129 bp, Homo sapiens
  misc_feature (1)..(1): n is a, c, g, or t
nccattttaattgatctgtgaaaaaacttaagaaaatcacaatttcagctaacagcaattgtgtcccaaagatgaagatactataacctcaaatggtgcagatccagaactgggctggatgacatccctactgtgccatgtcctggggcatttggaagggactggacctctttcccctcatcaaaggaaacagcagtctttgcctctttctgttggttgtgcccaagggctacagtagctctgaaataacaagagctctgtaataacagtaataaatagctctgaaataacagtcctaagaactcctaaagtcctgagaacttttcttgtaatgcagctttttctcttcctgagaaacagtgtgttctaatgggattcccaggcagttcctacacctacggtgtgtgttccagcagggaggagttatgggctgggctgccttttcccatgggtcttcattcccaatggaaagttcactctgcttagtttggaattatttttctttcagttgttctggaacctttgctttttattgatttatacaatacaattggtgggagggtggacttgggatgggagtgggaaaagcatgtaagagctccttttgtgatggtccatctacccaaaagagatctgctttagtgaacgatactctttcatttttctaaattagatcaagttgttattgattttagatgacttgtatgcaaatttgaaaaacttttttttttaaagctgattgggaactacaaacaatgaatggaatctactgacacagctaattggaaaacagatgtcttcttctgtcctattgatgctggtgtttaaaaaacatcacttaaaaaaaaagaataaatagttctaaaagcaagtttggcaatttctacttttcctacttttctccaaccccccttagaaaaagttcttcgtttactgcctggctgttctatgtaactttccatcccaacctttctcccattagcagcagtgattctgggcattgctggagtgaacaggagggcttgggcagagtatctgaagagcttccccttcctttataccttctcccaccccaaatttggaattactgcttttatgttctcaactccagctgcacataaaatcacta

SEQ ID NO: 637134 - DNA, 647 bp, Homo sapiens
  misc_feature (20)..(20): n is a, c, g, or t
  misc_feature (65)..(66): n is a, c, g, or t
  misc_feature (74)..(75): n is a, c, g, or t
  misc_feature (77)..(78): n is a, c, g, or t
  misc_feature (81)..(81): n is a, c, g, or t
  misc_feature (83)..(83): n is a, c, g, or t
  misc_feature (87)..(87): n is a, c, g, or t
  misc_feature (91)..(95): n is a, c, g, or t
  misc_feature (97)..(98): n is a, c, g, or t
  misc_feature (100)..(101): n is a, c, g, or t
  misc_feature (103)..(107): n is a, c, g, or t
  misc_feature (109)..(109): n is a, c, g, or t
  misc_feature (112)..(112): n is a, c, g, or t
  misc_feature (161)..(161): n is a, c, g, or t
  misc_feature (195)..(195): n is a, c, g, or t
  misc_feature (209)..(209): n is a, c, g, or t
  misc_feature (215)..(215): n is a, c, g, or t
  misc_feature (219)..(219): n is a, c, g, or t
  misc_feature (221)..(221): n is a, c, g, or t
  misc_feature (225)..(226): n is a, c, g, or t
  misc_feature (231)..(232): n is a, c, g, or t
  misc_feature (234)..(235): n is a, c, g, or t
  misc_feature (296)..(296): n is a, c, g, or t
  misc_feature (299)..(299): n is a, c, g, or t
  misc_feature (303)..(303): n is a, c, g, or t
  misc_feature (308)..(308): n is a, c, g, or t
  misc_feature (312)..(312): n is a, c, g, or t
  misc_feature (318)..(318): n is a, c, g, or t
  misc_feature (323)..(323): n is a, c, g, or t
  misc_feature (335)..(335): n is a, c, g, or t
  misc_feature (339)..(339): n is a, c, g, or t
  misc_feature (343)..(344): n is a, c, g, or t
  misc_feature (352)..(352): n is a, c, g, or t
  misc_feature (361)..(362): n is a, c, g, or t
  misc_feature (385)..(385): n is a, c, g, or t
  misc_feature (387)..(387): n is a, c, g, or t
  misc_feature (391)..(391): n is a, c, g, or t
  misc_feature (398)..(398): n is a, c, g, or t
  misc_feature (414)..(414): n is a, c, g, or t
  misc_feature (426)..(426): n is a, c, g, or t
  misc_feature (428)..(428): n is a, c, g, or t
  misc_feature (435)..(435): n is a, c, g, or t
  misc_feature (437)..(438): n is a, c, g, or t
  misc_feature (443)..(443): n is a, c, g, or t
  misc_feature (462)..(462): n is a, c, g, or t
  misc_feature (465)..(465): n is a, c, g, or t
  misc_feature (474)..(474): n is a, c, g, or t
  misc_feature (494)..(494): n is a, c, g, or t
  misc_feature (503)..(503): n is a, c, g, or t
  misc_feature (506)..(506): n is a, c, g, or t
  misc_feature (521)..(521): n is a, c, g, or t
  misc_feature (523)..(523): n is a, c, g, or t
  misc_feature (542)..(542): n is a, c, g, or t
  misc_feature (580)..(580): n is a, c, g, or t
  misc_feature (583)..(583): n is a, c, g, or t
  misc_feature (587)..(587): n is a, c, g, or t
  misc_feature (617)..(617): n is a, c, g, or t
gccgccttgaggagccgctncccccgctccctgaagatgggggaacaatgaaataagcgagaagnnccctcttnncnnctntntctntgtnnnnncnncnncnnnnngnggnggcatctgttccttaaggcggtgggcggaggcgaaaatgttggaggggnctgtttagcgagctcggccttcttttggaagtgntaaagtttgaaatntggggngagngntttnnttaannannttcagcgacaagggcgacgcgccgccaacgccaccgcctactcccatatacacactctccncanccanctctntatnccaaantactntctctctatatncaanacannacatatanacattctcnnatctcaaatactaacactatctntntcanatataancactacaaatatcacnatcaataaatantntcactananntaganctatctgcacaataagtcncantctcaatanagcgcaatatgaccaaagcngcacttgtnagngatctaagccttcgncngcagaacgcgaacgcgcgngcagcacacccgcatgcacgatctggaacgcagctctngancaanctgcgcgaaggtggtggcctgctactccanagacgcagaagctgtctaagatgagacgct

SEQ ID NO: 637135 - DNA, 226 bp, Homo sapiens
tggtcggacgtagccggacgtaaggtttgggatctgtgctcaaactacacatgcaatgaggacaatattctgctgatacaattgacttgctgctgcattatgtctacatgtttgtctaaatattaacaatttataaacacgagcaggtgcaattagctatttgcgaacatatcgcttacagctgttacgttgtcctggccacgaggtagccgagctcgcatattcg

SEQ ID NO: 637136 - DNA, 910 bp, Homo sapiens
  misc_feature (50)..(50): n is a, c, g, or t
  misc_feature (102)..(102): n is a, c, g, or t
  misc_feature (114)..(114): n is a, c, g, or t
  misc_feature (129)..(129): n is a, c, g, or t
  misc_feature (133)..(133): n is a, c, g, or t
  misc_feature (136)..(136): n is a, c, g, or t
  misc_feature (146)..(146): n is a, c, g, or t
  misc_feature (150)..(151): n is a, c, g, or t
  misc_feature (175)..(175): n is a, c, g, or t
  misc_feature (178)..(178): n is a, c, g, or t
  misc_feature (183)..(183): n is a, c, g, or t
  misc_feature (190)..(191): n is a, c, g, or t
  misc_feature (205)..(206): n is a, c, g, or t
  misc_feature (208)..(208): n is a, c, g, or t
  misc_feature (213)..(214): n is a, c, g, or t
  misc_feature (218)..(218): n is a, c, g, or t
  misc_feature (226)..(226): n is a, c, g, or t
  misc_feature (236)..(237): n is a, c, g, or t
  misc_feature (242)..(242): n is a, c, g, or t
  misc_feature (245)..(245): n is a, c, g, or t
  misc_feature (259)..(260): n is a, c, g, or t
  misc_feature (266)..(266): n is a, c, g, or t
  misc_feature (300)..(300): n is a, c, g, or t
  misc_feature (306)..(306): n is a, c, g, or t
  misc_feature (312)..(312): n is a, c, g, or t
  misc_feature (330)..(330): n is a, c, g, or t
  misc_feature (354)..(354): n is a, c, g, or t
  misc_feature (360)..(360): n is a, c, g, or t
  misc_feature (369)..(369): n is a, c, g, or t
  misc_feature (382)..(382): n is a, c, g, or t
  misc_feature (398)..(398): n is a, c, g, or t
  misc_feature (417)..(417): n is a, c, g, or t
  misc_feature (420)..(420): n is a, c, g, or t
  misc_feature (424)..(425): n is a, c, g, or t
  misc_feature (450)..(450): n is a, c, g, or t
  misc_feature (468)..(468): n is a, c, g, or t
  misc_feature (475)..(475): n is a, c, g, or t
  misc_feature (504)..(504): n is a, c, g, or t
  misc_feature (831)..(831): n is a, c, g, or t
  misc_feature (892)..(892): n is a, c, g, or t
atgatcctgaagggatttcttctgatggtagcttttgtattatcaaactnttttcagatacatcttctgagtcataaccagcctggcagtatgatggcctanatgcagagaaancagctccttggtganttgntangtaaggccanaaanntatatgtcatacctccattgggantangcatnaccctanntcttactactgatnnanacatnntctncatatccnaaaaatttanncaatnaanctaccaatttaaanntacggnattccattttaaaattaattgcttgtcaaactanaaccanaaaaanaataaattaataaaaaanacaataaaaaagcaatgtccatcncaaaanactgctttnacaaaaacaaaanaaaaacgaaaaaaaanaaaaatattacactacaanaanccannaataaaagaagccgaaataaataanaaatgagttgggatcaantggattnaggaagctgtgctgtgtgccaatatttcnattgcctcaaacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaancctctaaagtgatcagtgccttgatgccactaaggaaatttgtttagcattaatctctganggtctatgaaaggatagc

SEQ ID NO: 637137 - DNA, 348 bp, Homo sapiens
  misc_feature (50)..(50): n is a, c, g, or t
  misc_feature (102)..(102): n is a, c, g, or t
  misc_feature (114)..(114): n is a, c, g, or t
  misc_feature (129)..(129): n is a, c, g, or t
  misc_feature (133)..(133): n is a, c, g, or t
  misc_feature (136)..(136): n is a, c, g, or t
  misc_feature (146)..(146): n is a, c, g, or t
  misc_feature (150)..(151): n is a, c, g, or t
  misc_feature (175)..(175): n is a, c, g, or t
  misc_feature (178)..(178): n is a, c, g, or t
  misc_feature (183)..(183): n is a, c, g, or t
  misc_feature (190)..(191): n is a, c, g, or t
  misc_feature (205)..(206): n is a, c, g, or t
  misc_feature (208)..(208): n is a, c, g, or t
  misc_feature (213)..(214): n is a, c, g, or t
  misc_feature (218)..(218): n is a, c, g, or t
  misc_feature (226)..(226): n is a, c, g, or t
  misc_feature (236)..(237): n is a, c, g, or t
  misc_feature (242)..(242): n is a, c, g, or t
  misc_feature (245)..(245): n is a, c, g, or t
  misc_feature (259)..(260): n is a, c, g, or t
  misc_feature (266)..(266): n is a, c, g, or t
atgatcctgaagggatttcttctgatggtagcttttgtattatcaaactnttttcagatacatcttctgagtcataaccagcctggcagtatgatggcctanatgcagagaaancagctccttggtganttgntangtaaggccanaaanntatatgtcatacctccattgggantangcatnaccctanntcttactactgatnnanacatnntctncatatccnaaaaatttanncaatnaanctaccaatttaaanntacggnattccattttaaggtaatcttacagctattacccaatatgattgatgggaatccaatgaggggcatgcatcctcaaatactg

SEQ ID NO: 637138 - DNA, 388 bp, Homo sapiens
aggggcgatgcgcttcctgcagctataccatgaggaccttcttgcgggcctgggagacgtcgctctcttgggcttgtttgggaaggtacgactggctttcggctctgcggaggccaggcttcctgccaggcggctgaggagtttctgcggagcctgctgggcagcagtagcacccatgtgttgtgcctggagcacccgggcagcccccgtcttcatctccgcccagaagggcagcaccttctgcagaggctggaggctcagttccagtgtgtctttgggacagagcgcctgctcacagccacgttggacacaggccttgaagaggtggaccctgccgaggccctcccagtgctccctggcaacgccgacgtctattgtggaccccaga

SEQ ID NO: 637139 - DNA, 157 bp, Homo sapiens
ttacatatctagaatttccttcctttttaaaagatccaaatatattcttattttatatcttttttttatccattcatccattagtggacacttgggtttgctattggctattgtaaatgatggtgctatgtacaaatatctattttattgtatttag

SEQ ID NO: 637140 - DNA, 1357 bp, Homo sapiens
gcccgctcggagtgtaactaactaggccccttgagagagaccaccgcgtggtcatcaaagacgcggggtgattacccgcgtgtttataatgccgcggggcggtatatacgttttccaaggcacatgttgtaccagttggccttttgggggcaacattattaaaccggtgttcggccaaacaacacgtggtgtaatcccgtcgcgagatttccccgggggattttttgggaaacacaggggtgtgttctctaatacaatatggtgaagacgcgtgtcctgggtgcccttaaaaagggggcgcttttttaagggcctctctctatgtggatctctctcgggctttaacacaatagtgggtgtttcgaaccagtgttacacctccataatttacggttctcttaataattagatgggcgctttatattgtggctcgacaaaaccgcctgtgtgccatattgtgcccacataggatgtgggccctgattggttatacacacccggtggtgatagtgcatcacagtgttctcaagaggggctccacccagaaacacacggcacacctgtggtcccccaatagatgggccctttgttgaaatatcggcgcgaataaatctcccctaggtggtgatgttgtactcccctcaaggaaagtgtttttttatgtatttttcacaaagaggatatttttttgggagcccccctttagaacaccttcaacagccttgagcgcccttatcccccccgccacattatgagagagggcacactggcgcccccaaacacgggcgaatttaacccccgcgtataaatcccccctaagaagagagtctcccactctgcttaacacacacacccgcgtatatatattctgcgcctctcacggagggtattacacaatcacccgtgagggtctacccacatatggtttaaatagagaaacacacacccgcagaaccccacaatataattcaagccccgtgggttatattacacaattttaacgtgggtgttttatattttaacccctctctaaacaaagcgcccaagaaggaacttagagagtttctccctttacccactttctcgagcgggcgaatttatcgggtcaaacacatttttgtggaagccacacacgggttccccggagatttacacggcacattatatgtggggcaaactttcctcacactaattgtggttcaatccgcccacacactaaaatatttcacctttaacaatcccacaacacatcacacttgtgggttcgagaacccccgccccgaaatgtggccttttgttaaaaggtgggtgtgtaatatttttgtgtaagtttccattttttgaagaggggttttta

SEQ ID NO: 637141 - DNA, 92 bp, Homo sapiens
  misc_feature (46)..(46): n is a, c, g, or t
tacttttgtgctcttggggaactcgctctacctgggggatacgcangataaactcatctttggaaaaggaacccgtgtgactgtggaaccaa

SEQ ID NO: 637142 - DNA, 259 bp, Homo sapiens
agcacatttttgatttggccgcccaacgtgtttgacactaggcctgcatgcacaccagccatgcacaatggcgaggaatctctatatccatgatgaattgttccagatatctcagctgaaggaagcagacaaccagctgggcagtacttactgaactcaggttccaaaaaattggatgcagtgtccaaacaaggaattagatcttgtttatcctataacagagtatgaggccaaaaatccgggtccagaaacacggatt

SEQ ID NO: 637143 - DNA, 420 bp, Homo sapiens
gaggatcccctcaaggctatacttcacactgtggcatcaccctgaattctttcttgcacaagatccaagaaccctctcttggggtctagattgggacccctttctgtaactatcatgctactgcactccagcctgggccacagtgtgagatctgtctcaaaaaaagaccacaaaaagacacaaaaaaactacttggtattgtcgttgacatcaaaagctctccttcacctcttttcactttaaagagctgtgtgattttaaaaccatttttcttcttaaaaactaacatcgtagctaatgaaatttcttttaacttgtgtctttcagttgatcgtttaccatcctgtgggccagtggccattgataggaatgtccctccatacttaataccggagacaaactgctgagctatgatgttga

SEQ ID NO: 637144 - DNA, 194 bp, Homo sapiens
cttacacagcccgtcgtagtatacctaagcacagaggaaataacagataccactgaacccgtgtactgccaaagaagtcatacaaagatcacactactgcaggcacccaaaatcaaagccaaagcatcctattcaaccaacaacatatatctatcttcaggaaaaaattctgccctgctgtgggtggcagaatt

SEQ ID NO: 637145 - DNA, 817 bp, Homo sapiens
gcctgtcggccgagaaccgtcatcattacagatatgtgtcgtccaaagtgactgaacgacagatagggaaacaaaggagaggacacggcagatgctatgattctcataggtcgttgtagatagacatggaatataatttcgatttgggcacaataatatgctgagtgtcgtataagaaaggtgatatgtagacatcaagggaatgggatactgttcaaaacaggaatgccccacaagtgttaccatggcaaaactggaagagtctacaatgttacccagcatgctgttggcatcgttgtaaacaaacaagttaagggcaagattcttgccaagagaattaatgtgcgtattgaggccacccacgttaagccacgtcttaagacgacccggagaattaagcttccctgcacaacgtgtgacacggaccacactggaaaccacacacccaagaaagaaacaaagacacaaacacccgacaggttggccaccccccaccgctcccgaacaacaagcacgaaagaacaacatcgccaaaaaaagatgccacacaggggcccaacagactgaggacgcaccaaacgagggggaaacagagacggctgtcctgaggcaaacaacccgaggcctacacaagcacagagacctagagaccgacaacgcccaacatagaagaaaacgacccccccgagaggaaacaacgcaggacgaggacgaagaaaacagctacagaaaaggaaaacagagagggcacacaaacgaggggccacggcataacacagcggccccacgcagcaacgccgctgccccacaagtcggc

SEQ ID NO: 637146 - DNA, 692 bp, Homo sapiens
gaaacatcagaatgaatctgcactgtagaccaaatggatccaatagatatttacagaacatctcttccaatggctgcagaatacacattcttttcctcagcacatggatcattctcaaagatagaccccatgttagatcacaaaagaagtcttaaaacattgaaaaaaatgaaataatatcaaacatcttctctgaccacaatagaatgaaactggaaataagaataataattttggaaactacacaaatacatagaaattttaaaatatgctcctgagagaccagtgggtcaatgaagaaattaagaagaaaattgaaaaatttctaaaaacaaatgataatagaaacccagcataccaaaacctatgtgatacaacaaaagcagaactaagagggaaatttatcgctataagtgcctacatcaagaacaaaccaaaggaaaacttcaaatgaataatctaacaatgtatcttaaagaactagaaaagcaagagcaaaccaaactcaaaattagtcgaagaaacacgacactaataaagatcagagcagaaacaaatgaccttgccatcaaaaaaaacttaacataagatcaatgaaacaaaaagttgcaattttaaagttaaacaaaattgaccaaatctttaatcagactaagccaaacatacccacaacacacttacacgaagatccc

SEQ ID NO: 637147 - DNA, 218 bp, Homo sapiens
ctgacagcagaggttgatctttgccgggaaacagtggaagatggtcgtaccctgtctgagctacaagcatccagaaagagtcaccttgcagcctggtgctccgtctcagaggtgggatgcacgatcttcgtgaagaccctgtactggtaaggaccgatcacgtctcgagcgtggagccgcagtgacaccacttgacgaatgtcagaggcaagagatcc

SEQ ID NO: 637148 - DNA, 1266 bp, Homo sapiens
atctttgtcagtggcacaaagatggagccactacagcctactggtgactcggatgcagaaaggctctgggtgatgcggaagtaccagtgtggcctcagtccgtgtgccaacgggcgcaaggatggcagagtgagccactttgatgcccaacgagatacatccatatatgaccatgctagagaagaacattaacattgttcgcaaacgagctgaaccggacgcggctgacactactcggagacagattgtgatatggacacctggactgaccccgaccagccaggaaactggacgcgaagagacaagatcgatacctgcggatgacgagaccggaccgagatggaccatgcaaggatgcgacggcccagatgagcacatgctccaagattcatcagcagcagggcatgatccaaaggatggcatgttgccaatccaaccatccacgtgtgaccatactgatagaagcccagggataggacgaggcagacgaaacgaccatgacgacacggggaacaaaggacatcacaaccacggcaacgatgcataaatcatacctgagcaaacagcaagatgccaaaatatggcagagggctacagaaacgcctgggactctgggacatacaatgccaacaaaaataacaaactaggaaaaaaataattgacgtaacccatgagaggtacatacttgacttcggacacagaactaccacaaaacacccccaaaatggaagggagagacatgagagagcatactgcactaaggacagaaagagaagcaatgacagaaatgaccatgagacacaagagtcagctggacctgagaaatcaacacacagagagcaacaagaaaagaaggccccaaaaggacgacatgagaaagatgaagaaagcacggccaccaacacactcgaaagagacacacaaaccaaaaacagggacatcagaaagagaccagaacaaaacaagggggaacaagaggggaaaagagaggaccaagcatagaaacaacaaggccacagaacgcaacactccaaaatatgacagtacagagacagacccagaacatgaacagaaaaaaggagaaccaaatgggtacatacaacagggaaaaatacgaaaaacacggaggaagaaaaaacaacagcagcaagtaagaaagtgaaatacagaacaagagcgaacaaaaaagcgagaaaagaaaaaatagaacgcaaggaaaagaccacataataaaaaagtaaaaataacacccaaccacagataaaa

SEQ ID NO: 637149 - DNA, 627 bp, Homo sapiens
  misc_feature (15)..(15): n is a, c, g, or t
  misc_feature (17)..(17): n is a, c, g, or t
  misc_feature (67)..(67): n is a, c, g, or t
  misc_feature (264)..(264): n is a, c, g, or t
  misc_feature (565)..(565): n is a, c, g, or t
  misc_feature (590)..(590): n is a, c, g, or t
aacaatgtgctttgnanatgctgctccctggttcactctctgccaacccaccactcccacaatagangcaacaaggagacgcgcctttgccctggtctctcaagcgtatacttcaatcatcgccgatgattttgcagcctttgttggacttcctgtagaagaggctgtgaaaggtaattttggcttactttttacttataaggaaaatggaaaatagaagtgtgaattgtaggttcacagtctcctctgaaacacttggaacanaatatgcttttggagtccaggctgtgttttttgagaggtgatatgaaacaggtgttgtggaacacccagcaggcaccctgcagtcaagcatattaatagttctatagcaagcaaatgtgtgagtatccacacagttggttacaaaaatatgtcttaatttggtctctttactcatatttggaaatccttatttcacccttatttgataaagggcagcatcatccccacgtcccttttcattttccctgccatttctgacccataccctaggcgcttgctttgctcccactcatacctgctnggtctctccaaatgtaactttgcantttcatttctcagccttccaaagtgctgggatacagg

SEQ ID NO: 637150 - DNA, 405 bp, Homo sapiens
  misc_feature (390)..(390): n is a, c, g, or t
ggaggcgttctagaggtccctcacgccatgtccacaacagcatggttcccgaaagccaagaggtagaagcaacacaaatgcctttcaataaatgaatgaataaaataaaatgtggtacagggctgggcgcggtggctcacaacctgcaatcccaacacttggggaggccgaggtgggcagatcacgaggtcaagagaccatcctggccaacatgatgaaaccccgtctctacaaaaatacaaaaattagctaggtgtgatggcgcacgcctgtagtcccagatgctaaggaggccgaggcaggaggatcgcttgaacctgggagatggaggtttcagtgagctgagatcacgccactgcactccagcctgggtgacagagcgagactccntctcacaaaaaaaaa

SEQ ID NO: 637151 - DNA, 159 bp, Homo sapiens
atggctatcgtcaggctgagaacgggaagttgtcatcaatggaaatcccatcaccatcttccaggagcgagatccctccaaaatcaagtggggcgatgctggcgctagagtacgtcgcggagtcctactggcgtcttcaccgccatggagtaaatggca

SEQ ID NO: 637152 - DNA, 123 bp, Homo sapiens
cccatcgtccacctgggggatcccatcacagtcctcctgcatcatcaagcagaacgtgcagccatctggacccggagccacagattctgtgcgcacgactggcgagcagcagcttcacgcccg

SEQ ID NO: 637153 - DNA, 110 bp, Homo sapiens
cgcgccgagcagatacgaaggttgggcatgaggggtctgggacggtggttgctgggagtagggaggctgctgctgctgagcagcatgactcggctgcgtgtgatgagccg

SEQ ID NO: 637154 - DNA, 820 bp, Homo sapiens
gatcacgaggtcgggagttcgagaccagcatgaccaacatggtgaaaccctgtctctgctaaaagtacaaaaattagctgggcatggtggcgcatgtctgtagtcccagctactcaggaggctgaggcaggataatcacttgaacccgggaggcggaagttgcgagtgtgccgagattgtgccatgtgcactccagcttaggcgacagagagagactccgtctcaaaacaaacaaacaaaaagaaatcttgtttacttgtaaaaatatagactacctcctacttggcaccgttaagtgcaatttactggttgtgaaattactgtggctgggtgcagtggtcatgcctgtaatcctagcactttaggaggccaagatgggaggatcacatgagcccaggagttcaaaaccagccaggcaacatggcgagaccctgtctctacaaaaaatttaaaaattagctaggcttggtggctcacacctgtagttccagctactcaggaggctgagcgtgggatgatcagctgagcctaggagattgaggtgccagtgagctgtgatcattgccactggattgtgaacctgaagcaacagagtagagacgtgtgtcaaaaaaatcaaaaaaaaggcaggtatggtagttcacgactgttattcactaaacttgtgggggctagggggcagatcaggagttcgaaacaggtgggcaatggtgaacccgtgttcttaaggcaaaaataccgggtgggggggcgcctggtaaacagcggtgggcgcagggagaacgctggtggaaagaggggggggcgaatcaagacacgg

SEQ ID NO: 637155 - DNA, 190 bp, Homo sapiens
gagtgtgactttctggaaacagctctgtttcacggtgcagtgatgtggaagtttaaggtacatcacacattctggatccataacttgcatcctctgaatactccgcctgcgagggtgtgctgttgcagagggctgcctggatcccaactgcattagggatacatccccccattctctcatcctaagttcc

SEQ ID NO: 637156 - DNA, 1525 bp, Homo sapiens
  misc_feature (116)..(116): n is a, c, g, or t
  misc_feature (283)..(283): n is a, c, g, or t
agcgctgggtacgagctatgtgctagattgaccgatcggtccctcagcgtagtcgtccatgtggagacgatccgtcgagtcaagcttgagttaccttgatggaggatcctcgagcnaattgaatagatcggctctcggagtgcgtcaaccaagatcagatcatagagcacaagagtcgcgaagaatcggaagttcttcgagcgtccaaatatatctcggacttcgactgcaactagaggagcgcaccaaaccgcgagcggccccagattaaaatccaagagangacccggacaccgccggaacgtcttgaggagtaactccacccctcgaaaccagcgcaccggccccccgggagacgacaaacaacaagcacaccacaacaacaacacaaccgccccaccaaaaccacaacgagagaacagacgcaaaacaccaacgccagcacgacaagaaaaacaaagaaggcaccacccatagcgaaaggacgcaaaacgcgagaacagacgagacccacgcgcggacaagaggaccaacaccagaagaccaacagacaccaccaacgcagagacgacaggacacgacaacgaagcgaaagacacagacagcgacagacggacgcacgagagattacacagcaagcacacagacggagcggaccgagagcagaatagcaagacggaaaggggcggcgcgagagcggaacggcggaggccggaggcacgaaggacgacacctaacgccgcgaggccaggagacacggaagcgaggggtgacgagggccgcagccgaggcgcgcacgagagcacgcagcggcaccagcgcagccagagggggatgaagtacgcgagcgcaaccacggagggcgcaagagagcgaagcggcgagacgccaagcacacggctggcaccggccgcgacgacaccgcgagcaccgtgcgccgggggtgccagagcgtgacggcggggaaggtgctgagcagagatcaacaggagagagaaccggagagcgggacgagcaagcgaacacgagagcgatacaagagaacacgatgagagcgaggccgtgagaaacgcggcggggaacgagtgcacgacagacgggagaggcgggccgcgcgacgaggacagcgtagcaggatacagcgcgagcggacgagaacaggacacacgtacaggtgagtgtgaccaagaggccaagatacgaccaagaagacgtgagaaagcgaggcagagaaggaggcacgaacggagaagtgagcgagaggaagatgagagtctagcccagcagagacaggagcagaacagacgagcgagggaagagccgacagacaagtaggcggagcaacacgtgaggcaagtacggaagacaggctgaagaggcagacaggaacgggagacaacaaggggcacaagaacggtacaagcgcgaccaagcgacgagacaggcgcgagtaggagagaagcaggagagcgacgacgcggaggagagagcaggtcagaacacacgccgaacgcagcgagcaagg

SEQ ID NO: 637157 - DNA, 398 bp, Homo sapiens
acatcctttagtttctattatttcactgcttaagttctgcatctgaattacaaaggtaacataagtagtacttaagatcccaaaggcccattacattctatcaataaagacaaaacaaaactacatgtttactgataatagtctttttttctttgctttccagttttacacttttgttgaacacaatagtggactagatcaaataactagatggtaaaacactgattttttaaaaatcacatctttatacccgtgagaatcacaattcatattacgcctattgggtgctacctgtacacttacaaccttctcttaacacttacattatgtgactgattttccttacaacacaacttccattacgcaactacttttcgttgacacctcttccacaaaac

SEQ ID NO: 637158 - DNA, 716 bp, Homo sapiens
aggaggcccaggaatcaagtataggagaaatgtcctcttactctaagtttttattattattattattattattattaattatacttcaagttttagggtacatgtgcacaacgtgcaggttagttacatatgtatatatgtgccatgttggtgtgctgcacccatcaactcgtcatttaacattaggtatatctcctaatgctatccctcctccctccccccatcccataacaggccctggtgtgtgatgttccccttcctgtgtccatgtgttctcattgttcaattcccactatgagtgagaacatgcaggttggtttgtccttgtgatagttgctgagaatgatggtttccagcttcatccatgtccctacaaaggacatgaactcattattttttatggctgtatagtattccatggtgtatatgtgccacattttcttaatccagtctatcatgtggacattgggtggttccaagtcttgctatgtgaatagtgcgcaataacatatgtgtgcatgtgtcttatacacaaacaaaacaaacaacaaaaaaaaaacttgccgcgcccgcgccccgaaagtttaaagacacctgtgggccgcgcccggctatcgcacggcccagcggccagcaacacggggaccaagtgggttccccaaaaagccgggccccggtctgaacaccaggggttgggcacggccacgggcgacgaa

SEQ ID NO: 637159 - DNA, 1098 bp, Homo sapiens
  misc_feature (467)..(467): n is a, c, g, or t
  misc_feature (868)..(868): n is a, c, g, or t
gtggatctttgccaggacagatgtcccaaattagttccactcgaaagccttcgctgtctgctgcgagtaaactatcgatacaacgccagggaaacgaattggcaaacgtatatacagctcgagaaggcaatagagttaatcatcccaaaggggacattaaatctccgctcgtgaatatctcgtgttctagacggtaagactgtagaatctaagaacgtaacgaaccaagtttatatctttggcgtcctaggggtaggaaaatctcacaatgcctttacatgtatcacacccgcgcaaaaactcgaggaaacgagactcacttcttagaagaagatcagacgtgaacaacgcaggacgagcaaccaagcgacttatgcttacgctggaactccaggtgggtgacccaactctgattaaagggtatgacgtccgtagaatagaaacgtagctctgaagcgcatgttgtngatatacgactcgcgatgtcgatcctagatagaataaagagctcgtctacagtctctaagagcgtgctatagcaatgggttgtcgcacaaacatagaaatgcgcgtccatatagacctcaccgcgtctgatttcatttctattatcacctttgggctttagattcgcaaaggggggacgagacatcaccgcgctcctccttgggaacaaacattatgggacatccaaacaccctcgtgaattagtacgaatgcaagctcaaaagatatacttttgggaacaacacttggaataaggatcaagggacccgtgatacatgggcccagcccttattccaaattttaacgcacaaggccgttgtttcaccagtcttaccatagaaaccaactatatgcactactnggaagatcgccgattactgggggatcaaaacttggaggcaaatcaacctaaagggtcttttcaaggcgaactggcgtgggcgtgaccctttcctcccggggggttctacaaggaaggagagggcaatctcccgcgtggaaacggcttcctctccaaaggggcccggttggcatttaacgggctcttggtgcctttgagcccaatttcgaccggaaggaaaaaggtggcag

SEQ ID NO: 637160 - DNA, 104 bp, Homo sapiens
ggatcccaccaaagcacagcatacggtagacacgtcactctcgagcaggagaccagaatacaggagcacaagaagacctgaggacctggagtgcaggaggtccc

SEQ ID NO: 637161 - DNA, 132 bp, Homo sapiens
tgaggctagtggtactacttcacagtattggatcagagctggagagcacagaaggagcattcacttctggagtgaggggtggagaggcatctgagaaggttcttggaggaggtagcattttggccgagttga

SEQ ID NO: 637162 - DNA, 98 bp, Homo sapiens
ttggacatgaaatacaccgtatttggaaaggtaatagatggtctggaaactctagatgagttggagaagttgccagtaaatgagaagacataccgacc

SEQ ID NO: 637163 - DNA, 360 bp, Homo sapiens
  misc_feature (1)..(1): n is a, c, g, or t
  misc_feature (4)..(4): n is a, c, g, or t
  misc_feature (48)..(48): n is a, c, g, or t
nganactcaagatggctgcgttcttgctgaggtgactttagcctgggntaggagtccacgcccgcgaccgttgggggaacctgaattagtccctgagggggtgacagcgacatgtcagccgtcactgcctccgagcccacctgaatgctcagctttgtatcagaaatgctgctcctttgggaaccacagctaaggaggagatggagcggttctggaagaagaacacgaagttcaaaccgtcctctgtctccccatttgactatctacaaatggtctcttcctatggcactgtccgtttgccaccgaggctcttggaatagccttgagttggaggggtctctctttttggcctgtcggcac

SEQ ID NO: 637164 - DNA, 447 bp, Homo sapiens
  misc_feature (8)..(8): n is a, c, g, or t
  misc_feature (116)..(116): n is a, c, g, or t
gagggccnatggtccaggctggtctcaaacttctgggctcaagcagtcctcttgccttgacctcccaaagtgctggtattacaggcgtgagcccaccacacccggccccagagtanacttttttttttgaggcagagtcccactctgttacccaggttggagtgaagtggctcaatcttggctcattgcaaccttcacctcctaggtttaagcaattctcttgcctcagcctcctgagcagctgggattacaggtgcctgccaccacgcctggctaatttttttgtatttttagtagagacgtggttttgccatgttggccaggatggtctcaaactcctgacctcaggtgatctgcccgcctcagcctcccaaaatgctaggattacaggcgtgagccaatgcgcctggccagagtgtacatattaagtgctatacaagtaattgc

SEQ ID NO: 637165 - DNA, 145 bp, Homo sapiens
gaacacccttgtgtgtgtcttcacggtgagaacagctgtcctttcccctaagtcgcacaccctcctcctggcctgagtatagacctcaccctacatcatggcatgtaggtaccaggcgtctctgtgcccgtataccacaaccaga

SEQ ID NO: 637166 - DNA, 644 bp, Homo sapiens
cgctgttatacagcctcatatgatagagctaatgacaggtgacatctgattcatctgttgttggccaacgttgatgagacccgctttcgcataacgagagtttcttagtactactaaagattatcaatctgttgccgatacattcattcaatagtgtccgacattcttttacacaggtccggttgttcaaactacacacattgcggctactgtcaccacctctaaacccaggacagttgtttgaaccaatggtgcctcttcagcttgcctcaccattgttaccacacttgggaccaacacaggtgcaaacagacactgttgggttatctgcctcggaagtgattgaagaccagctgtattcatgcataacgccaatctacacatacctgtgttgttcagcattacactgtatgtctgattctcatggattacattcaacatttcactatgtgtttgggctagatagcattccttaatcacttgcattacacatctacggccatgtgtgcagcatgactgtggaggcgcaactcttatacacacatatatctatatagtactcaggtgctgctgcatgcacccatattgcactcagtgtatcagattctgtgtgaatttgtgaggcgcttatatcgtgaatacct

SEQ ID NO: 637167 - DNA, 131 bp, Homo sapiens
ctaccatgcatcacctctgtcacccttaggccctggaagaccagctgcaccacgttcatccagtgcattccctgaacggccagtgcgcgccccttggctaccggagagctccagaggtcaccagtcatcac

SEQ ID NO: 637168 - DNA, 137 bp, Homo sapiens
attgggccagaaatcaatgattggccaatgtcgttcttttttaattagtcagataccataccctgaacttgtttcaacatcttgctttatttccagaatgtgccttaattgcttcctaatttctgtgcccatttcaa

SEQ ID NO: 637169 - DNA, 616 bp, Homo sapiens
cagacagaaatctagatagaagagtgctaggttggcaagtcagttatctgcatgttgggaggaaagttaggtaggcagaaggattgttaagtaggtggagtttcagtaaaacttggttttctaagtatgtaaagtgtgctttacagttttcctggtgttcataagtttagattataggcactttagaaagttaattcttaggttgggtatggtggttcactcctgtaatgcaagtactttggcaggttcaggtgggtggattatttaaggttaggaattaataagtagggtgataaatatagtgaaatcccatgtgtagtaaaaataaaaaaaattagttgggaatggtggaatatgcttgtaatccaagcattttggcaggtgcaggtgggtggattacttaaggtaaggagtttgagattagtttggttaatatggtgaaattctgtgtgtagtaaaaatataaaaattagttgggaatgatggtgggtacttgtaatgcaagtactcaagggggttgagataggagaatggtttgaacttgagaggtgaaggttgtagtgagttgagatcagatctttgcatgccatcttaggtgatagagctagattgtgtt

SEQ ID NO: 637170 - DNA, 199 bp, Homo sapiens
ttatgctccttcgctgtggctctgccctctccaccgcacatgaagtgtctccttgcagccgcctcatcgcgtgctcgtcttcttcctgctgctgcgggatccttctgcggccgatgagacgaacacggggcccacagtcaccgtcacggtgtcttttgacctacgagttgaagatgaagatataggccgagtaatcttt

SEQ ID NO: 637171 - DNA, 113 bp, Homo sapiens
gacgagttggaagaagacctgtatcaacaacttcagggtgaagggacatattgatagcaagacccagacaggccgaccacctcgtgaaccggaggattccggaaaagccactt

SEQ ID NO: 637172 - DNA, 371 bp, Homo sapiens
caagagatcgcaccatattggaaatgtcgaaaactatagtaaagtagtatgatgaagtagctttagtgtcatacatgtcgaatgacatgaaagtgatgtacatttattctatgtaaatacacactaaaacctagtacacgtaccataagtagaatacatgtgagaatcacctaggcttcactatcttgagtaaatataacatgctcatatgacaattaatgaagactaacactttataaacatctccataatatctacatcctcttgaaggtatttatcatagttgccaatataactataaggatcgactctctctctctgaatagactcataaagtgtggagtgaatgtcgacgactcgggctactaatg

SEQ ID NO: 637173 - DNA, 698 bp, Homo sapiens
tgtaatcccagcttctcggagctatggcagaagatcgcgtgacctgagagcagaggtttgtgaccgagatcaccccttgcactgcagcctaggccataagagccgactccatcccccccccccccctcaaggaaagaaaagaaatctgaagaaaggaaaagagaattgaggataaagctttgggataccaaatcccaaatccaatgttagaaataagttccgatatatcacggttgttcctacccaacatagaaggattaacctcatatatgtgaataccaatatccgttaccaagcagcacttgccaatttaagaaagaaaaaccatggggataaaaattttaagtaaatattcaccggaagccagctgctaccaccaaattaattttagttcaaataaaatttaaggaagaaataatgaccaccggatagacactgcacatggagggaccatagaaccgagtaggtgaagcaacgtcaagtcccacgctggcctcgcctcccaggacataccaagaaactaaccggaagagccaggttctagagagggacgctggaactcatacttctgaatttaaatgggaaatagaccaaaatgttatgtgtttataaaagattttaaatcaccaccaatgctgaatatacatcatttcctagtatatgtatacttactaaatgggactcatattaggttgcca

SEQ ID NO: 637174 - DNA, 360 bp, Homo sapiens
gaagtggagcggtttacagcaagcagctttggtcaccctatgttcaagctgctgcgaaatggcgactatcaggcggtgcagtgcagacggaagggcctgctggtgtgtggacgccagtggacggagatgcatggaacccggcagcaaggggagccgacatcttgtgctgaagtgcaatcttgtgcctccgaaaggcagcagggccgtgtccagactctactttgggaccacaggctacttcaagccagcacgagcttgttctcttccacagaccacaacgatgggcctctccaagagtagcccgaatttgcacaatctgaccacccacgatcaaagagctctttgttggactctgggctt

SEQ ID NO: 637175 - DNA, 808 bp, Homo sapiens
  misc_feature (185)..(185): n is a, c, g, or t
  misc_feature (192)..(192): n is a, c, g, or t
  misc_feature (309)..(309): n is a, c, g, or t
  misc_feature (366)..(366): n is a, c, g, or t
  misc_feature (381)..(381): n is a, c, g, or t
  misc_feature (397)..(398): n is a, c, g, or t
  misc_feature (415)..(415): n is a, c, g, or t
  misc_feature (420)..(420): n is a, c, g, or t
  misc_feature (435)..(435): n is a, c, g, or t
  misc_feature (442)..(442): n is a, c, g, or t
  misc_feature (455)..(455): n is a, c, g, or t
  misc_feature (472)..(472): n is a, c, g, or t
  misc_feature (494)..(494): n is a, c, g, or t
  misc_feature (500)..(500): n is a, c, g, or t
  misc_feature (502)..(502): n is a, c, g, or t
  misc_feature (504)..(504): n is a, c, g, or t
  misc_feature (507)..(507): n is a, c, g, or t
  misc_feature (509)..(509): n is a, c, g, or t
  misc_feature (511)..(511): n is a, c, g, or t
  misc_feature (514)..(514): n is a, c, g, or t
  misc_feature (529)..(529): n is a, c, g, or t
  misc_feature (537)..(537): n is a, c, g, or t
  misc_feature (546)..(546): n is a, c, g, or t
  misc_feature (550)..(550): n is a, c, g, or t
  misc_feature (558)..(558): n is a, c, g, or t
gggcacatgtaaactttgattggtcaaatttatgctgtgtgaatactaactatatgtatttaacttagtttaatatttccattttggggaaaaatctttttcacttctcatgatagcggtaatatatatatgctaaatctttatatacagaaatatcagtacttgaacaaattcaaagcacatgngtttatnaacccttgctccttgcatggtcattaggttcaaattataactgatttacattttcagctatatttacttttaaatgcttgagtttcccattttaaaatctaaatagacatcttaatnggtgaaagtgtttaaactacttattgtggtaggcacatcgtggtcaagtgaagtagnttataggtatgggtnttttctccccctcacnnggtgggtggaataagtngattnggccaatgtgtaatntttaacntgttctgtacaantaagtgtctggccattnggtatgatttctgtgtgtgaanggtccnanantcnananggntactccataatcagncaccattnaacccttcnttgntctaaaanaaaaaccaaagggcgctggtgtggaaagggtgaggtgggggagtattctcatctttcgggcattgggggacgcagacagcttacacttgtgtaaagcgtgggaacagcagcaactatacatggaaatataaaccaaaaacctttcactgttctaaactttcctaagatgggtattcatttgcgcggtcagtggagtattccaaagcaaagtgctacttactcgctccttctcttcctccattacaaattg

SEQ ID NO: 637176 - DNA, 842 bp, Homo sapiens
gagtgcatcgtacagtgtaagtaaaccaagttccgatgaacaaggctgggctccatttcctgtaaatcgctgaaagtgggggaacattagctagcagcccagaatttccgcccattcatttcatcactattgcattcttggttgtcttattcaaggttcttggtccaattcgagtccatcgcaattttactcaatcatcgtcaagtgacaacggagaagccagcggcgtttaggacatcctttaataatcaccggtgagcgaagaacgtccggcaaaggcgggcagagttaactcttctccgcgagaaaaacgccaggagttcatcctgttgtttggcgttgtcgccgtgacatatgaaccacatgctcctgagaaccctatggggcgctggtgctcaacacacggccatcggtgggacgtttccaatggacccttagtaccttttgctcttccaccctcctttgggcacaccttctgggcacggaaaaattcctcgaggtggtccaacaattaagtttaaaccatcaacctgatttactagtaaattatttagcctttggtgcccagacgaagtgtgccccttctaatttataatgcgcgcgacgtaaaacactttaccatggaggtggccccccagggggtgttcctccctttgtttggaacgatctgaaattcccttaaatttgcacgcacataggctggtcgcgccgccattatagtacctttctgcgggaagtacacttgagtgtgttaacaccctgggggaggcattaaggaggacctaacaactttatacacacggcacgttgctttcccccaccgagagaggagcgggggcaaa

SEQ ID NO: 637177 - DNA, 227 bp, Homo sapiens
aaagctgcagagagctatgatgtagccactgcagtccagactgggagacaacgagcacgaccctgtcgcaaaaaatacatatgtattataattcctgggaggcattatcactcatgcaaaaggaaccaaaactagaaacatttcatttttgtatagtttagtaatgagacaaggtctcaactcatgtcatccagagctcggagtgcagatgataggggtcctgagct

SEQ ID NO: 637178 - DNA, 123 bp, Homo sapiens
tgagagtcaaaatgaacacattgccatattatacttgctgcccacgctatgacgttggtgtttacagtgttcccaaggcagtggcttatcttcacagcatgcaacccaaagcgctaattcaca

SEQ ID NO: 637179 - DNA, 200 bp, Homo sapiens
tgggccccttggtttggggggggggggcttaaacccctggaactcttaaatttccccgtttgaaaaaaggccccgggggtggacctttggggggaaggcttttaaaccggcttaacccaaaggccggggggtttaattttttttccaaggaaaaggttttttaaaaaagcctaagggccccaagaacaaaagtttttttt

SEQ ID NO: 637180 - DNA, 701 bp, Homo sapiens
gccgagccggggctatttctggcgctggcgcggctccaggaaggcattcgtgtttgttatcgagaggaggccgtgtgtggatcctggccggtcctctgcgcccagcactcggctgctcccgggaatcccgtgagcgcgcatcgcaggccggcggccgagctcgcgcgatcccagccatcactcttctagctgttccttagagcacagggaagatgagtgagtcgagctcgaattccagccaagcccttgggctcctaagcaggacaacaggacggggactgagaaagcggggcccggggcaaggcgcgcgctaagcgagacctccgggggtagtcccggggacgagcgcatgggtcagggagtctagaaaggagcccaggcgaatgtgctcaaaatccttaagagaccgtcgggggccgaccagttgggaatgcaataaactaggcgtgttgccatagacccgggaaaggcaaccaaaattccatggcacggaaatccaaggggcaagaccccgaaggaaacgtggagaacggaggacagaggagggcatctcgcaaggagttccttcggaaggtaggacgcgagttgaccccatgcggtgccgcctggctcctcactgggaggagcagtttccttctgggggactgggacaggcttttgctcccggtcccatggtgcccacagggcgcttcccggcaggc

SEQ ID NO: 637181 - DNA, 147 bp, Homo sapiens
ttttgggggggacttttttgggaaaacccctttccccaaggtgggctttccctttttggatagcccccccccccccctccccggggtggggggggcccgttcccccctttttttttcccagccctttttttttttcccggccgggga

SEQ ID NO: 637182 - DNA, 220 bp, Homo sapiens
agtaaatctgcttaataaatagaacttccctgtgtgctgtgagccagcggacccacttgtccaatgccagatttgtttatctttgtacagaaggtttgatgaggtgtcttgtatttcctcccctaatttaaggttatttaacctcaaatggtaattttataaaatttggttggctgccctccgatgagggatggaggtcgctgccggctcagaggagcct

SEQ ID NO: 637183 - DNA, 892 bp, Homo sapiens
ttggggggcgctacagggcgggacgaaatgttccggcccgcctttcttggggggggggcctcccgctgttttcccgccccgcctgttttgagccccacgcgggcggggccccctcggttggccccgcctggtcaacgtgaggtgatgctacccaacacccgagccacgggtgttggccgaccacacttggtggtctcccaccctgccgaggggagactcttcccctcgtttttttcggagcgtgggcgcccccctcctctgtcgggttcagtggcacggacgggattcccacaaagggggggcgcctcccgagcagggggttttttaaacacccccccccctgtgacggccccaccccgccacttcttcgcgggcctggcgagtgctgcgggcccccgcgcgccgtccttctttcctctctcgcgggggagaacgagagtgcgtgtgccacccacccgcgggggctccctccttttcgtggttaacaccgcccgcgcggggggcgcagccggactccctttcttcttcccgcgagacgattggttctgtcgccctctattcctctcgcgcggagactagcgagggggggagcaccgcccccccttcttctgtgtcctccccctgggggggccaaccccccccgccgcaggtgttcttcggtcctccccgcggaggaacaagcgtctctccttctcctcgggcggtgctagatatcctcgcgcgtccccccttctctctgttgttggcccccctcctgcgaagagttgtttttttttctcccccaccacttgtgacgggggcgggcccccccccccccggggggggtggggggagtccccccgtgggggggggggctcaaaaaagaagggtgggccttgtttttccccgatga

SEQ ID NO: 637184 - DNA, 662 bp, Homo sapiens
tggatcccacccattgaccctgggacccaaaacagaagaaaaagaaccaaaaaacagaaaaaagaaaaaggcagtgagacagatttcagcccaggactcacgccgtgtagaagttgaccctcttttgccacgcagagaggactccaggaaattacagaaggccattgagctgtccctcagggggctcagggacctgccaaaaccagtggaggaggctagcagagcgaacgcataccagttctgggattacgcagcccgtccccaagctgggcgaagttggtgaacacccatgtggccccgttggagcctgacaaggacaattatccgccaggagccctacaccctgccccagggctttcaccttgggatgcttgtggcctgggcgacccgtggtgtgctaacaagaactgtacaccctcctgattgagacctatgtggaagatgatgacaacttgtcccgattggattaatcccccggagttcctttggggggctctccggccacccggctggctcccccagtggccctgtggggtccgagtggtctcaagtcggaacatgggtggggtccatagcgccatcccagcaaacatccatatctatgaccccgagaagacgatggtcgaaatcaattcctgtgttgtcccccagaagctgcgttc

SEQ ID NO: 637185 - DNA, 170 bp, Homo sapiens
ttagcgctcgcgtactccgcggttccctagtggtgttcttgttgtgcatgctctggtacgcgtcggacgcgtggattttctaccgcgatcaccagttggcctcccgcggtccggtcgtaagctgtgtggcagtgacttgtacggcagggcgatgagatagatggtccctg

SEQ ID NO: 637186 - DNA, 1226 bp, Homo sapiens
tcgccgcctcttgtggtgttgttctgccgccgtagtgatcggtgcccgcccgcgtgactgctggggggtgggcggtcgcccccacgtggggagtagggtgagttttgctgcattgcgccgtggtcctgctctgttcctcttttgggtgttatgtggtccccgttgttttgcgttgtggggtgttgtctgcccctctgtgtggttgttgctgtctgtggcctggtttatggggtcgctggtggcatcgttcttgttgttaatgcttgtgtggggttgtctctactctctctgggtatttccgctctttccgcagttccgtataggggggggcctgcttgggggggcgaaccttgttgttgccgaccgtggtaagtagtccttctcatggtccgcttggtgagtttcgcttctaggagatgtcttcgataagctgttgcgcttgggggttaaagctgtgggtgcatattattttggtgatgggtggtattcgtccgctcgtctcgctgcgttgttcttgtggtgccggcttttcttttgtatgggtgggtcatcaacacaacggtgttatcccacggtattcgcgcacgtatgacgggtgttgtttcctctcttcgggtatttagagccatacaacctctgtcgtggtaaatttgtttgtaagtctctctggggatttagaacataggatatatctttgtggataaatctctgactcgctctctaacagctcgtttggactttttatgggtggttattctgtctgtatctgtgtctgtggacttcgcgcctgcctatgtattgcacacgcgggctcgagtgatctgtgttggatattttttggaataaattgtcgtttgtggttgtctatggtgtagaagaaagcgctgtgggggtgtctaaggaggtgctgagtagcacgtggtgtgttctttgtgctctggaatagaaacactctttggataagaatttgtgttgtgtgtggtttgtgtggtttccgtgtttgctgaagcgtggttccgtccgttgttaaagtagttctggtaagtcacacggtgaataaagtctagtccgttcagccaccctcgtggttgttaccgagtagtgtgatcttttatttttaaagtggttcaagtgtatttgatgtagacaccttatactggattttggatattattaaacttttgtcccatttggcttttataataattaataaatacataaatata

SEQ ID NO: 637187 - DNA, 749 bp, Homo sapiens
  misc_feature (407)..(407): n is a, c, g, or t
  misc_feature (549)..(549): n is a, c, g, or t
tggacagtgcagagggtgaccaagccggggaaggccccaggggtccaacaccaaaattaagggttatatttatacacaaaaggacgtttcgtgctcccctcagaagtgtggctgtggccaccctctccccaacttctgtggccaaggctccgtgcacagaaggttgtgtccttcaagggtgtgaccctttcttgtggccgcccacgagcttagaaccctccggcgaaaaaggcacgcagtccatggctggtctgggcacaagtgtcatcttggagccagtctcctacaagccaccggtcttaggcgcgcattcttggtgccttagaggtgtaggccgccttatctggccattccaagatcttgagatgtatccaggccatctcctataagaatgcgagaagttccantatattcacgtagaagcctgtgacaggcccacttattgttgttccgcgcgggcccagaaaccaagaggcgaccacagacagagctccttgtgacatacgggactgtattaagaacgtctgtggcgagaacttccacaccganaaagaaggcatagaccctcttagaacccgtgtgaagggtggtagactgtggtctctcccaagatgggctgtgggcaaagggtgacggggtgccacaaaagatcccctatacggcgcagaaaacttcgccgatcaacagtgtctccagacagacaccttcagaattccagaacaccaagccatattggcgtgtggccaacc

SEQ ID NO: 637188 - DNA, 840 bp, Homo sapiens
gcaggtgcctgagaattacctggaggggccacagcagggactctccgtgcttccttccctgtgctggaagagtcacttcagctgacctcgttcaatgccctctcacttggctcctggcagccccttgctcctgggatctccgtgcccagggaccactcaccctccacctaggcagagagcacaaagctctgaaatcttttcttttttttttttatttttttggaaacacagtctcacctctgtttgcccaggctgtggagttgcagtgggcaccatcttcggcttcacgtgcaaccttccacctccggggtttcaagcagtcctccataccttcaggcctccgtgagttagcgtgggatcacaggcttgccaccaccagtgcccggtggctaatttgggggatttaaggggaggacggggtttcaccatgtttgcccaggctgatctccaactccgtgacctcaatgtgatccaccgtgcctgaacctcccaaagttcggggataacaggcatgagccattggcccggccaaagctctgaaatcttgactctcctctcctccccttcccgtgggctgctgccctcgtggtgggcctgggacaggggtagcccgggagtgacggggggcaggcagcaaaaccagtgagccccgtgtttataaaccgttgaggggcatctggtccctagcctgtctgcagcctctctttacacggtgcaagtcattgcagggtgtttgaatgcccccttttgttctcagaccctccggggttcttgaatagccacattttattacaaccagaatagagctggcactcaaagaatcctctaaacatgggggtc

SEQ ID NO: 637189 - DNA, 356 bp, Homo sapiens
  misc_feature (318)..(318): n is a, c, g, or t
gaggaaggaaacccaggagtgtgaacggatggccacattaggtaagaagaagttggaaacaaagggcatgggaatcttgcactggaatcttcagaaagttataatctccttttaaaacattggtggtgagtgtaagatgtccttcatgttttcttattaagtcagtgtttagaaatgttaccctttctaagttatatacagattaaatgcttttttctttcacgtacatccatcatttgcaactgctgttcgtacacagaaacaggactgctcaaatgatcctatttgtattttctgatgctatcagactctaatgtntttttccctaaaatattattgccatcatgctgtcgacg

SEQ ID NO: 637190 - DNA, 147 bp, Homo sapiens
tcgcacggcgcccgccaatgttcagttgtttttttgtttttttgcgccaatctctctctgtcacccaggctggagggcagtggcgcgatcctggctcactgcaacctctgccttccggattcaagcacgggggctcctctagaagtc

SEQ ID NO: 637191 - DNA, 258 bp, Homo sapiens
ctaaaggatccccgaacaacagcccttttctgaccattaccagcatgacccgagtcattgaagtctcttactggggtaataatgctggggaagaaaatggggacttaaagcacacaagagctgggcttaaagggcctttcttaccctttgattaccaaagacccccagaaagccggaatttgggtacccagcttgaattcctaattatgggcataactggttcctgggggaaaatggtattccgttaccatttcccac

SEQ ID NO: 637192 - DNA, 109 bp, Homo sapiens
gtcattccgtggcggccacccggcaaccgcacgccgacgccccaggaaacccagatctgcctaccgttcatcgagcgccaggtcgagctggtcgatcccgacatcctgg

SEQ ID NO: 637193 - DNA, 128 bp, Homo sapiens
tagggatgttctcctccaccttgtcagccccctgtgggctgtattcgctggctgatgcaatctggggctccagcttggcgaggatcggctgagccccgctgacagcagccgccgtgatggtcctcagt

SEQ ID NO: 637194 - DNA, 453 bp, Homo sapiens
  misc_feature (8)..(8): n is a, c, g, or t
  misc_feature (11)..(11): n is a, c, g, or t
  misc_feature (16)..(16): n is a, c, g, or t
  misc_feature (28)..(28): n is a, c, g, or t
  misc_feature (51)..(51): n is a, c, g, or t
  misc_feature (59)..(59): n is a, c, g, or t
  misc_feature (61)..(61): n is a, c, g, or t
  misc_feature (64)..(64): n is a, c, g, or t
  misc_feature (84)..(84): n is a, c, g, or t
  misc_feature (122)..(122): n is a, c, g, or t
  misc_feature (127)..(127): n is a, c, g, or t
  misc_feature (140)..(140): n is a, c, g, or t
  misc_feature (152)..(153): n is a, c, g, or t
  misc_feature (157)..(157): n is a, c, g, or t
  misc_feature (161)..(161): n is a, c, g, or t
  misc_feature (165)..(165): n is a, c, g, or t
  misc_feature (172)..(172): n is a, c, g, or t
  misc_feature (176)..(176): n is a, c, g, or t
  misc_feature (184)..(184): n is a, c, g, or t
  misc_feature (191)..(191): n is a, c, g, or t
  misc_feature (199)..(200): n is a, c, g, or t
  misc_feature (211)..(211): n is a, c, g, or t
  misc_feature (220)..(220): n is a, c, g, or t
  misc_feature (223)..(223): n is a, c, g, or t
  misc_feature (240)..(240): n is a, c, g, or t
  misc_feature (244)..(244): n is a, c, g, or t
  misc_feature (250)..(251): n is a, c, g, or t
  misc_feature (267)..(267): n is a, c, g, or t
  misc_feature (298)..(298): n is a, c, g, or t
  misc_feature (303)..(303): n is a, c, g, or t
  misc_feature (310)..(310): n is a, c, g, or t
  misc_feature (313)..(313): n is a, c, g, or t
  misc_feature (328)..(328): n is a, c, g, or t
  misc_feature (333)..(333): n is a, c, g, or t
  misc_feature (351)..(352): n is a, c, g, or t
  misc_feature (356)..(356): n is a, c, g, or t
  misc_feature (365)..(366): n is a, c, g, or t
  misc_feature (369)..(369): n is a, c, g, or t
  misc_feature (373)..(373): n is a, c, g, or t
  misc_feature (385)..(385): n is a, c, g, or t
tccagggnttnatttntttatttacaanagcattctaggggaaaggggaangggccccncnccncagtgcccaaggggacaggnctggggcagccccacctggcccatggctctgcagagcnctgcnccctccccaaggntgttacccacgnngganagangggngttctcncaanaccagggntgatttngggggggnnggggggaaccncgtctaggnccnaccaacactagcccccncccngggggnncccaagttctgaaaanaaaaccaaacgcagtgggcccacgtcagggnctccncgttccngcncgtaacacccacganaccantgcagcctcagcatgggnngcanggggggggnnggnctgngggggggggggnaggactgaagaggggggggggcccgcactccctgccagccgcccaccacctgccttttctattttggc

SEQ ID NO: 637195 - DNA, 129 bp, Homo sapiens
aaagcccccccccccccccctcccccccatttgaagaacccggatacataaaattttgccaaaaaagggagggattggacccccccaagggggtttcaagccaaccccctggcccccatggttttttca

SEQ ID NO: 637196 - DNA, 441 bp, Homo sapiens
caggcgaaacctaattctggactcgtgactgtatgatgcggatagctatgatgtccagaccctggagctgctcagcgaaacagaatggtagagggggcctggactcgccctccgggcatcccgctaggaagtgggtctcattcgggcttggagttccgtcccctggaacaaaactcccctgggcagtaccactggtagggcagggcccctgaaggagggctccccataaccgtacagggtcgaggacctgaggctgtaggtggcagaacttccagttcctgaccgaagagtagactttcacggagccgtcgcaggtcctgcccattttggaccagcagccaacagtgtcaaagcctgaccccgagcgcccgagcccagcggatgtgactgcttctgcacaccaacctccaagaagtcgtggaaaaggtgcggtgtgccatg

SEQ ID NO: 637197 - DNA, 203 bp, Homo sapiens
tgtgcctgtctactgctcagagattctactccctctcctgtgaaatcaggattactcttgtaactgtttctttcttgccatcatttagccatagtgcagagtgcctccatgataaatttggacacatctcaagcccttaatggtttgtcattgccctgaaaaaaaaaaaagccacatttattaacactgcactttcttccaat

SEQ ID NO: 637198 - DNA, 342 bp, Homo sapiens
  misc_feature (33)..(33): n is a, c, g, or t
agctgtttctcatgttgtcaggtgtctcgactnccactcaggtgatctgctgcctcagcctcccaagtgctgggattatagcgtgagcaccggggcccgtggagctgttttagagaaggcttaactgactgctcagcttcagttagatattccttcttcctggggtgctcccccaggcccaatactttgtctgtcacagcacctaacatagtgtctgtaattgcttctgttgcttgcttctcccactaagctatatagggaggtcaaatgatgagaagacagatgaagtgtggagaatagaaaagagctggtttagaaaatgagcagcattgagggcccaac

SEQ ID NO: 637199 - DNA, 136 bp, Homo sapiens
acggtattacagacgtgcacaccatgctgactaattttgttcagtagcagacaagtttgcgcgtatgctggcaggctgacctcgaactcctagcctcctcatatgatccacccaccctcagtctcccacagtgctg

SEQ ID NO: 637200 - DNA, 225 bp, Homo sapiens
cacgaggccagatccctgcaccagctctttgaaatgatgtaaagcttccatacaatgccctgcaatgtctgtcacaaaaaatggatgtcttttgtgaaaatcacctaaaggatgtggatttctcagaaaacgcactcaaagaagatcccctgcaacttttccagcttgatgccctcatgttcttgaggctacaggggaaccatctggtggaacttccacctcatg

SEQ ID NO: 637201 - DNA, 354 bp, Homo sapiens
gcatcctttcaaatggattcagcacaaagctgcaaatgcttgttattattaaactcagtgtacttaactcacaccaggagaactttctcctacaagagattggaaatctcttacaaatgattagaaacaccagacaatatgatggttatagatagaaatacagatacgtagatatctctcccactctttggacactgtaaaacatttatatttatcctccaaccacaagagatggtcttaaacttttaatttatttcctagtaaaaaaaatgtataaacattcttacacaatgctaggcacataatagaattcgatagattctattgaatgagctcagcttttcatcttttttt

SEQ ID NO: 637202 - DNA, 530 bp, Homo sapiens
gcaccattagtacactttttagataaaaaaattcggaattagccacggatttatgactacagttcacgcttatacagctgatcaaagactacaagattcaccacacaaagatttaagaagagctagagctgctgcttataatattgttccttcttcaacaggggcagcaaaagctattggtttagttgttccttcattaactggaaaattagacggaattgctattagagttccagttattacagggtcatttgttgacttatctgttgaattaaaatcaaatccaagcgttgaagaagttaatgccgaaatgaaaagagttcaaaatgaatcattccaatacaacgaagatcaagttgtttcttcagatattgttaacaatacacatggttccatttttgatgcaacattaactaaatttatagatgtaaatggaaaaagattatacaaactctatgcttgatatgacaatgaatcttcatttgttgctcaatatgtaagagttgctttacactttgcaaaaaaaaaaa

SEQ ID NO: 637203 - DNA, 957 bp, Homo sapiens
  misc_feature (957)..(957): n is a, c, g, or t
agcggattccaggtgtaagccaccacgctcggccaataaattatgaatataatattaagatgacctccatgtaatacctttggcatgtcagattcacataagtgacatgtcctgtttatgcctttatgacgccttgccttcaccttccaaacatattacagaatggtagtcgtagcaccattcgtaaggttgccacttaacttgagcacctctgatgattgttcatcatagtacatactatctagctcgctaactggatgcatgaaccaaacagctcaatatgtcctccttgaactcgggtccccagccctagtatggcctgcagtattccatgtcaaggccgtggggggccagcccggcgttgcgcgaagagcaattttcggggtttccggccctttacccatttggtaggcgtggtacccatcttgccaatgcttgtccccgccgttcgatcgtccgctatagcttgccatcattggctgggtcctcgccttgtcggtcgacccattgttgtcaccgtcccgtcgttcaaccacattctcccacgtgcccctttgtatctctccaccttaggaccgggttcgaacccccctttattcccccttggccccccattggttgttcccaccccctttttttccgcccctttgccgggttaattcttaggcgacagcgcggcacttacacaccgggcttttagaactttgcaatgctgggtagttccggggagaggttaaacccctggtgacggcgttcccgcctttgggacactaggggttgggcccctcttgggcaccttggcctttgggtgccaaccacaaatttccggaagcgagaaaaaccccaaaggcaaattggcaccaaaccccccccgggacgtttggaactttcaaactgcgcgcacaatggagacacgacaagaattccccccgagcgagcaaaccttttcccacgagn

SEQ ID NO: 637204 - DNA, 126 bp, Homo sapiens
gacacaagctatcacgtggctgctctgctctcccaggctggtgttgccctcgttcccacatgtgcagccttctactatctactagctcagaactggagctcacggtgggatttgcttggtgattat

SEQ ID NO: 637205 - DNA, 400 bp, Homo sapiens
ccggaaagattggactctccttattagctggttcctcctgtctgtactctgagcccatgctgtgctcgtcagacagcaacaagggagaatacagcagcccagaatgcaggctgcagagtcagatccccagaacaggatctcagccggctccatccttcctcagctgggcgaccgtggccattgacttcctctctgtgcctcagttgctccatctgtgcaatgacgattgtcatagtccctgcttcaaagagtcactgggaggattaactgagaaaatgcagggaaggtgcttggaactaaatgctccaaaaaagtccatctggccaggcacggtgtctcacgcccgtaatcccagcacttcgggagactgaggcaggtggatcacttaggtcaggaattc

SEQ ID NO: 637206 - DNA, 208 bp, Homo sapiens
  misc_feature (172)..(172): n is a, c, g, or t
gtctgggtatctaaggatccctgtgttgggaggtttggttgtaagcagctggccggcgtgtgacagaaatctgattgagaggagcttctagggatctgtgacccctcttctactacctgtcttttaccccagctgaagcactgcgctggctgctcagagaactgagcctggncgggccctctgctgctcccgccgtcccaaagcacat

SEQ ID NO: 637207 - DNA, 170 bp, Homo sapiens
tcgataacaagtatatgtgaatacatatgctctacagaatgaagtacaaggaatatactaatacagaaagttagagacatcaagagatgtacattactagaggtcataccatattcgaacttacaagaatctccagccaggcacagtggctcaggcctgtaatcccagca

SEQ ID NO: 637208 - DNA, 291 bp, Homo sapiens
tcgaaagctattgacctgcgagtaatagtatatacatgagtacaaaagcataacctaaagtaaacttgtaggctattactaacaatgctttaactagagtggtaagatgggcagcttttttttgtttaatagccagatactttttatactccgaatacaaatattgaaaaaaatgaaaggaaaaccccctagatcaaactaggtcaatccatggcctctgggctgcatgtggcccaggatgacttttaatgcagcccaacacaaattcataaactttcttaaaacgttgtg

SEQ ID NO: 637209 - DNA, 292 bp, Homo sapiens
cagaggctgaggggaggattgcttgggcccaggaatttgaatttacagtgagctatgattgtccactgcactccagcctgggccacagagtgagaacctgtctcttaaaaaaaaaaaaaaaaaaaaaaaaaaattcaggtttcctgcttgctcatggtcgcacatgtagctactccaaaggctgaggggaggattgcttgggcccaggaatttgaatttacagtgagctatgattgtccactgcactccagcctgggccccagagtgagaacctgtctcttaaaaaaaaaaa

SEQ ID NO: 637210 - DNA, 190 bp, Homo sapiens
cccgagctcgtgcatccatgaacaacattcagatgcaataaaacaaggaacaacgggaaaagagaatctaaaaataaaaatgatgatacccctcccccaggctttttcttaaaagggttaaaccataagctcaggaaaatctcccagaaagcagaacagaaagacgaatagataagtgataacagagaag

SEQ ID NO: 637211 - DNA, 101 bp, Homo sapiens
atctaagatccccctcggtcgcccttgttcgggttatgagtatacactagtctttttactttaggaatagcgtctattactggccgggtgctgtgactcac

SEQ ID NO: 637212 - DNA, 142 bp, Homo sapiens
actgcaggagcctgttctgtaactcgataaaccccgatcaagcctcaccacctcttgcccagcctatataccgccttcatcagggctttgctgaacgatgcgcggtatataggctgagcaacgaggtggtgaggttcaccgc

SEQ ID NO: 637213 - DNA, 134 bp, Homo sapiens
agtttggaatattaagagaatttccattttacagtgtctccatagctgtggtgcttcttacaaccctttcactttatttcttgtgacgacgagatttcgcatctgttgcccagagctggatgtgcaggtgtgcg

SEQ ID NO: 637214 - DNA, 115 bp, Homo sapiens
gcgcctcctgtgtcctacaggggcgccagacggatttccactcggcttgaggtagattagtgccacgtgccccaaagtcttaaattgggtgaccataagctgtgcaattgataat

SEQ ID NO: 637215 - DNA, 218 bp, Homo sapiens
agacatgacagacatgataatatcccagacattacagacatgataacatcacagacattacagacatgatagtatctcagacattaaagacatgatagtatcccagatattacagacattacaggcatgacagtatctcagatattacaggcattacagacatgttagtatcccagctattacagacattacagacatgatagtatcccagtcgacgc

SEQ ID NO: 637216 - DNA, 382 bp, Homo sapiens
gcagtgcaccttgattctgtagtgctctagaggatccgatgttctcaagagcgcggctattggtaaatctctgaaattgctgcttccctctggcagtcttggaatacactcagatactgcagaccgtgacgattcctatccaaatgcagctattggtattgaggttgaactagataaataaatcccggtgtgaaaatcccattgactcgtgccttttgccagctcattagtactctggtggagagctcatttccttctaatttggtctgacttgagaacctggcgttgacccttatttgcagttccttagagactctgtgtttctacgattccgtacaagagcttaccggagagcagctgaaaaggttatgttcagagaaaa

SEQ ID NO: 637217 - DNA, 1141 bp, Homo sapiens
ctaccagaacaagccttagatcagaagccatttgacccaaataaagtataggcgatagaaattgaaagctgtgtggcaatagatatagtaccgcaagggaaagatgaaaaattatagtccaagtataatatagacaaggactaaccccgtataccttctgtgagtaatgaattaagctagaaatagactttgcaaggagacgccatgagctatagacctccacgaaatctagacgagctaccataagaacagctataaagagcacgaccacgtcttatgtatgcaataatatgtgggaagatttataggtagaggcgacaaacgctaccgagccgtgggtgatagctggttgtgccaagactagaagtcgttcagtctcacatcttgtacacactttgtcgccagcagtaaccctctaaatcccctgtgtagatttaactgttagtccagaagaggaacagctctttggtacactaggacaataccatgcttgtagagagagtaaagaaatttatgcacccatgagtatggcctaaaagctagccaccaattaagaaagcgttcaagctcaagaccacactagtctaatgaaatcccaaaagatataagtgaagtcctcacaggccaattggggccattctatcagcctatagaagaactaatgttagtcactaaggtaacattgggagcattctcctccggataacagcctggcgtcccgagttacagactggagactgggcaattagcatggccaatattcttgtatccaaccgacaagtccttttagcccgcatggtgcacccaaaaaaggcatgctctcaaggacagggcaaccacgcaaagggagctggcagatctttacccgccgtgttcacgaaaactctgccttaaattccccccgtttataaggccctgccccagaaccgtgttaaaggggggggtacaaacaggaggagaggaataaacaaggcgtataaagacgagcagtagatcacccaaagaagttacatataaagagaacacgtacaaggagcataaaaacaaccacgcacatcaagaagacaaaataagtgccggcccacacacaatagagatgtccgtccctctccacctcatacatgtctgtaataaaaaaata

SEQ ID NO: 637218 - DNA, 290 bp, Homo sapiens
ggcccccccgattttttttgtttttagggccagggtgctgttgaaaagcccccccgtgggttttttatttttcccccaagccgccttccaaaattcccccgggggcccctgggaggggaaattcccgtttttttttaataaggggaaatcccctgggtaaaaccccccccgtttgggttgggtgggccccccgtttttttccccgggggaggggtggggttttttggccccttgcctccccccttttttttttttggggggggaattaacccctttttggtcccccctta

SEQ ID NO: 637219 - DNA, 459 bp, Homo sapiens
taggcttcctcagccctctgtcatatggctgttttccaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgcactagcctactcatctttgtttctctgaatggacaactgtcatggtcccggccacggatctttatctggttcatcgtatttatatgtgaggcatggatggctgcggggcttcaagtaagatagggggatgttttttaaagtccaggtgcgctgtccttttttactttattgtctccatagctgtgtgatgtcaatgctatctccatgatacaattcattaagggtgttttggtcctttgaaatgtatcatgtaaagccattttttttcctcaaataaga

SEQ ID NO: 637220 - DNA, 331 bp, Homo sapiens
  misc_feature (44)..(44): n is a, c, g, or t
  misc_feature (64)..(64): n is a, c, g, or t
  misc_feature (67)..(67): n is a, c, g, or t
  misc_feature (87)..(87): n is a, c, g, or t
  misc_feature (91)..(91): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (164)..(164): n is a, c, g, or t
  misc_feature (204)..(204): n is a, c, g, or t
  misc_feature (293)..(293): n is a, c, g, or t
  misc_feature (303)..(304): n is a, c, g, or t
  misc_feature (309)..(309): n is a, c, g, or t
gctgcttcgacatctatcccaacctgagtcccgtcaaagggggnttacaacaaatgtgcttgtngtntatcatctctagctagtgtntcanaggggggggagtatcatttcctgggtgactttgcatagagcaagctccccaaaggncanggnatactcaatcnagattcttccaatcctccggtacccaccaagtcaaaaganttctggctccctgtagcttcatctaagtgcttttctgttagaggagaaaagtgaggaaagcgatgctctttcaataagttcggcagggnggggcaaggnntggtncaaattgattttttttttttct

SEQ ID NO: 637221 - DNA, 1271 bp, Homo sapiens
gacaagaattatgcgtatgaacgccctgtcttgccgcatttgggagcctgtgatctagtcctgggggcccccctcttggaccgtaatcacttacacggaggccagctccccttcatgtcgtggggtcgctgtccgtgtgtagggccaatcctcgttcgggttccctcaggaataagctgtgtgtgtatagtacgtggtgggttccctctgggtaaagttcgataaggcggcttccattcccgctgttaatggtgtatacaccgtcgcatttctctgttgtgtgagaaacgaggctggtcagcagctatccaattattcacgcatgtgaccgtccatctgaacccgttcttaaatccgttcgatgcaacaactgccgactaaaaccagatgagatattggaagggagcgatccaattatgattcggaagggcgtacgtatcagtgaggttgataaccaatcgtatgcttccggcgagcggaacaaatcgtcccgccttttcaatgacgccaaccacgggccaaataaaggaataagcgtctgcgtgacgtaaccggcgatgatgatcgtccagtttgtactgccgggaagctacttctacggttcaatcgtagaggggtatcactccagtgggtaagaatcttcctcgcttgagttgacgaaccgtagcaccctggtgcgaacggaagctccattattctcctcaggaattgcaccgatagtacggggcaaatcgtaccttcgcggagagcagaactgaagtgttccgataaaggagatcttgcgggcccgttctcggtgcaatggccttcagttctcccacattataggaccctcacaggatggtacaaacccaagggaatgtcacgctcatcatagccgtgatgtctccatcagatggcatccggcttgtcacgtgcatttagaccaacatccggatatggggcctctcttaagaagtcagagtagagtcataacatgcgtgatgtttaaaccttacatgatcggcgagtctgttggtatcataaattaggaatctcgggccgggcagcagatggctcatgcctgtaatcccaacactttgggagaccgaggcgggtggatcacctgaggtcaggagttcaagaccagcctggccaacatggtgaaaccccgtctctactattaaatacaaaaattagccaggcatggtggtatgcgcctgtagtcccagtcttgggaggctgaggcaggagaatcgcttgaacccagaggaagaggttgcagtgagcca

SEQ ID NO: 637222 - DNA, 647 bp, Homo sapiens
accaacatggtgaaattccatctctactaaaaatacaaaaattagccaggcgtggtggtgcatgcctgtaatcccagctaatagagaggctgaggcaggagaatcacttgaatccagaaggcggaggttgccgtgagctgagatcacgtcattgcactccatcctgagccacaagagcaaaactccgtctcaaaaaaaaaaaagaagaaggtggatctccaaccaggccagagaagattctcacagaaggtttggaacctctaagaaataaatgggttgggtaataaatggcttctggtcagataaaaaaaaaaaaaaaaaaaaaaactttgtgtggggcggccctgggcccctatgaaaaaacggattttataaaaccaactttggtttggggcggcgggcggcgaccccaggtaaggtatactaggacacagttgcgcaatacgcggtgttcccaaaagaaaacccggggccatgagcatacgcgctgtgggtcttctccacccaatataaaaaaacccgccgcggggggacacccgcgggcgtttttgaaccaaactccgagatgagggtctcggaggcaccatcacggggcctttatcaaacgggggctccagggagcctgatataaactctcagggcgggag

SEQ ID NO: 637223 - DNA, 250 bp, Homo sapiens
aaggggggggggggaaaagggggtttccccccccttttttgcccccgggttggccgggcctttttggttacccacccccccctggggggtttttttctgggttgggggaaaatggggccccctccccggggggggggggaaaaaccccccccaaagggattgggttttttaaaaggggaaggggggggtcccccccgggttttttcccggggttttttccttccctttaaggttccggggtttgggttta

SEQ ID NO: 637224 - DNA, 659 bp, Homo sapiens
tgggaagccccgtgcacatgggccagaatcggcagggcccggagcagggggccttctgtccacaatccctccagcgggcacagttcaccaaacgcacccccttcctggacacggggcaaagggtgttggctcatttcgagcaagcctggttcggtggaggtggcaggaagaggaggtgtgcacaggtgatgaaactcacagaggaggccagatctccttccaggggcagctgctgaacaccaagggaggccgagacctctgtggggaacagtgagtggggtcattacccatatagttctttcattcccaaaggacgtgcagtcgcgggaagtataccttttcctcccaattccgtgcccaggccaataaatctcccaggggtcttcccatgttcagcatcgtgattcccgagtgaagcttcgttcagcgaatcccacaattggcgcggtcctatcatcgaaagacgcgtcgcgctggggggagatcgtgcacgtggccaggggcactgtggatcgattcccacaagtgtgagctttctggcggccagctggaggtgtgttgcctcatggggggggtggtccataaccaagaatgcccttcctggagtggcgggcctccaaatccactttgtccacaccggggccagccctggccaccat

SEQ ID NO: 637225 - DNA, 247 bp, Homo sapiens
acggcgtatgcggggagccggtgatattgcgataaagttgcccgaagcgggcggaaagggcttcaccataatggcggctgacttcggtgaccttttgcagcacggtttgcccttcgaccagcgtcggcggcactatttttggtaccggttcagcagggggcgtagcggcaacggtgcgcaactggtcgatcaactctttacgcgaggtgtcattatccagcacatccgccagtgcgccatacgccgt

SEQ ID NO: 637226 - DNA, 273 bp, Homo sapiens
  misc_feature (198)..(198): n is a, c, g, or t
ctcacagtggaagcattcccagaacagagtggaagtagggagataatttgaagtataggcactggagaaaatgttattcaaaaaactgttgagaagaaattggaagttgatgaggcagaaagatacaggaaacctattccaagtggcaagaaccccagtggcacactcaccaatttagagatgtcttctccattaagntaaatgagaatagttgctaacagaccactctcatctctttttgatctccaaccccaccctttctagacttcaacc

SEQ ID NO: 637227 - DNA, 211 bp, Homo sapiens
attacacatgccagcatccccgtacaagtgagttcacccactaaatcaccacgatcaaaagggacaagcatcaagcacgcagacaatgcagctcaaaacgcttagcctagccaaacccccacggaaaacagcagtgattaacctttaacaataaacgaaagttaaactaagactatactaaccccagggttggtcaactttcgtgccagga

SEQ ID NO: 637228 - DNA, 349 bp, Homo sapiens
cgcacgacatgagcctgcacccaatgtgctgagcctgcacccaagtgctagcctgcagccatgtcagagcatgccacccaagtgctgagcctgccttcatagtcactccagcacagccagcagaagacagcagaagtatgtgtccaagccatgccttgaggagcggccaccagatgctgaattcccttttccatttcttgtgtttgagtcccattttgcctttgaattaagcatttctgttctccccccaaaaaatgaatgttgcttattgaatgcttttcttttcctaacaacaactctgaggtcttctgaaatagaagcctgaagagggtccttaggtacccaggag

SEQ ID NO: 637229 - DNA, 821 bp, Homo sapiens
aggagcgcgcggcacaatgtcgatatttcgtcccacgaaaggttgttcaagtaggtttccgatatcccgcttctgttgtgcctttcctcggtattgttaatcgcttgcactgatgcgctattggttcaagttcgccaacacggtccccatcgatgccagcggccacttttctgaataaagggctttacaacaggccgaaggaggtgttggccgccactggaaggaaatatgcgccagattaccctggaaaaaattgggggaaaaacaaattaatgcaagcgtgggaaaaaaaaagatacacgtctgttcccccacccaccagcgcacttctttgtgggaaatcatatctccccccattgttgaagaatggtcgtcccacatccccccctgttgatggaccgctcccctaattcatctttggagacacccttccacattctttctcttcacgtagatctccacaaacagcccctcacagccaacaattatctgtgtgataaaaggtatgggacccacgtctggatcctctgaattgaactcccccccccaaggactcctcaagtaggctgttatttaaactacaggcattttttgaaacaaattctagccccaatgcgtcagcagaaacaacaccaagagtgagtttcaatttgaataactttcgatgataatctcattattcatgcggtttcatacaacctctggcgcgtacaaccccacatcaccccaacgaatcttttttgagacaccatgattaattaacggtagtccccggggttcaaaaagaaggtaaaaccccaaaaaaaagaagcgccccacag

SEQ ID NO: 637230 - DNA, 532 bp, Homo sapiens
attcctaggcctcgttgttccgccatttggggcgttctctccggtgtccccaagtgccgggttcccgctgggcccagcttgtccgcgcacccagtttcacgtgcttgctgctggggtgttatggccggtgtttccccgcacagcgtcttgtctcctatcctcgtagtttccgtcgatattcgcgtgttccccggaggctctatctccccccgggatgcgcttccctcatgctgtatgggagcactgactgttttctagaccgccgtggatatttcaatgactgattccccgcaagtgtagaaacctgtctgttcatcacggcaaagactgcgagatgtcaaagagagacgccctactctcacctcgagtggcgacaataatggcagccggccccccccttccccaccactgtgagagaccccctattagactcatgatgtattttgcgacaaatcatagtaaggagtatggatacccccccaaggggggtctagcccgccccctggccccccaaagtttgtcaaaaaaagaa

SEQ ID NO: 637231 - DNA, 987 bp, Homo sapiens
tatacccagcccccaaggggagtgttcaattgtggaaagggggcccccaaattaaccaagggtgaaacagcgtgggacctgtggggcgtggaaaaaccccctctcccctctccccatataacatgtgcccaccgtgccccaaattaaaaaaaaaaccaaccttaggtggagaagaaccccgccagagaaacgcgcacacaagggggcgagggagagaaaaagcagacgtgtgagaactcccagaggcgcgcccggggtgagaaagagactcacacgcgcggtgtgcggccggcgaggggcgccacaagagggatcagacgaggggagccacaacaaagacacgcgcgcgccacgggtaataacaaagaatcactacagagagtgactctataccccacgcggaggggatataagtagaaatataaacatatattaccaaagaacacagtaaaggagaacaaaaataatcttaatctcccacatgggtagaaaacaaacaactcaatctacgcgccaacctcacagggtagtagagtatgctaatacgcccagcagaaggcaacacacaacgaggggcaacaaaatctataaatgacaagcgcgggtgatgcgcggagaataaatacatataggaggtatcaactgtgaaaaatatgtgtagcaaaccaaatgtggggtctacactaagaagcgcgatgtagtaatatccactgagaaacaacccaaacgaggagataaacacaacagtggctagcacacaaccaacaagaagtggcggtgcagctaccaacacaccactcgcgaccgcgaaggaaacacacccccacaaacttatgagcaggagagagaccgacgctatcatatgataaaaataatgacccgaaaaagaagggaaccacagaggaggtataaacaaactcgcgtggagaacaaataaaaagagagaaaagacacccgggagcaaacaacagacaccaaagacaacac

SEQ ID NO: 637232 - DNA, 138 bp, Homo sapiens
gcggccgcctactactactactgctcgaattcaagcttctaacgatgtacggggacatggagggatgtctgggggatgctgtgcgctgccgctacgatgtttggttagagattaaagccatttcagaagtggaaaaaa

SEQ ID NO: 637233 - DNA, 694 bp, Homo sapiens
cgcactaatcgaggtttgcctaggctggcatagattcggttgtatccgctcatagctgctttggtcccgaaagatgccgactctggctgtctcaaaccttgccctgactgaatctaaccagaagaaccctgttaagccctgctgcgctcgaccagagaccacgaaggctcgcgaagcgtgaatcatcaagaacggtgaagaccactgaggacatctaattgaggccgacagggaacgcttgaaagccctaggatttaaaatatgaaacggtgggaagatgtgagaatagataattgctgaagaatgaagaagattaattttggaagagctttgacaagctttgatatgtggaaaaagtaattataagatattggtagaagaaagctaatggttactcgtggaagatcaaaaaaaaaaaataatgatacaggccgaaacaagagctcacttggtcaattaaaaaaaaaatgagaacccttttggcccacttggcccaagcctactttagccttacgcaagcttacgcatgcggccgcaattggaccaaattggcccatatggccctatagagagttgatttacaatcattggccaccgtttaacagggataaccttggaaaccctgctgtatcccatttgatcccttggccgtaaatcactctttcgcaactggactaatcccgttatgttttaa

SEQ ID NO: 637234 - DNA, 133 bp, Homo sapiens
gctgatgctgaaggcgactctagaggtatcccctccaggatgctttcatgctgagctgggactgcagctctatctccaagcttgcagtcccagctcagtcatgaaagcatccctggaaggcaaactggcggag

SEQ ID NO: 637235 - DNA, 289 bp, Homo sapiens
acccacacaattaaactatctgagaaacactgaccaatgttaacgacactcgttcccctgccttggctacttagttgctgaggatgtaatgagcactgttctcacagcctgttcccctgtccttccctttaggagacgagtgataaacctaaaatgaagacaatgcaaaagccccagtagtttcctcaggagaatggaatgaaagacccatctatcgctttctccaaacccaagaaaaagaattttttttccatggtggagttgatgattagcgatcttgaagagaccg

SEQ ID NO: 637236 - DNA, 322 bp, Homo sapiens
tcctggatactcattattttgccctatttatttgtgtagttgaaaaaaacattacatttatcatcctaacaatttttaagcatatagttcaatagtgttaaatatattcatgttgttgtatagcagatctctagaactttttcatcttgcaaaactgaaactctatacccattgagcgttaatttcctctctctcttccaccagctcttggcaaccacctttctactttctatgattttgactactttagatacttcatgtgagtggaatcatagagtatttatatttttgtacctggcttattttacttagcataatgtcc

SEQ ID NO: 637237 - DNA, 163 bp, Homo sapiens
tttacgggggggggccctttttttttttacaaaaacttgggaaacccaaggttttttttccccccgggggggttaattggggaaggtttttaaagacccccccccggtttcagattttgctggggggtgaccccaaaaaattgtcccgtttgttcccaattta

SEQ ID NO: 637238 - DNA, 389 bp, Homo sapiens
ggcggatatctctgccgggtgactagctgtttcctttctctctcgcgcgcggtgtggtggcagcaggcgcagcccagcttgaaatgcaagaaggaacgccgggaagtccggggaaccctgtaccgctgccgggacaagtggctcccgggtaagccaattcgctttcatcgggtgccaagggaacccgtgattttctatcgagattgaaggttgccgcggtatgaccatggttccccacggccgggtttttcaaggggccaggttaaaacacattgtaagtgcttatcgtggggggcgccatttccggagggcatggggtgaacatcagggatgattccaatgccaccggatgtggccaagggccgatgtggaatccgtcctaagagact

SEQ ID NO: 637239 - DNA, 1904 bp, Homo sapiens
acacgtaaccctacctaccggttctaacgtgtcgctgaacggcactgtgtgtggctgacacttcgtgcaccgacggtgacgacgacgacgacgacacctacgtctcaacgtttttttttttttttttttttttttttttttttttttttttttttttttttttttttttttgaggagagcagaggagacacacgcggcggggaggcgggggggagggggaggggggtgggagggtggagcagggtggtgtggtgcgaggggtggtgggagacacaccagcggggtgtgtgtgtgtgggggcgggcggagtgagcgggtgtgttgggtgtgtggtgggggaggtgggtgtgggtggggcgcgacgcacgcacgcgcgagggtggtgggaagacacacacacgcggagagggcggagccaggagcgggggggcgcagacacacacacacgcggcgagcggagacgccggcgagagagagagcgagagcgcagcgagtgcgaccgacggcacggccgcaggcaccacagcgcggcgtgccgcgacacgcaacagcacacacagagcagcgcggcgcgcagactcgcagcgcgaagcagggagagaccaaacagcggcgcggggggagtgaggcgagagaagagagaggagagagagcaaaagagacgagaggaggagaggagagacacacacagaacaacacaacaccacagacaggagacagagagagcgcggtggggcgccgacacgccgcgcgcggcggggcgcggccccccgcgcggcgcgcagcggggaggagcggcccacccagagacgccacagcgcgcagcgagggcccagccgcgaggggcgggcggacgcggcacagacacgcgggaggggccgagagcggcggacgaggcgccgagagccacgcccaaacgcagcccggcgggccgccgcaggacgcgcgcacccgagcagcgcgaggggaggaggcgagaaagccagccacgacagacgcagaggaccggacgccgacgggagagccgacacggggcacacgcgacaacgacacgacgggggacgagaagagtgcgagcgaagagaaacacacaccgcacgcgggcgcaggactagcaccacaacaggaagcagcgcgggaacagcgaggcggagagcggcggcggacagacaccgacgccacacagcgagcgccgcaggggcacgacggagacgaccgcaaaacgagagcgagcagcacgagagcgagcagagagagcagagcgaagacaggagacgccagcggaacggaagcgaaacccaacactggcacggagcaggacgagacccacagcacgaccgagagggaaagacagcagcgcagcacgacggacaccgagcgagcgagcgcagcacaagccaagacggagcaagcggggggggagacggagaggcggagggacgagacgcagccgacccaacgacggagcagagagcgcagcagagaaggacaccaagcagcagaacgcagcgagacagagacacgagaccgcagagaacggcaacacggagaggagcgagaggacggacaacgacgacagacacacaaagacgcgagcacacgcagagcgcaggatgtggagaggcaggagcaaggcaaggagcgaaacgacggcacagccagcacaaacgcacgagcgagaagaagacaacgcgagcgcggcgagaagaagaaagcacacacacaaggagcacgaagcgagacgacgagaaacacaacgaacatgggatacgccaccagaacgacagaagcagcacaagagaaagaggagcacgacgagagtgcagcctgcgggaccgcaaagacgaggacgacaaggagacacaccgcacggaggcacaccacagtgggcgaggggacaagca

SEQ ID NO: 637240 - DNA, 117 bp, Homo sapiens
ccttacccctccggggagcccttaacctctaactggcaacactctgcccattgtgcgcatgcgatttcctttgggcatcctgcaatgtatactcgctggcaatccaactccattcca

SEQ ID NO: 637241 - DNA, 376 bp, Homo sapiens
tcagaggatccttttctgccacgactcggatagtaaactagggtggggggggtaacttctgtgatacatagtaggtgaatagtaaactggtgggagtgtgatcatccagtgatggatccatggagagcaggtggacagtgaggggagaatggggaactgatgtgtgatcagttaacgtgttggtaaatgaaacgacgttccagggcacggaggctacgtgctgtgatctatgaacgggtctactgggcgcaacacctgagttactgggggctgctacactcagcactggacatgcttaacgtggggacgctaactagacccatgacttcttccaggacatgggttacgacggtccatacagggctgtacgtaccta

SEQ ID NO: 637242 - DNA, 136 bp, Homo sapiens
  misc_feature (9)..(9): n is a, c, g, or t
  misc_feature (53)..(53): n is a, c, g, or t
  misc_feature (65)..(65): n is a, c, g, or t
  misc_feature (87)..(87): n is a, c, g, or t
  misc_feature (89)..(89): n is a, c, g, or t
  misc_feature (102)..(102): n is a, c, g, or t
  misc_feature (105)..(105): n is a, c, g, or t
  misc_feature (108)..(108): n is a, c, g, or t
  misc_feature (110)..(110): n is a, c, g, or t
  misc_feature (112)..(112): n is a, c, g, or t
  misc_feature (115)..(116): n is a, c, g, or t
  misc_feature (118)..(118): n is a, c, g, or t
cttgcctgngagcctgacaaagggaggagacacagaaggaaccggcgacagtngtctcagggccnctccggggggcctcaacaaccngngcacccccggagnctnccncngnccnncnccccacacgacgaggccg

SEQ ID NO: 637243 - DNA, 262 bp, Homo sapiens
  misc_feature (183)..(183): n is a, c, g, or t
  misc_feature (196)..(196): n is a, c, g, or t
  misc_feature (211)..(212): n is a, c, g, or t
  misc_feature (262)..(262): n is a, c, g, or t
acgagttgtccgagttatgaatatggaatgaagggataaattcctgatgtctccatttatctcctctgtgtaaaatacttcatggcaaagttgctggtatttaaagtaatgagtatgatcttggccccgatctaaatcttttgatcttgaaagaaggatggagtatcaataaagagagggcangacagattttctntaaagaaatgtgatnnagttaaagggatggtcaagacccagcaagtaactcggacaactcgtcgan

SEQ ID NO: 637244 - DNA, 129 bp, Homo sapiens
acagctccatagtgcctcatactacattgatattatactagcgatttaccatgctcatgtctaggaatactagtatatcgctcaaacctagatattctccgctattatgcctagaagaataatactatt

SEQ ID NO: 637245 - DNA, 518 bp, Homo sapiens
  misc_feature (323)..(323): n is a, c, g, or t
atatgtgcccgtatacgaggatatatctggtaactatggtgccatcgctcagacttgggacgaccctagggcacaatgataaacatactggccgtcgtgttaaacatgacccaattgatgtgtgtaaaataggaagcaaggtatgtgcaagagataaaataattggcgtgaaagttctaggcatattggctatgattgacgaaggggaaaccgactggaaagtcattgccattaatgtggatgatcctgatgcagccaattataatgatatcaatgatgtcaaacggttgaaacctggctacttagaagctactgtggactgntttagaaggtataaggttcctgatggaaaaccagaaaatgagtttgcgtttaatgcagaatttaaagataaggacttggccattgatataattaaaagcactcatgaccattggaaagcattagtgactaagaaaacgactggaaaaggaatcagttgcatgaatacaactttgtctgagagccccttcaagtgt

SEQ ID NO: 637246 - DNA, 113 bp, Homo sapiens
agtagcacgacctcatttctacaaacaaaaaaaacatgggcttgggagtgaaatattaataacattctccctctctctcctttggccggtgtctccaaccatatcaatacatg

SEQ ID NO: 637247 - DNA, 342 bp, Homo sapiens
cagacacgagaagtggacccgagacactgaggactgactatctcaccacaggatggaactctccaggctacctgtcacccactgtgagcattaagacccaactcagtggggagcacacataccgcctgggaccttcagtgtacagctacatagaatcctttgcatctttacttccacacttaggaggcggcaatgtctactaaagtggaattaatatacacactagactagaatatgacccaacacatttcacagggacacgggaagcatgcttctgtatgtaacaaaatgaagggcaaaatgccgccgcacaattgactgctaccggtcgaaaggaaatcc

SEQ ID NO: 637248 - DNA, 914 bp, Homo sapiens
gatctgactctggcactgtgaatatacatattcgatccatttgaaagggcctgtgcccttatactctacactcattcttaagcattttcgcaatacgtgacatccacggactaatcttgctgaactgtaaatatttaaagcaagactaatgtatgttttgtatcaacgctaaatgagtcataagttctaagaaagtatgcattgtcaatcttgtcagtagattgttgaagctatgattataatagcatcgcatagtgacatgtacgatactgtatatacgccggatataacggggtatagcagttgtgtgccatcttattttatgacatttgacacctgtgaagtgtgacactaactgttgttcggagaaccgtgtcttatggaccgaataccctgctcagcatttagtcaatcttgtgcctcacatactgtttgatgtctaagtttgcctcagtgggtcgagaaaaatgcccagtgaggatgtcctgtccgctaaagagatgatgctgtgctatcactgtgatatgtgcaccagtaactactggcatcgaaatgtgaggcctggtgctgcttgcttctaccgtcccgtcagcaccctttaacgccctacagtatcgctggtgtgtcgggcccaagttgctggccactttccctggcagtgtacggcaacactggggcagcaattacggcgccggactaggagggcgaaacgtggaagggactctggcgaaccctggagacacgcgtcagttttccctgcaacgggctactcggtggccaagacaagctgggggggtaaaatggccgaaagggctgcgggcccagagaacacacgtgttgacactacagggggatagaacataggggcgacacataaaaataggttcttctgaccgtcatcaccctctcctgaa

SEQ ID NO: 637249 - DNA, 1309 bp, Homo sapiens
taacaggcagcacttttatttttccttacacaaggacgtgtggctgggggcctaaggtcctcacataacagtaaaaaaccaaaatttgtggtgggtcatctcttctttcaaaaaatctcgaaaattggcgttacaaaaaaaacctttacatataaatttaaaaatgtgaattacattttacgggggataaatgtgcaaacgggtttccaactctcaagagccaagtataacgagccccagcgggtggtcgcggggccaagagaacactcgagcataagaaagaggaacagcggggctccatagcgggcgtgggaactttctccaaccgcgtggacgagaacccgacaagaacaaacacaaagcgtgggtctctgtggcccgagctctctctctgagaagaaatattcccgaggaacacaactctcgagccccgtgagacaacgtgttaattacccagaggggaacaagagtttacacttctcaaatacagaggctccaaaaactcaggcacaacaagttcccatacaaaatctccgaggggcgtggcattattcagaattcacagagccttttcagagggggaccaatttctctttatcgcgcagagggcttatatctcccagtttcgcggtgagaggcctagccagtagagaggggcgggcgtgcgatttttggcccacgggggggccaaacatttcccatatttctctctacaaatatataaacgcccatgtggcaagggacaaaaggcgcgataagcgcatatcctgggcgagtggaagctccggggtttaaaaaaacgcatttgggcggggagggagcacagaaagagagaggggggggccccgagacactcagggtgaagaaacacacccatgggcgagtggggaaaacctcccacaaatctcgggcgtggaggaacggggttggggaccacgttgaggggcccaaggagatgtgtgggcagcccacccgggagtcacaaacacccgagaagaacactgggcgagccccgggggagagaggacgcgaaacaaacccctgagaaccctacccgagggcggcgtaggaggagcccagagaggggaggaaaaacacccgattagggaagaacccctgattcggagcaaaatggcccggaggaaaccactgacgggggagttgccgcgcccagaaaaaaacccgggattggggggcacacagggactatgagggggaaggtatcaacggatacaacccccatgaggaggaacgcaaaggaggctccccaggaatgtgcccacagaaacaaacccggcagagaaagagt

SEQ ID NO: 637250 - DNA, 350 bp, Homo sapiens
gcttatgttactccacaaacaggtggaaaggatatcacagacgaagtgattacagacattgccggggtaataccagctgagaaaatgatggagtattgctgcctgtcagagtggctctattagacaaactagaaagctgtggtcacggatttactagcatgagggtcatgcagcaactcagctcgtcaatcaactccaagatgtggtggtagaaacataacttatctgatcaacaggaagtctatcatcaacaggcaaaaaacttgcccgaagttgacaaaatgcctcagcagatggagcttttatgacatgtgccactcatcagcctttgtgcaacctgtgattgccag

SEQ ID NO: 637251 - DNA, 163 bp, Homo sapiens
cactgggcaggaactggagacctccatggccaggtaagaattcagatctcttagggggatggagaacacagagtatgaggtgcggcagaggtctcagcttaggagtaacccgtaactggtgtgaggacctcttaaaactccatgacctgtgtagaattcaaat

SEQ ID NO: 637252 - DNA, 157 bp, Homo sapiens
gactctagatgatcccgatttggtgggacacgggcggaaagctgttgctatgtgcaactctgtacctgcagcatggagaccacctgctcacactcttctcctggcgagggagcgagcccccaaatgttccacactgtgtccccgtggtcccacctct

SEQ ID NO: 637253 - DNA, 309 bp, Homo sapiens
tgacagattctcagatcacggcagcacctcttctgtacagcattctcagcatcacggcacgccaccctcttctgtgacgagattcctcagatcacaggtcatgcacccctcttgcgtgtgacgggctttcctcagctaccacagatgacatcagccgtcttcctgtcaccgacgtgtactcgggatccacaggtcaggtcagccctcttgctgtcaccagactttcctcagtatccacaggtgacaccacgcctcttcctgtcactagcccttcctcagcatccacaggtcacgtcacccctcttcctg

SEQ ID NO: 637254 - DNA, 280 bp, Homo sapiens
cggacgccaggaatgttttttttttagtaaaggcagcctcccctcgggcagttcctgcaggttcctcaccctccggggtgagcctggctttaggaccttaaaaacttttgaaggacccagccctggttagccaagggcaaccccccaaaaagccaggatttaaacggtggtcaaccaggccccttgggcctccggacaaacttgggggttaggggaaacagggcctcttgggatttactttgtggctttcagggcccataaaaccctgtgatgattagga

SEQ ID NO: 637255 - DNA, 102 bp, Homo sapiens
gatactaccagaattgctcgctacactactccgtgaggatgctactcccgagcccggagtaggacccacgcgtgacccgggccaggtacttcattcgtagat

SEQ ID NO: 637256 - DNA, 276 bp, Homo sapiens
  misc_feature (159)..(159): n is a, c, g, or t
tgattagaggatccctgtaacatctatgccacctcaggaacactccgacagtcttgaaatacccccatgttgccttgttgttttttccttctggcttcttctattacagtctcttcattggaagctctgtaggccaagtgcatgagctgatactgacancggagccacatgcagcatagcacatcatgatgctagagggtcgctgggagcgattaacgggacttaatcgtgctagtgaacaccctgtacttgacagtggaggaggctagtggggcc

SEQ ID NO: 637257 - DNA, 388 bp, Homo sapiens
taatgttcctccatacagttaaaacatcctaacttgtttttcaagctcactccagcctacgccaaacgtttccgttttttttaaccatgaggtttaatttatttttgtgataggagggatatttacatattttagtggacccccttttaagtgggatggcgggccctaaacttccgcaaaccctgtgccccttttcccccgatttttcttcgcggggtccctactcccccttctcctcgcgtttttatcccggcgtcttttttcgactccccctttgctttcccctccctaatcccgcctcctctctcccccttttttacattgccctgttccaaaaatgtattttgatttgtatttccgaacctcaatcttacaatgttgaaagaaa

SEQ ID NO: 637258 - DNA, 250 bp, Homo sapiens
ctctagagagatcccctcaccgagaggatgagagaaatatggagtacacgatgcttgcttggtaattagtagtcaaaacactacacacacccacacacacacactatataaggcagcccaaaggtctgtggcagaaaacactgcaaatgactcagtgatacactacatttgctattctctcatttataccaaaaaagaaacaagtttccagctgtgttttcaacaaatatacaacaaaagaaaaaaggga

SEQ ID NO: 637259 - DNA, 610 bp, Homo sapiens
  misc_feature (421)..(421): n is a, c, g, or t
  misc_feature (442)..(442): n is a, c, g, or t
  misc_feature (452)..(452): n is a, c, g, or t
tacatcaagaactcacaaaataatagcacctgcgaattatggagcgcccgtgtaagggtatattcggaaacctatcgattacacagttcctgggactattgttgggccatgggtgtgtcaagcagtggaaaataaccagcgctgcaaggaaactggcacaacgtgtcgatgacacaaattcactccatacatcaggaaacccgcgcaaggtccttccccagtgtcaaggccaggggaacacacttgtggcacgcgaactacgtcctttatacaacacccttggaaaccgtgttaaaagcccccacaaacgagttaccttaatggaactactagttgacccatgttccttgctaagtggcttgtgggaacagtcaacgcaataagttaccaagggccatgtggaccatagacaatttctctntcaagattccacgcagcaccnacgaggcacnacaacgtagctggcgacaaggtacagtggcgcacggcacatgtgcgcacagtcagcagacaaacaccatgtgtggtcaagcaaggtaagtcattgtgggcaatttccccaaattgtgcattgttgccttaacaactcttttcaggccaaacccaaaca

SEQ ID NO: 637260 - DNA, 387 bp, Homo sapiens
ccaaactcagccaggtggttcgaaagacttcaagcaattgcacatgaacttcatgaaatgggttttgctcaaggatcactctttggaggggcggtatttccagaattacagttatggaggtgtgattcaggatgaccatattccatttttaaaaaaaggtgttccagttctgcatttgaaaccgtctcctttccctgaagtttggcaccccatggatgccaatgaagaaaatttggatgaatcccccattgccaatttaaacaaaatcctccaagtctttgtgttggaaaatcttcatttgtaaaactctgatttagtttaggaaaattggttttaaaattgaattcaaaagtcaaggcctcctttaaaataatttgatttccccca

SEQ ID NO: 637261 - DNA, 281 bp, Homo sapiens
accccaaaagtcaaacagggccttccccctacatacaatatgtttcagatcttcaaaagtttgtgcataatccacatgccattacaagaagtagatgaaatgttaatcgcacaggtgaaaataaaagggatgtactttctctgtttttagaccaggacattgaaaacatgaaaaactctgctgtccaaagtatggtccataatcttatagtaacagtttatcaatagggacttcaggaagttactctttttgatttttttttttctattccttctatgggg

SEQ ID NO: 637262 - DNA, 275 bp, Homo sapiens
gggctaattaatttgctttaaccattttcttttcctttccttttttcctttttgggggcctcccatgctggtgctgggtctttatgaatgttttaccccttttcatggtggaagaattttatatttaggcggttggcccattttttttttttctgcaagaaaaagtgtaatgtttgaaataaaccccggtccccttgtttgaaaataaatctttattttggcctttttaaaaagcaatgcggtcccccataggctggtgttaaatgttgtctccg

SEQ ID NO: 637263 - DNA, 441 bp, Homo sapiens
ccggtgctacggacgcgcttcatggagttcttcgacactgagcaaggaagagcgcgcccaggtgtggggcatgacctttgccctggacgacggcaaaaacagcgacagcccgctggcgcacctgcaaagcgagttcgcgggcttggagcagcgtctcaacgaacgcctggtcgagcgcttgcagctggaacgcgacccggcacgacgcgacctgatctacggcttcccgcagcagttcggcgcgctgaaagattgcctgcaaagcttcctcgaaggcgtgttcaaacccaacgcttttgaagagcgcgtgttgctgcgtggcgtgtacttcaccagcggcacccaggaaggcagcccgattgaccgcctgatcggtgccatggcccagagtatgaacctggaccgccagcacctggcgcgccagagcggcaccgggcgcag

SEQ ID NO: 637264 - DNA, 1598 bp, Homo sapiens
ggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgta

SEQ ID NO: 637265 - DNA, 694 bp, Homo sapiens
  misc_feature (24)..(25): n is a, c, g, or t
  misc_feature (231)..(231): n is a, c, g, or t
  misc_feature (316)..(316): n is a, c, g, or t
  misc_feature (373)..(373): n is a, c, g, or t
  misc_feature (466)..(466): n is a, c, g, or t
  misc_feature (484)..(484): n is a, c, g, or t
  misc_feature (568)..(568): n is a, c, g, or t
  misc_feature (595)..(595): n is a, c, g, or t
  misc_feature (627)..(627): n is a, c, g, or t
tgtgtaaatgtattgctaagaacnnaggcctgttaggatttttgcaagaattagacagatgcctaagagggaaccgaagtttcatcatgatgagatgtttgagggggctgggaggtcaatgaatgcgttgttgataatttttattagtgggtgtgattttcggatgttggtcattaaggttcttgtagttgaagtacaacgatgatttttcatgtcattggtcgtggttanattccatgtgagaataatgacaatatatattgcatttattttaagtactatttttgttattgggtttgttggtttttcttctaanccctctcctatttatggtggacttgggttgattgtaagtggtggagttggttgtggnattgtattgaattttggtgggtcttttttaggtttaatggtgtttttgatttatttggggggtatgttggtggtttttggttatactactgcnatggctactgagatgtancctgaggtttgagtttctaataagactgtttttggagcatttgtttctggtttaataatggagttttgtatggtttattatgcnttgaaggaagaggaagtagaaattatntttaagtttaatgggcttggggattgagtaantttatgatacgtgatactctcgcggtgtgtacctcgagaagctataagaccgcttccctgaataaca

SEQ ID NO: 637266 - DNA, 222 bp, Homo sapiens
  misc_feature (25)..(25): n is a, c, g, or t
  misc_feature (48)..(48): n is a, c, g, or t
  misc_feature (105)..(105): n is a, c, g, or t
  misc_feature (133)..(133): n is a, c, g, or t
  misc_feature (197)..(197): n is a, c, g, or t
aaggcacagggtagcaatcctcaantagcccagagaatcccagaggantatagttttagggaaggaggatcactatggaatttgtggcggtaagattaattacantggaggttagtagctcatagtagcacangagctgctaggaagatgcaccgcattagcatttgtagcaaaggcaatagcagcagcttgctgcnggcggctgcctagtaagttattggc

SEQ ID NO: 637267 - DNA, 278 bp, Homo sapiens
gtccccaggttttggtatgttgtgtttctactttcttcttcttttttttttcttctttgagacagagtctagctctgttgcccaggcttgagtgcagtggcacgatttcggcttattgcaacctttgcctcccaggctttggaggctgaggcatgcgacgcttgaacccaggaggcggaggttgcagtgatccaagatcgccccactgcactccagcctggaagaccaaacgagactttgtatcaaaaaataataataattaataaagttttactgga

SEQ ID NO: 637268 - DNA, 1795 bp, Homo sapiens
ggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgtattttcagaggaaaaaaaacacacccacaaaatccaaaaaaaacaccgcgggcacaataactgccgggggggcgcaccaaaaggttctgacacacgggccgctgggctcacggctgtgccgggcacccgttttgtgccaaggggggaatcggggggcacccaaagggagcggcaaaattcggaaacgcggtacggtag

SEQ ID NO: 637269 - DNA, 697 bp, Homo sapiens
  misc_feature (24)..(25): n is a, c, g, or t
  misc_feature (231)..(231): n is a, c, g, or t
  misc_feature (316)..(316): n is a, c, g, or t
  misc_feature (373)..(373): n is a, c, g, or t
  misc_feature (466)..(466): n is a, c, g, or t
  misc_feature (484)..(484): n is a, c, g, or t
  misc_feature (568)..(568): n is a, c, g, or t
  misc_feature (595)..(595): n is a, c, g, or t
  misc_feature (627)..(627): n is a, c, g, or t
  misc_feature (656)..(657): n is a, c, g, or t
tgtgtaaatgtattgctaagaacnnaggcctgttaggatttttgcaagaattagacagatgcctaagagggaaccgaagtttcatcatgatgagatgtttgagggggctgggaggtcaatgaatgcgttgttgataatttttattagtgggtgtgattttcggatgttggtcattaaggttcttgtagttgaagtacaacgatgatttttcatgtcattggtcgtggttanattccatgtgagaataatgacaatatatattgcatttattttaagtactatttttgttattgggtttgttggtttttcttctaanccctctcctatttatggtggacttgggttgattgtaagtggtggagttggttgtggnattgtattgaattttggtgggtcttttttaggtttaatggtgtttttgatttatttggggggtatgttggtggtttttggttatactactgcnatggctactgagatgtancctgaggtttgagtttctaataagactgtttttggagcatttgtttctggtttaataatggagttttgtatggtttattatgcnttgaaggaagaggaagtagaaattatntttaagtttaatgggcttggggattgagtaantttatgatacgtgattcagggttttttanngtgaggcgtaattaggtgttcgggatcctctagatcgccc

SEQ ID NO: 637270 - DNA, 300 bp, Homo sapiens
gtaacacaaaaaagaggctacgctagcctcctcgaattaactcatatattttaaacctttctatgacttcagttatcgtattcattaagtattcagggtccacgccaacaccaccaagctagccctgatacctctatttatatttgccacggcatgtcccaagaaagaacagattttgaacacggactaaccccgtctctggtagctttggcttttccagttcttagtctaacaatgttttgggatatagaatccaactagtaatcccgagtaataagacctgtatgccccaaattgatg

SEQ ID NO: 637271 - DNA, 1589 bp, Homo sapiens
gtcctcctcgcacactcgaggccagggggcgggagggccgcagctccggcgccgccgcgtcccgccaggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgta

SEQ ID NO: 637272 - DNA, 485 bp, Homo sapiens
  misc_feature (254)..(254): n is a, c, g, or t
  misc_feature (272)..(272): n is a, c, g, or t
  misc_feature (356)..(356): n is a, c, g, or t
  misc_feature (383)..(383): n is a, c, g, or t
  misc_feature (415)..(415): n is a, c, g, or t
  misc_feature (444)..(445): n is a, c, g, or t
gccccaaattttgatgtctaatccaatgttatagcgtttcatgaaataggtgacccctcttactaattttcacagcttatatgtaatggcttttaacaacaaataatgtaatatattgttttcgataatggagatttcaggagagattgcagtcaactgctagaatagattgtggtggtctttagtttttaagggatctttttttcttaatttatttggggggtatgttggtggtttttggttatactactgcnatggctactgagatgtancctgaggtttgagtttctaataagactgtttttggagcatttgtttctggtttaataatggagttttgtatggtttattatgcnttgaaggaagaggaagtagaaattatntttaagtttaatgggcttggggattgagtaantttatgatacgtgattcagggttttttanngtgaggcgtaattaggtgttcgggatcctctagatcgccc

SEQ ID NO: 637273 - DNA, 462 bp, Homo sapiens
ctccatttctggaggcatatctattcaggtagggcatcttgacaagaggagcaaggtcaaccacgacgatcttatatctcctgcagtgcactggccaagtgtgtgtgtatcgctatgcttgaagcccctagggtatctcaacatgccaaatcacaaaggggttccatttgtggactagcaacattgcccccaagcaagactgtcatccagtccctaaaagacttgaagcctggccatagctttggactacctcatggatcaaagtccttacaggcatctagttaccagaatagaaaggtttcatccatatcgaacataagttctggcaagtgattatcctccagactcagcttatctagagttacccaaaattcttccgctgactttacatcagcactcacaaactacacacttacccattatgtcatgcataacgatccttgcattgtctacaccacccag

SEQ ID NO: 637274 - DNA, 1524 bp, Homo sapiens
gggggggtgggagagctccactcgttggaggtaatggtgccggccgtgccctccaaggctccgcttggaggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgta

SEQ ID NO: 637275 - DNA, 1631 bp, Homo sapiens
ggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaagacaggtgctgagctaggcacctgtggtagagaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgta

SEQ ID NO: 637276 - DNA, 86 bp, Homo sapiens
atctcctgaagctgcgaggcggtgttgcagttagatgaactgacacaccacacaccactgcactccagcctggagacagggtgacc

SEQ ID NO: 637277 - DNA, 234 bp, Homo sapiens
  misc_feature (1)..(1): n is a, c, g, or t
ngactctagtggatcccctgagctatcgcccaacacaaaaatggtcaaataaatatttaaaataacaataaggccgggtgcagtggctcatgcctgtatacaatcccagcattttgggaggccaaggcgtgcagatcacttgaggccaggagttcaagaccagcctagccaacatggtgaaaccccgtttctactaaaaataccgaaaaattagccgggtgttggggataacat

SEQ ID NO: 637278 - DNA, 1468 bp, Homo sapiens
ggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaagtttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgta

SEQ ID NO: 637279 - DNA, 806 bp, Homo sapiens
ggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccaggggggcagccccctgaagtgccaagagagctgagaggagcagttgtgactctacccaggaacaaactgtgcctgaacctgaggtgcccaaccccaaataaacccaagatgctgtgta

SEQ ID NO: 637280 - DNA, 376 bp, Homo sapiens
aacttgaccgatttccacatgtggtacctaagggtcagagaggctaagtaacttgcccagggtcacacaggaagcagatagtgttgaggcacattagactcagggttgcatgacattagaatcttatcttctcaactgctttcctattttgcaagaaaataaagttgccttgactagtagaaagatttgctaacattcaggcaaagctggagaaatgggcttggtatgtgcaatccaacgtccatagatagacaatcagacagacagtgcttagcacaactatccacagatgtacttagatatatgggtagagagatgcatgatgggtagatggatagaaagattcaatgctttgcacagtgagttatctttgaca

SEQ ID NO: 637281 - DNA, 395 bp, Homo sapiens
caagcacgctagacatctaggtttagtgtgaaatctctctgttaatataggagacttaatagtaaaacattttcaaaatacgtcagtgagctgccagttttcaatttctgcttctgaatagccttaggaagacctctgtcacctatttttttttttattttatggagatggagtttcgctctggtggcccaggcgggagtgcagtggcgcaatctcggctcactgcaacctctgcctctcaggctcaagcaattctcccgcctcagcctctggagtagctgggattaccagcacccaccaccacgcttggctaattggtgtattttaagtagagacagggtttggccgtgtgggccaggcttctctcgaactcctgacctcaggagatccacccg

SEQ ID NO: 637282 - DNA, 856 bp, Homo sapiens
  misc_feature (13)..(13): n is a, c, g, or t
  misc_feature (105)..(105): n is a, c, g, or t
  misc_feature (110)..(110): n is a, c, g, or t
  misc_feature (112)..(113): n is a, c, g, or t
  misc_feature (148)..(148): n is a, c, g, or t
  misc_feature (212)..(212): n is a, c, g, or t
tgaagcatgggcncatgagtgggagctggggccgaggctgcggttcgctgctgctgtgcgccgcgctgctggcgggggctgcgcctgggcctgcgcctgggccgnggcangnngcggcggaccgatgcgctcatctggctctgctacnacgcgctggtgcacttcgcgctggaaggccctttgtctacttgtctttagtagaaacgttgcanattccgatggcttgattgcttctttatggaaagaatatggcaaagctgatgcaagatgggtttattttgatccaaccattgtgtctgttggaaattcgtgaccgtcgccctggcatgggtctctggactaattgttcctcatttatggcatagtcaaagaaaaatattaccggcatttcctgcagatcaccctgtgccgtgtagcgagctgtatggctgcgtggatgaccttcctcccagagtggctcaccgagaagtcccctaacctcaacaccagcgaacatggcttggtcctgttggcttttagcgtgtatttggctcaacggggcgtgtgggctcctgatcccagggactgctactgtgggcagtcatggataggaactctaagaagaactgcatcgaggaaagaaagccagttctagtgaagaagttaacagtggaacgtttctagaaacgatttaggcaccattatctaggttcatgaacccagaattgaattccaatctttttctgtttggccaacggtgtgaatacattccagttctacactttgtttttgtatttgttgtcctgaaacaactgtttcaaattggttttaaggggacagttttcggagtattgttgtcagttaaatgggaattaag

SEQ ID NO: 637283 - DNA, 438 bp, Homo sapiens
gttctcctttgggcccttggtcaataactgccatagaatttcgctttgtgtttctataggtagctgctcacggttcagtaaaaatactgctgctatcaagtatgcaaatatggaagtatgatggtttgactatatggcagtgttgtagcagcctctcggtttttcctctttcctccttttttttaaacctataaagtcacttttaagtcttcaatgatgagagcaatattaagaagacgttgctatctaatttttaatctttttaaataaaaagttcctgtgttcagtagcatggttaatgctattgtttagcctcccttttaaactgtacactggcttggaatgttcacagtttcgcgtgtgtggcagcagaagataaccccacattctacattgctactgttttgtatgaaataaattgataaagattgacactaa

SEQ ID NO: 637284 - DNA, 195 bp, Homo sapiens
agcaaggaagcggcgcttgggccctgcaagggtaaggggaaaccttctcttaaccacacacccccccggcttattggcccttcagggcgcggccgatgcggatttttttcttccccaccgggcgggtttacaacccaaaagcaaaattcgtttgggaaaatttacaagattttaatcgccgggggggcccccccc

SEQ ID NO: 637285 - DNA, 607 bp, Homo sapiens
ccgtcatggcgaccttgctgctattaccctctggatgtggtggtgacctggacccgagaggactggggggatcccccgccccagtctctgggccctccttttcccgcctccggccaagcgtggcaggcacctacagcatctcctcctctttcacccgccagaacctggctctgccggtggccccttacacctgcgcggtcacacacatctctctggaggagccccttggggcccgcaccccggttgtcccccccgagcggagaacagccttgggagtcatctttgccagccagtctcttccttctttgcactgatgttcctggggcttcagagacggcaagcacctacaggacttgggctgcttcaggctgaacgctgggagaccacttcctgtgctgacacaccagagctcccctctccctgaagaccgccccgcgcgtgtaagcccgccccgcctgaccttaagcgacatgagactactagaaagaaacgacacccttcccccagcccccccagctactcccaccccaaccaccacccagcccgtttaatggtaggaatttgtattttttgcccttgttcagaaaacaagacccttggtaaatta

SEQ ID NO: 637286 - DNA, 107 bp, Homo sapiens
  misc_feature (66)..(66): n is a, c, g, or t
acttacaatcaccattttattataaagaatacaaatgattagccagacaaagaccacgccccctcngtttgctctgtttttttccagagctcaggagcctttgtcct

SEQ ID NO: 637287 - DNA, 495 bp, Homo sapiens
agactgtcgaccaggttggagtccagtggcacgatttcgactcagaataataataataataaagccacatcgctatctttttccagggcatggaatttaagtaacaactttaaaagttatcataacctgtattctattaggtatacatgtgacatttcataaatcataagtattgcctaatttaataaaggcatatctgaatacacaccgtgaacaagtaacagtaggtgagagaatataaatatataagaaatttcagacccagtgcagtggatcttgcttgtaattccagcactttgggagatcaagacaagaggattggttgagttcaccatgttgccccacctttagtagactctgtctctgcaactttgcaaaataattcagtggggtgtggtggtgcacacctctcatcccagctacttgggaggctgaaaccagaaggattgcttgagcccaggaggtcagggctgcagtgagccgtgtacatgccac

SEQ ID NO: 637288 - DNA, 304 bp, Homo sapiens
  misc_feature (41)..(41): n is a, c, g, or t
gtctatcagcaaatgaacagataaaatgtggtatatatacnccgtggaatactatttggccattaaaaaaacaaaattctgttattctcagcaacatgtatgatcttagaagacattatgttaagtaagccaggcacagaaagataaatactccatgtactgtacttatgtggaaggtaaaaaagatctcatagaagtagagagtggctcatgcctctaatctcggtgctttgggagtctaaggtgggaggatcacttgaggcctggagtttgagaccagcctgagcaacatctctcaaaatta

SEQ ID NO: 637289 - DNA, 341 bp, Homo sapiens
gagcatgaaaataaagataggtgtcccttccttgctgtcatctaacccagactgtctgcttgctctctggctgtctgctccctggaaaggcttaaggaggaccagccaggacagaataaccatgctgccatctgtacggaagctggatctcaatgcacagggacattgactgtggatggttgccgtctctgatgggaggtgacagatagaagtgactacgagctaagaggagcttctgggtgccttggaggcggtccgtcttgctgtgatcaagccaggacataggacatggagcttggctgtgagaggagcagattctgaggaggatgcaaggtccttct

SEQ ID NO: 637290 - DNA, 697 bp, Homo sapiens
ctttgcatgccaggctagcagcagatacctatagaagcagtaggcatgaaaggagagatctctaaccttaccacacacactcctttggatcctcttcattgcaaagcatgaagactaccacatcattaagggaatctgaattcttgggaacatggctgggaagaggcccatactaaaaggacagagctaggtgggggctttggatggtaaagggttcgggtttgccaaaaaataatctgaagtgttgcatggggccctgaggaccactgaaaaccatttcatgtcttatcactggtagttctctctgcccgttacggcatctgtgggccactttcctagcaacccaaaggatcgttatgaaaatatgtcctgtgtgtgatctggaacacacaactcgattagacaactatactcctctgttaaaggcagcctatgtggtcttacctcaggaatagcattgcccatcaacagccaggccttcttacccagagacagaaagtaattacacaatagtactgcatgttcttcttcatcccctgccaggagatcaagaaattgctgacatgtgctccagaggtcacaaataccaccgaatgagacagtgtcaggcaagaaggttatcaagggctacaatcgagccagttgtcctgaagtgtctgttttcttcgtcttggtgtctgagttggtaatgcgcgcg

SEQ ID NO: 637291 - DNA, 126 bp, Homo sapiens
  misc_feature (104)..(104): n is a, c, g, or t
cgcttgtggtcagttagaaaagtcttaacatcgttaaaagtgatagaacgccgttttgtagtcgtttctgcacccggcaaacgcaatgctgaagataccaaggntaactgatgccttgatcaaata

SEQ ID NO: 637292 - DNA, 868 bp, Homo sapiens
ataattattgaaccatagaccaaaacgggcctcaggttaagtttgtaatgtaggataaaggcaaagaaacatgaaaatccgagggggcttataataccttactctctgggacaacgatcagtctactggtccatatactcactcttgcacgccgtggctctattttagctaggtgtcaacaaagttcactgacttataaagggttctaaaatattttcgcttcgggtcgaaatggggggggcgtaaagtcaaagggactttctgattaaagaagtttagctttacctgtaatttaaattcacgtggctggttgcttggtgataagcggcggggaataagaattctcaagtgttgaacccctcgacaggcgcatgatagcggaagggcttatttgtaaagggactattctcatagcttgggcctggtgacatcaaaatttatccttagtggagattcatatcgttgaatattaaaccaaatattgtcaggacctattaaacagcccacatttttcaagggacagaatgtatcaaattgtccataaaaatgtccactgcagggattccatattaaataacgaccttgctcccaagttagcacataggcagttggaccctcaggaatagcattgcccatcaacagccaggccttcttacccagagacagaaagtaattacacaatagtactgcatgttcttcttcatcccctgccaggagatcaagaaattgctgacatgtgctccagaggtcacaaataccaccgaatgagacagtgtcaggcaagaaggttatcaagggctacaatcgagccagttgtcctgaagtgtctgttttcttcgtcttggtgtctgagttggtaatgcgcgcg

SEQ ID NO: 637293 - DNA, 1049 bp, Homo sapiens
  misc_feature (115)..(117): n is a, c, g, or t
  misc_feature (380)..(380): n is a, c, g, or t
  misc_feature (384)..(384): n is a, c, g, or t
  misc_feature (413)..(413): n is a, c, g, or t
tgagtaggttcggtctgaaaggtgtggcctttatatttagatccacacacgttggtcttttaaccgtgctgagcagaaacacaacaccaggttaagaagagccgggtggcagctnnnagaggaagccgctcaaataccttcacaataaatagtggcaatatatatatagtttaagaaggctctccatttggcatcgtattaatttatatgttatgttctaagcacagctctcttctcctattttcatcctgcaagcaactcaaaatatttacaaataaagtttacattgtagttattttcaaatctttgcttgataagtattcaagcaacatcattggcacttgctgccgtaatttaaagctctgttgattttgtttccngttnggatttttgggggaggggagcactgtgtntatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaaaaaaaaaaaaaaaacatgggggcccccttggcccaaggggtttttaacttgggcaagctttttccttgggccccaatttggggctacttggcccaattgcccttaaggggggcggtttaaaaataaatgggccgggttttaaaaagggcggacttggaaaaccctggggttaccccaattaaatgcctttggaaaaaatccccttttcccaagtgggggaaaaaccaaaaggcccccaccggatggcctttccaaaaatttgccaacccttaatgggcaatgggaatttgaagggcgaaaattttggtaaaaatccggggaaaattttggtaaaacccccctatttttaacccaaagggccgctgggcccctttttc

SEQ ID NO: 637294 - DNA, 594 bp, Homo sapiens
  misc_feature (123)..(123): n is a, c, g, or t
ttttctttaagaattttttcaaacctgtcttgtagctcagctgcagctgctttgtctgagcgctggtaaattagctcttcaggctgaacactggaaaggccaggatatggaaggcttcttganaagaaagatttccatagcttgggcctggtgacatcaaaatttatccttagtggagattcatatcgttgaatattaaaccaaatattgtcaggacctattaaacagcccacatttttcaagggacagaatgtatcaaattgtccataaaaatgtccactgcagggattccatattaaataacgaccttgctcccaagttagcacataggcagttggaccctcaggaatagcattgcccatcaacagccaggccttcttacccagagacagaaagtaattacacaatagtactgcatgttcttcttcatcccctgccaggagatcaagaaattgctgacatgtgctccagaggtcacaaataccaccgaatgagacagtgtcaggcaagaaggttatcaagggctacaatcgagccagttgtcctgaagtgtctgttttcttcgtcttggtgtctgagttggtaatgcgcgcg

SEQ ID NO: 637295 - DNA, 1066 bp, Homo sapiens
  misc_feature (5)..(5): n is a, c, g, or t
  misc_feature (277)..(278): n is a, c, g, or t
  misc_feature (280)..(280): n is a, c, g, or t
  misc_feature (284)..(285): n is a, c, g, or t
  misc_feature (291)..(292): n is a, c, g, or t
  misc_feature (946)..(946): n is a, c, g, or t
  misc_feature (948)..(948): n is a, c, g, or t
  misc_feature (954)..(954): n is a, c, g, or t
  misc_feature (956)..(957): n is a, c, g, or t
  misc_feature (963)..(963): n is a, c, g, or t
actcnctcatgtgtacctcgatctctaagtgcagtggcattcctatatgcttaccgaacaaaagatgctgaggtcatattcaactacggcagcaggccccagacgttggacgcccctacgggctactacatccctgcgctgacgccttaaaactctttaccaatagtagctccctaaaacccgccacatctaccatgaccctgtacatcaccgtccccaccttagctctcaccatagctctgctactatgaacccccctgcccatacccaaccccanngncacnngaaccnnggcctcctatttattctagccacctctagcctagccgtttactcaatcctctgatcagggtgagcatcaaactcaaactacgccctgatcggcgcactgcgagcagtagcccaaacaatctcatatgaagtcaccctagccatcattctactatcaacattactaataagtggctcctttaacctctccacccttatcacaacacaagaacacctctgattactcctgccatcatgacccttggccataatatgatttatctccacactagcagagaccaaccgaacccccttcgaccttgccgaaggggagtccgaactagtctcaggcttcaacatcgaatacgccgcaggccccttcgccctattcttcatagccgaatacacaaacattattataataaagaccctcaccactacaatcttcctaggaacaacatatgacgcactctcccctgaactctacacaagcatattttgtcagcaagaccctacttctaacctccctgttcttatgaattcgaacagcatacccccgattcgcgtacgaccaactcatacacctcctatgaaaaaacttcctaccactcaccctagcattacttatatgatatgtctccatacccattacaatctccaggcattccccctcaancnctaaanannaaaaanagaggggggggccccctttatagtacaggagggacacctaacaggggtcataacagcgcgttagaacaagtggccgcgccatctgacacccaaggggggtata

SEQ ID NO: 637296 - DNA, 1075 bp, Homo sapiens
  misc_feature (115)..(117): n is a, c, g, or t
  misc_feature (406)..(406): n is a, c, g, or t
  misc_feature (410)..(410): n is a, c, g, or t
  misc_feature (439)..(439): n is a, c, g, or t
tgagtaggttcggtctgaaaggtgtggcctttatatttagatccacacacgttggtcttttaaccgtgctgagcagaaacacaacaccaggttaagaagagccgggtggcagctnnnagaggaagccgctcaaataccttcacaataaatagtggcaatatatatatagtttaagaaggctctccatttggcatcgtattaatttatatgttatgttctaagcacagctctcttctcctattttcatcctgcaagcaactcaaaatatttacaaataaagtttacattgtagttattttcaaatctttgctttaaattacggcagcaagtccaatatttcttaatacttatcaagcaaagatttgacttgctgccgtaatttaaagctctgttgattttgtttccngttnggatttttgggggaggggagcactgtgtntatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagagaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaaaaaaaaaaaaaaaacatgggggcccccttggcccaaggggtttttaacttgggcaagctttttccttgggccccaatttggggctacttggcccaattgcccttaaggggggcggtttaaaaataaatgggccgggttttaaaaagggcggacttggaaaaccctggggttaccccaattaaatgcctttggaaaaaatccccttttcccaagtgggggaaaaaccaaaaggcccccaccggatggcctttccaaaaatttgccaacccttaatgggcaatgggaatttgaagggcgaaaattttggtaaaaatccggggaaaattttggtaaaacccccctatttttaacccaaagggccgctgggcccctttttc

SEQ ID NO: 637297 - DNA, 547 bp, Homo sapiens
ctagctcaaaacccgggttacaaaaattagctgggtgtggtggtgggagcctctagtcccagctactcgggaggctgaggcgggagaatcacttgaacccaggagaggcggggttgcagtgagccgagatcgcaccattgcactccagcccaggcaacagtgcaagactcagtctcaaaaagataataataattaaatcaacaaaaaaggtaaatccataatgtaattaaaatctaccctttattaggctgggcgcagtggctcatgcttgtaatcccagcactttgggaggccgaagcgggtggatcatgagttcaggagatcgggaccatcctggctagcgcggtgaagccctgtctctactgaaaatacaaaaaaattagctgggcgtggtggtgagtgcctgtggtcccagctattatggaggctgaggcaggagaatggtgtgagcccgggagctgagcttgcagtgagccgagatcgcgccatgccctctagcctgggcaacagaccgagactctgtctaaaaacaacacccccaaaaaac

SEQ ID NO: 637298 - DNA, 371 bp, Homo sapiens
tctatgccgacggtacatcgtttccccagggaaccatgatacaaccggcatccacttcataacgacactgacacacttatactctggaaccacgttctgatgtaacccaagtgtcaagtaccagacacctttctaccaaggtggtctcataatctagaatgaaaggtccagggggtgacaaaatgaagcacagacaacacaatattcactcgtgtggagatatcctactcataactatgcactgtgctgtgatcctgcaacataactcgtcccaaaaccttgtcacgatcatcctgactttttaggttggctgatccatcaatcttgcaatcaactgtaacttctttcccagtgttgttagagcgtgctgt

SEQ ID NO: 637299 - DNA, 214 bp, Homo sapiens
aggcctgcccaatccagaggcctggacaactccagaggactgtccaactccgaggccaggtgtgctgtgagctgtagtcccagactacaaggtgggaggattgcttaggcctgggtgattgaagatgcaaatgagactgtgacttgtgccaccactactccagtcctgggacaactacagacaagtacttgtctcaataaacaaaaacaaaacc

SEQ ID NO: 637300 - DNA, 979 bp, Homo sapiens
ggagattgcgtggggagcttggttataaaatgtggacccgaatcccgggtgtccgaggaacttctgcttttgcggcctccccttcacacggtttgaagtgcaagtttcaggtccaagtaactgccctgactgagcctgcatgcagtaggggcggccggcagacgctaggcttaaactactagacaatctttctgctcccacccctttctctccacctccggcctgactgtcgctgggtcgccccgctagagtcgcttgttctgagagcttggatgcacttgccctccagttcccgcgaacttctgagtagctgctgagccgcgttgcctgcggagccctcagcttccacagcctccatcatgcgcgtgtgggtccccgtgggtgtcctgacctcgctggcttactgcttccaccagcggcgggtggccctggccgagcagcgggctcctaatggccagcgtccggtggaccgcaacctactggagctgaaaatggtgcaggtggtgtttcgacacggggcacggagtccgctcaagcctctcccgctggaggagcaggtggagtggaaccccaagcttttagagatcccacctcaaactcggtttgattacactgtcaccaatctagctgggggccgaaactcattctcattacgacactgaataccgaagacacttgaaggggtggcgtgctgctgggcaggtggacagtgggcatgcaacgatgtttgcctggagagaactgggagatacgtgggggtattccttctttaacagttaaaccccaaagtttattgtccccacagttcggactggatccctcggctgtgcgggattcccatccaaaggtgccgccatagagaagaggctgaatgtcccccaataggggcgaaaaaaacacactggcacgcccggagaaacaaaagccactactcagacacaggaaccgcctacttccgagataacatacacgtgtggct

SEQ ID NO: 637301 - DNA, 624 bp, Homo sapiens
  misc_feature (148)..(148): n is a, c, g, or t
  misc_feature (552)..(552): n is a, c, g, or t
aagcctgaagcgtccagaacataagagttattgcccccctaataatggaagcagaattatgggttaatggcccttaaggttgtgtgacaaaaatgcagggcaattctgcagtacccccccctaaaaagaaggggggattgtgataaanccaggtatctaggaatgaccagtaaaagggagcaggttggctccttgattccaacagagtaaatgaagtactggattggggaaaacctggttttattagaacatatggaatgaaagcctacacctagcattgcctacttagccccctgaattaacagagcccaattgagacaaacccctggcaacaggaaattcaagggagaaaaagtaagcaacttgggctaggatgagctgactcctttagagcaaaggagagccagcccccattaccaaataccatttttgcctggggcttgtgcagctggcagtgttcctgccccagcatggcaccttattgttttgatagcaacttcgttgaattttcaccaacttattacttgaaattataatatagcctgtccgttngctgtttccaggctgtgatatattttcctagtggtttgactttaaaaataaataaggtttaattttctcccc

SEQ ID NO: 637302 - DNA, 404 bp, Homo sapiens
  misc_feature (341)..(341): n is a, c, g, or t
tccccatttggcgaggcagtctcatttgggattggagacccctttgtggggttttgggagggcctggtcggcttgggggcttaggagatagctcatgaggcagactgttgggaggtattctcctagctgagagttagaagggggcctgttttgtaagaggaaagggcgtccgtatattaactcaaatggactgaggaaggagggtgcttttggactggctctaatgctctccagtgctatgggcaaaagggaggtccatggtttttggacttcaagagtgagtttggttaactgagccttaaggatcccatttaccctttcgacttttccggatgtctggngccagcatgggatatggagacgccactggatgccaagggactgagaaacctgttgagtgattt

SEQ ID NO: 637303 - DNA, 215 bp, Homo sapiens
ggggtttttaaaaggggggtttttaaaaacccggggcccccaaaaaattttaaggggccttttcctttttttaaacccctggggggggccaggatctttttttgtttaaaaaaaaatttttgggggggggggccccctttttttttttttaaaaaaaaaaagtttattttggggcccccggttttgggtttaaaaaaaaaaggggtttcccccca

SEQ ID NO: 637304 - DNA, 788 bp, Homo sapiens
  misc_feature (558)..(558): n is a, c, g, or t
ggctaggtacgaggccgggtgtgaatcggccgaggggaagcttgttctttgcaataaatcttgctactgcttactctttgggtccacattgcttttatgaagctataacactcaccgcgaaggtctgcagctacactcctgaagctagcgagaccatgagcccactgggaggaaaaaacaactccagacgcgctgccttaagagctgtaacactcaccgcgaaggtctgcagcttcactcctgagccagggagaccacgaacccaacagaaggaagaatctccgaacacatccggaacatcagaaggaacaaactccagtgcgccaccttaagagctggaacactcacccacggagggtccgcgggcgttcacttcctggaagtcacgtggaggaccacagaacccgacacattccacgagcacgttgttggcattgccactatgggacctgtgtcgcctagtcgcgcaagttggtggctgaccaatcgccgagcaagtgagagcactgtgcgcgcgtgatctgctgcacgccaagaattgtagcgtcgcagtcaggnctgacaggactcggtcctatacatcgtggacattcccacgtgtgaccgttcaacttaggcacactttactaccgagggtctcgcctggatcggacccgtcgtggcctcttcgccctgtgcctcgaagagttcgcctctggaggatacctggactacgagggccccgttcttcgtgtctatgccagggggaagtagtgcgagatggcatctgttcagcttcccaccagtag

SEQ ID NO: 637305 - DNA, 1789 bp, Homo sapiens
atgctgagactacataagtgtccttcaaataatgcagaagaaaaagatcataggcaggcaaaaattacttaataaattaagctttttaaagaagtgaaagaattatatccagaaccaacagctcttaaatattctatttcaataaaaacaatttctatacaattgcggtgaaacttatttttggcaaatactcttccgtaagttatgaacatttctcttgataaattttatactaggtatataagttcctttattggtgttttggatgacagcaaatgactttccataaggcagatgtagattttattcacacaacttttcaggagtagctttatgttaatatgttaggactgtccttccttgagctttacagttaaccaatgaaagtgagttattttagggaatggttagatttggacatggaccaaaattagttttctaatgagtggtgttaaagatgtgtaactactattacagagataatgtaaatggccttctactttttaattctctgattctgatcttgttttgtagtaagaaaggctcagtatgaatttgaggtacttaactaacttgttacagtggtggtcagtgaagaaagattctatcgggcaggactctctggaatgcatgtgtcagaagcccagcccaaattggcctcagcagaaaacaaaacatagcgaaaagcaaatgacaattcattggctaaagcaatggaaaaatacaaggatatctagcttgagactcagctagagccaaatattcaaatctggtcatccaacattgattggtctctttcaatttacttagctgtgctaaacactgttggcttggttttggggcacgttcttctcaaacatggtgaaagtggcccctagcaccgccaagattgatcctgtcacagcccagcaatcccagtggttgcttaaaagcaagtccttttcttgataattctagcaaaaatcatagggaggtcacccattggcccagtttagggcatgtgccatcccttaaccaatcagcaatctgattagccaggcctgaggcacgtcttcatcactaaaactagtcgtgatagaatcaacttaagtggaaccctgttgagagaaggagaggagggatggcttccctagtggaaatgagctattaccaagagtggatgagggcgggcagaaacaagaggtgcacattacagggataccagggatttgagtctgcagtctctctgattttccatgagtgcttatcttcttgggggaggtgggggcggtgtgtgaacatccacacagcctcctgctcctcctcatctactggggcgctcagtcacccaggtttggaatgcttctgaggtgatacttaatgttacagttcatggtcaccgtgctccatgtacgtgaggtcatgtgtattgtgtattgtcactgtctctcttcccagttatttttttcagtcaggtgctagggaattctccttttcttactatgtcatggctgtcctccccactccatggggctttcagaaagacaggtagaacataagagtctagagagaccttgggtgtcacccaggccattgaggctccatctgggcttgaaagagccctcacctgcagtaaaggtgcctctgaggccaaggagaaattatggcataagaagggaacaccaaggagatgggggcccggacataccctctcccacctccttcagatttcattctttataaaatttcacataagggaagagtctccaaagtgtaaggagggccacaacaaaaaaaaacaaacaaggtt

SEQ ID NO: 637306 - DNA, 141 bp, Homo sapiens
  misc_feature (139)..(139): n is a, c, g, or t
ccaaaagtcagtgtgaggtctttcatttggcatttcaatctgcttttgggtcaaagaaaagtgtcagatttttcgccttctatgaaaagtatgttataaatgaaattcataatgaaatatttctatttcgccaggtgtngt

SEQ ID NO: 637307 - DNA, 111 bp, Homo sapiens
aactatcatcagagtgagcagacaacctacaggtttgttggctgcataaatgtctttcgtttgggttccttgtagattctggacattagacctttgtcagatggatagatt

SEQ ID NO: 637308 - DNA, 378 bp, Homo sapiens
  misc_feature (197)..(197): n is a, c, g, or t
  misc_feature (246)..(246): n is a, c, g, or t
  misc_feature (254)..(254): n is a, c, g, or t
  misc_feature (273)..(273): n is a, c, g, or t
  misc_feature (297)..(297): n is a, c, g, or t
atgctgctactctcactagatttgagatatgcatagtctctgcctgagtatgtggggatgcagtgtgacctagaggagggagatctgggaaaggctcaacgtggaactggtattcaaccagcaatagcatctctgagcaaatgaaggcagaagatgcaaacaaacgttaagttcagagtccgctgacattggaagcnagccaggtgaaaaccgttcacgtggatcttcaagggagtcaggcatttnttagagtngccatcagcatttcttctnttctggaatgtaaagtttccttcnctttgtatgtaactagggctctatctgtatccagagagggtgaaatgctttccaaattatagctatctctccctttctgca

SEQ ID NO: 637309 - DNA, 194 bp, Homo sapiens
  misc_feature (96)..(96): n is a, c, g, or t
  misc_feature (165)..(165): n is a, c, g, or t
ctcaaaaataaaaataaaaaagttgaaagttgagccaccgtgcccggccaaaatttgcataattttttttaaaacttttttttttttaagacaggntctcactgtcacccaggctgcagtgcagtggcacaatcacagctcaccatagcctcgacctccccaggntcaaatgatcttcccaaatagctgagacc

SEQ ID NO: 637310 - DNA, 172 bp, Homo sapiens
aaatatgcaatatagaatcaacctaagtatcatcaaccaacaaatggataggctgagcgcggtggctcacgcctgtaatccccatactttgggaggccgaggcagatggattgcttgaggtcaggagtttgagaccaacctggccaatatggtgaaaccccacggacatcgt

SEQ ID NO: 637311 - DNA, 159 bp, Homo sapiens
gcccagactcaaggctgactaaactggaggctgaataccgtggaggtccacatgcagcttccctggagggcaggccggagcttcccgcccctggcttgaggatgctgtacccctggcttcaggcctgccagatgatgccttaggctctgtccctggcgg

SEQ ID NO: 637312 - DNA, 208 bp, Homo sapiens
agcccgatgcctccctcacctgtgtccctgttgtcatgctcttatcacagccttcaacacccaaataagagaacgagaaaagggaggcccaggtagaatcttgtggttaaggttaaacctgcaaaaggtaagcctgcaatagaccgccctgttccaggctgcctttttttttttttttttttttttttttattttttttttttttttc

SEQ ID NO: 637313 - DNA, 167 bp, Homo sapiens
tccccttgcaattgggcacagaagttacagaaaaatttgtaaagggtcatgaacccagtgggatggcacccagacacggtgtagagctaacgacagctgcagcttgtaggacataattattgacacgtcttcagtggtgatgaccatagacgaggagactgacagta

SEQ ID NO: 637314 - DNA, 319 bp, Homo sapiens
aaccaaaatttttttgccaaatgggttcctttttttgatgaaggtgagccactggcccacaagggttagtttgggccttaaaactgccaaggagtttccaaggatttttaaggggatccctatttatggccaaaaaaaatttgccgctataatttggttttggcgggtccttttttgtggaaccttatttttgggggtttaaaaaaagccttgccctttttgtttgccatttttcagctaaacttttttggggaatggtatgggtccccttttgttaaaagttttttttgggggttttaataaagccctttttgtttta

SEQ ID NO: 637315 - DNA, 396 bp, Homo sapiens
tctgcaggttgagtatagagtaaaggcgagtgcgacctgtcaaaacagttctaagcacacagaacaaagctggaggcatcacactagctgacttcaaactgtactacaagcctacactagtcaaaacagcatggtactggtaccaaaacagaggtatagaccaatggaacagaacagaggcgtcagaaataacaccacacgtctacaaccacctgatctttgacaaacctgacaaaaacaggaaatggggaaaggattccctatttaataaatggtgctgggaaaactagctagccatatgtagaaacctgaaactggatcccttctttacaccttatataaaaattaattcaagatggattaaagacttaaatgttagacctaaaaccataaaaa

SEQ ID NO: 637316 - DNA, 135 bp, Homo sapiens
cttagccagaggaggtggacagcagcacagaggaggtggtcagcacagaggacggcaccagccagaacgcctgaacgctggcacatcttcctattctacaccctagtagtgctcccttcccctcctctgtgctgt

SEQ ID NO: 637317 - DNA, 294 bp, Homo sapiens
accaggacgataaccaaggctggcgtggtggctcatgctggtaatcccagcacttggggaggccaaggtggacagatcacctgaggtcaggggtttggagaccagcctgaccaacgtggtgaaaccatctctactaaaaatacaaaattagctgggtgtgggggtgcatgcctgtaatcccagctactggggaggctgaggcgggagaatcacttgaacctgagggggaggttgcagtaagccgggatggcacaatgcactccagacggggtgatggagaaactccatctcagg

SEQ ID NO: 637318 - DNA, 987 bp, Homo sapiens
  misc_feature (156)..(156): n is a, c, g, or t
  misc_feature (455)..(455): n is a, c, g, or t
gggcccagacgggctgcttggagatgcgccccggagaccgctgagttccggggtgaggacctgtctgacaggtagaacagcggctggagccggtcaagcgggcagaccacaataggactccgatcgaaggcggcgtgtcagtggcctgctctgcanggggccagaggcggggcgagacagtgtgacaagcgggtgaagaagcttccctctcactgggctctggtccacgcgagcgatgtgctgagatgcttcaagtgatctggacccgtgattccagacactggggaagggctatgtgagattgagctggttgccatccatggaatcacgtctgggccgcgcatctctggccagagtttgtagatgacgcctggaggagggacgtcctgaagccatctcaggctaggcgtgagtgaggaggatgctgccgagcctatccgtcagaagcatgaagnaaacagcctccagaagcgtcgtgtccgagctggtaagcgacgagcgtctaagagcaggcttccagtcgaggctaacctagaattcaggcagcagctcaaggccgtaggaggcagtcccgggtagtcactaggccatacgaccactggccaatcaaggtggagacgctgaacggaaggaggcaggaaggagcgtgcatcgcacggacacatgtgcgtcgccatctggaccgttagcacatcctgtgtgatgccctgtacgatctcgttccctcaggagcaggcaactccctaatgccattggtaaacatgccttgtccagtgcctttctcgaggagcattcctcgaagggcgggttttactaagaacgcccctgggacaatctcggcgacatcagctgggaaagaatgagttgcgtaggctggatccatggagggagacgaaactcactgggcttgggacagaccacgttcccaactatcaggcattgaaggcccatccgctcattcccacaagggatggatatggggagagt

SEQ ID NO: 637319 - DNA, 112 bp, Homo sapiens
cccccccacaccccaccccccccccaggggggggggaaaaaaaaaaacccccaagccccccttttatatttgggtgacacccccaacatttattgtagggggggcccccttt

SEQ ID NO: 637320 - DNA, 740 bp, Homo sapiens
  misc_feature (731)..(732): n is a, c, g, or t
tgaacttgaaaaaaaaaaaaaaaaaattaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaccttgtggcccccttggccccagcggcttttaaattgggcaaattttttcattgggcccaaatttggggttaattggccaatttccccttaaggggggcggtttaaaaattaatggcccgggttttaaaaacgtgggactgggaaaaccctgggggtacccaatttaaacccctttgaaaaaaatccccttttgcccagttggggaaaaaccaaaaggccccaaccgattggcctttccaaaaattggccaaccctaaagggcaatggaaatttgaaggggtaaaattttggtaaaaatccgggtaaaattttggtaaaacaacctattttttaacccaatggcccaaattgggaaaaaccctttaaaatcaaaagaattaccccgaaaaaggtttgagggttgtccaatttggaaaaaagggcccatttttaaaaaccggggcttcaaccggaaagggcgaaaaaccgctttttagggccaaggcccaatttgggaacccttaccctataaaaggtttttgggggcaagggcccctaaaggccttaaattggcacccttaagggaaccccctgtttaccttgcgggggccgnnaccgttgc

SEQ ID NO: 637321 - DNA, 192 bp, Homo sapiens
agctacagacggggtttcaccctgttagccaggatggtctcgatctcctgacctcatgatccgcccgcctcggccccccaaagtgctgggattacaggcgtgagccaccgcgcccagcctacaaacaattttgaatctgttcctatttagaaacttttccaatgcaaatatcgctaggatacagtagggaga

SEQ ID NO: 637322 - DNA, 85 bp, Homo sapiens
tactgccttttttaaaaaaatatttgacagaaaccaggggccttcaaaggctctttgatttaaataaacctttcttgttttttta

SEQ ID NO: 637323 - DNA, 368 bp, Homo sapiens
  misc_feature (261)..(261): n is a, c, g, or t
agtgtacgaggtctaccgcaagggtctgattgaccaccagacgtacctggagttgtccgagcaggagtgcgagtgggaggagatcaccatctcctcctcggacggtgtggtcatgtccatgatcatcgaccgccgctccgggcgccagtacgacatcgatgatgtcatcgccaagaacctcatcgaccgctcggtactggaccagtaccgcgccggcacgctctccatcaccgagttcgccgacatgctctcgggcaacgncggtggtttccgctcccgttcctcctcgggtgggatcctcctcctcctaccccatcagccccgtcgtcttcaggaccagttggcctcctggtcagacccactgagga

SEQ ID NO: 637324 - DNA, 335 bp, Homo sapiens
  misc_feature (310)..(310): n is a, c, g, or t
cttcaaaattcatatattggaacttaaacattaaggcgatggtataagaagtggagcctttgggaggggttaggctatgaggactccatcctcatgaatgggattcatgcccttacaaaagagggcattcatgcattcacaaagattcattccttttgcccttttaacccctcactgtatgataacaatgttcctcccagcaagaggacaacaacaaagtttcatcttggaattagagagtaattccaagacaacaaatctgccagtgccttgatcttggacttgccaacctccagaactgtgagaaatnaattttcaacaattattaaaaaaaa

SEQ ID NO: 637325 - DNA, 212 bp, Homo sapiens
ggtcgacaaaacgagtcttcactacccagaatccagttattcatccatttcatcaaaaaagaggtatgcagggttcacctggggaaatgtaagaaatctggaaggatgggccgtgcccgtggctcacgccggtaatcccagcactttgggaggccaagcgggcggatcacgaggtcaggagatcaagacaatcctggctaacacggtgaaac

SEQ ID NO: 637326 - DNA, 1006 bp, Homo sapiens
ctcctatccctccccctgccaccatccctcctctgcatactctcagccctgtaatctgttcccttttacagcttctagttagctctctaactccaaaacacactgatcccatttcccctttcccttacacctgagggcacacgagctacgctaccttgtgtcctgaagacctctgtcacaggtctggcaatgctcttcttctgctcgatggccctgcacaacgcgcgcaggacttactctgcagctgacacagttcccctccccacctgaacagctcattcctctgctgctcggagctctaccatgtgggtctatgcctagcaccccacagcctctcactgcccagctcctttccactcacgggatcgctctatcctgatactcctactactggcgcacaaacacctattctcacacctgcgcaactcatctgacgtcgaacctaatcggcgcactctacacctgctgctctaaggcactccaccccccacccctcgcaccaccccctagaagcacgagctcaacacacccctcagcccgcacctcccatccctccccaaccaccgccacaaccacccaaaacgacggggaactgcacacccccacaccccgcccgcccagccctcgaccctcgcaccaaaccccagcgcacccgcgcacatccaacaccacaccccccacaacctccagagcccccccagtgacgtcgcaccccacaccaacccccgcccccccagcactcccccacccccagcacccacggccccccccccaccccacactacaaccaacccacccggcggccccgcccaacacccgccccccaaccggcgggcgcccacacccccccataccagcaggccccccccccaaccaccccaccccccccgggcgaaaccccactctacccgccgcccgcccaccccccaccccgcgaccaccctgccaggacgcccaacccacacaagcaccccacccaccgccccaacccaggacgccaccccac

SEQ ID NO: 637327 - DNA, 121 bp, Homo sapiens
tatatagcccgacaggggggaacgtagggctttatgaggtctaggatactagtagatagagatagggggaagtagggctacaggaggtctaggatactagtagatagagatagcggggaag

SEQ ID NO: 637328 - DNA, 422 bp, Homo sapiens
actactactaaattctcaggcgctcgaccaaaagtctaatcgtagctgggcgcggtggcttatgcttgtaatcccagcactttgggttgggaggctgaggtgggcagatcacctgaagtcaggagttcgagaccagtctgggcaacatggtgacaccccatctctactaaacacacacacacacacacacacaccatctctactaaacacacacacacacacacacacacacacacacacactagccggcgtggtggtgcatgcctgtagtcccagctactcaggaggctgatgcaggagaatcacttgagatggaaaggcggaggttgcagtgagccgagatagtgctactgcctccagcctgggtgacacagcgagactccgtctcaaaaaaagtcgacgcggccgcgaatttagtagta

SEQ ID NO: 637329 - DNA, 1073 bp, Homo sapiens
ctatggctaggtacgaggctcgtgttaatcgtccgagggttctaaggcagtggttgacaacctccacaggcctggctggggctgcggtcctccctgagtggctctggtgatgggcggcccacctctgctggcagtggctccccctcggtcctggacacccctgcatcgctatcccacagagggtccccggaccacgacggccgcctgagcctgggtcatcctacagatctaggagtggccacccagtggaaagtggagctgggggccggaaggggcatgggaggaactgacggggagccagactccagggagcccaaaggaggtacccccaaagctcaggcgccgcctagaactacagactcacgcaatacagcctcagacctcaaggccaccgagagacagcacatgcggcctccagccccacagagctaacacaggacataaccttgcttggacagacagtgccctgagagtaggcacacactaatgggtgcactgggctactggcctgcccctacttgaggacggcctacggagcccggccaggccccagagcctggatggaacacagatactgagacctacctggggcccaacatggaacagacctcccaaaggattcggtcaaccgcactgcatctgcttgactcactgcttgacccccgcaaaagctgacatggctaaggccaaccctgtctgaacccattgaccttgggatgccttggccaagaaccaaaatgagatacccagactctgaacttagaagccaggagtcactcatcccctaagaccaaaacatggatggaccaattgatccatatgccaaggacacatagcagtctgtgcatagctggtgatgatgttgacgtttggatggacaggactaaatgggcaagggggaaataataacttaataaatacataaagtatagatgggtagaacagaagaacaaaagagtaattagaaaagaaaagcgaaaaaaaagacaaacaaagacaaacaagataagaagagagaaacagagaatagaaaaagaaaaaacagaaatacaataaaagtcagataagaaagg

SEQ ID NO: 637330 - DNA, 204 bp, Homo sapiens
  misc_feature (173)..(173): n is a, c, g, or t
agcgacagaaggaggaatttggagcagaactctggccctatgcggtgaggcatactttgcaaaccgaaactatgtgctatggcggttccgcagcagcagtagctatggcagtggcagcaagattttaattcaggaaaccaaagcttagcagggagacgccaggaagaagtggncccggagaagacatggtggcaggcatagttt

SEQ ID NO: 637331 - DNA, 162 bp, Homo sapiens
ggggagtatcttcttattcgacatagactgtctggagtttagaagtagattgcaggcattggacggcagagtcgctaagggcggattcgtgataggaaaaccccctggggatggaggctgacagccacacccaggcttcaggtggaggtgaggctgctgttt

SEQ ID NO: 637332 - DNA, 344 bp, Homo sapiens
agggtatgcatagcaaacacaggaacagatttagtcaacgtaaaaaaacaaactatgttgcatctacagcaactggactgatgctcgcaacaaagctgacaatcacagaaaaacgcaatacttaagtattcaagccagcatgtgattgctacgagtacaaacaccttcagagctgagtgcagaaatgctccgtctgtttactacgaagaagacacatcaaaatgttggtccaaggaacttgactcattcgatagagacctttgaatgccaatatgaaaaagagaaagcagcacagagaagtagctgtgagacagcttcaactaaaacgcgatgatgtcttaagc

SEQ ID NO: 637333 - DNA, 187 bp, Homo sapiens
gagattaacagggctgtgggagggatcccagagcaagctcgagggcgtctggtgcttaccacctggaaactggtgaggtggtgcgagaactcctggtggacctagtggaagctaccagtaatttcttgaagctgagcgctcaggtagagtagggcgacatctggtaggcggttgttgacggtcattt

SEQ ID NO: 637334 - DNA, 351 bp, Homo sapiens
atggaatactatgcagccataaaaaatgatgagttcatgtcctttgcagggacatggatgaagatggaaaccattactctcggcaaactaacacaggaacagaaaaccaaacactgcgttttctctctcataagtgggagctgaacaatgagaacacatggacacagggaggggaacatcacacactggggcctgttgggagtggggggctaggggagggatagcttaggagaaatacctaatgtagatgatgggttggtggatgcagcaaaccaccatggcatgtgtatacctatgtaacaaacctgcaatttcctcacatgtataccaagacttagagttcctggccgg

SEQ ID NO: 637335 - DNA, 135 bp, Homo sapiens
gcaaatctgcatctgcagggccaagccccgtttttcaggtgatgagggtttctgcaccttgcaactttgatattcaggcacaattggggaacagcaggaggcaagggtggcaaaaaacaacagggaacaggggga

SEQ ID NO: 637336 - DNA, 181 bp, Homo sapiens
tcaggaaagggtctcccttcttccccaaggctgggagtgcagtgccatgatcatagctccctgcatccttgaaacccctgtggcctcaagcaatagtctgtgcctcagcctcccaagtagctggaactgcaggcaggcacctccaggccctgctaagtttggggggttttttttttttttt

SEQ ID NO: 637337 - DNA, 909 bp, Homo sapiens
ccaacaggggtttttgtgttgacccgaggtgtacgaggatatgtggttgtgcccacccatcaaggttgtttttgtagcggcgcaccgtttgacgaacagctccacgaccctgcctatttgttgtgttagccacgccacacacgggggtgttgctacacagccccccccctcgggggtcttacactcccgtcccccctcttgtcgtgtgtgagtaatgcacgctctctgcaccccgcgctggttgtatagaccaacatctatctaatggcagacgcacctcacgcgcggataatattatttgttttgcttcgctgttgtgtctcctctctagtgcaggcagatcgaacccaaaattttgtttcctccacagaccgcctgtctatctgtgcgcggcccaccacgacccacgatttattatctcacgctgtgctaacacacccacttttgataacacacacactcaccacacgcacaattcaagacgccgccgagttagtatttttcaatatttattacgcgacacacaccaaattgttctggagactcccgctctccactcacaccacaattattggaggggagtccttgtgcctcattttgatactactcatcttcttttctttacgcagattatcccacacatgacctgctaaaatatgctcatcgcaccaccacacagcataatttttttgttccccactataacagacatctacttcttttttgtgatctcttattcgcagcactcatatctctcttttttatcacagtatagtggggggcaacaacccatgatagtaccactttcttccccccttgtgcaaaaaacccccttttttttttccccccccttttttttttatcaccccttttttcctttttttacaccaaaaatccaagtggggccta

SEQ ID NO: 637338 - DNA, 497 bp, Homo sapiens
  misc_feature (404)..(404): n is a, c, g, or t
  misc_feature (406)..(406): n is a, c, g, or t
  misc_feature (464)..(464): n is a, c, g, or t
catggccatgatgtgagataacatctcttttacagcttaaaggtactggccagctttgctatcctgagcacttcatttatgaaatggccttcactagatcataaaacaacagaaatttgaatggcctgaaactcttctccagttctaacaagtattctgaaagccaagacaaagttctagaatggaaagaaaaccataacaaaataaattagttcacaatttttgtgacatttgttagcaacagcctggaagtgaccaaaaatcatactcatgacacctttaaatatggtaggattattaattatattgaaatcagtcccctcaacttagatatgagaaaactgagaacagtttccttatctgtccctggatgcataaaaacttctgcctaggttcccagagantnactttatcttcaaacagaaaatttgagatcacatgtgattttttattttcagatcatnaataaaacaaatggaaagagaaaatataaaaaa

SEQ ID NO: 637339 - DNA, 128 bp, Homo sapiens
tggtttcgtttacttgcctacagtgctgtacgcaataaaatgatgatcccaaaatatggtaaagtgaacccatctgtttgcattttttactttgagcccatttgttaataaacccttatttttatata

SEQ ID NO: 637340 - DNA, 102 bp, Homo sapiens
tcaacaaggaaaaatgaggggtctgctttagactagcctaaggtaagtcagcagaatggtacctttttcttgcttctctcagcaagtaagacaggtgtctcc

SEQ ID NO: 637341 - DNA, 323 bp, Homo sapiens
agttaaaagagtcactatggctcaggacacaaggcagggaggtgccaggcctatgcccctgctgggggagaaggaggctcgggccaaagtgggagaagtgctgggcatgggctgagcggtaggggccacaaaagttccggtgggcaccactgtcggcaggtcatgggtgggactcatggcgacctcgctgctacctcttcttgtggtggggtgtcttagtgctgcacctgaggccactcttgttcctgagggaccaccaggccacaggcaggatgccagatgttagtcacttggatgaggcagtagagggtctttagtgcgat

SEQ ID NO: 637342 - DNA, 159 bp, Homo sapiens
ccgatcaacctaccttaatagtctttgacaaagtgggattttaaattttaatgtagtttagtttattaaaatatgtctatgattacaggcatgagccactgtgctcagcccagttgctgcttcttatttttaattttaccttcattagggtttcgatga

SEQ ID NO: 637343 - DNA, 263 bp, Homo sapiens
tgtttctctattagcgctgcgatgttggataattggtcttgttctaaaaccaagcagtgttttactaataaaattgggcaaagatgaaaggggcaatcctttgacgtaccctgctgatgcgatagtttcttcttttgataatgatatatcgaaaacaagtttgtgcagaatccaaaccatcattctgggcaaatcttctccaacatgtaatttgccttctgttgcagcgtctgccaaaactttatcgactaaatgccctaata

SEQ ID NO: 637344 - DNA, 139 bp, Homo sapiens
atgcgcttcagatgccgtgctgtggctgcatagaacgcgcatgactaatgtgtgtacagcacagccatggggcaggatgaccacagtgaagagctgggtgctggctatgatgaccacaagagtggcgctggcgttgccg

SEQ ID NO: 637345 - DNA, 164 bp, Homo sapiens
tgccaggagtacggttgaaacaatagaggtactgtttgacttcatggcttcctgaggcagtgattaacaggtggagaaaacaacaggctaaccaaaaaggtttaaaggaaaagctggggaataagatgtccacagaggcttagaaaagccccaatatattcctg

SEQ ID NO: 637346 - DNA, 262 bp, Homo sapiens
tatacttgctggatggaaatgttccctcagggaggagaaaacaggtgcagaaaagagagcttatctcccagaatacttcgggaaagggaggaactttcataacataaccgttctcctcctggtccaaagtcggcatgtattattttctttctttctttctttctttctttctttctttttttcttttttggagacggagtttcgctctggtggccccaggctgggagtgcaagggcacgatctcggctcaccacatcctcca

SEQ ID NO: 637347 - DNA, 104 bp, Homo sapiens
cgctgtaacaccatacacttcttcaacgtcaggtccggtatggacgaagttgttgcgccgagggtcatacccttggtgacgcagatcagagtggacgatagttg

SEQ ID NO: 637348 - DNA, 379 bp, Homo sapiens
acctgggcttcccttactaccttaaggtcaactactcttgcaaggaaaagccaggcgtggtagtggtacctgtagtcccagctatttgggaggctgaggtaggaggattgctgaagtctgggagaggtggaggttgcagtgagctgtgatggcaccactgcactccggactgggcaacagagcaagaccttatcttaaaaaaaaaaaaaaaaagccaggtgcagtggcttacacctgtaatcctagcattttaggaggctaaggctggaggattgcttgaggccaagagttcaagaccaacctggccaacatagcaagaccctgtcccatgtaaaaaataaataaataaataaataaataaataaattaaaaaaaaaaa

SEQ ID NO: 637349 - DNA, 445 bp, Homo sapiens
tcgcccaacagcataaagataaagatcatcgcaccccgcatgagcgcaagtactcggtgtgcgatcggtggctccatcctggcctcactgtacaacttccagcagatgtggattagccagcaggagtacgacgaagtctggcccgtccatcgtccaccggaaatgcttctaaacggactcagcagatacgtagaatccggtgcagtgggttaattgagaaatagaaatttgcccctggtcaaatgcacacacctcatgctagcctcacgaaactggaataagccttcgaaaagaaattgtccttgaagcttgtatctaatatcagcactggattgtagaacttgttgctcgattttgacccttgtatttgaagttacctgttcccccttggtattaaacgtgtcagcgctgagtgttgggggataaaccataagggtaccggagg

SEQ ID NO: 637350 - DNA, 187 bp, Homo sapiens
  misc_feature (5)..(5): n is a, c, g, or t
  misc_feature (25)..(25): n is a, c, g, or t
  misc_feature (59)..(59): n is a, c, g, or t
  misc_feature (90)..(90): n is a, c, g, or t
  misc_feature (139)..(139): n is a, c, g, or t
  misc_feature (149)..(149): n is a, c, g, or t
  misc_feature (171)..(171): n is a, c, g, or t
gtttncccagcctgtccttccagancctcacccagcctgagcggggttcctagggtgantccctgctgcttggggatgccccaaggcccntttggaggcagcgccccaccttgggcttctgagggcatcataggggganccctagagtntagttcaccacaggccctgggnagagtcaaagaccccc

SEQ ID NO: 637351 - DNA, 585 bp, Homo sapiens
  misc_feature (11)..(11): n is a, c, g, or t
  misc_feature (36)..(36): n is a, c, g, or t
  misc_feature (61)..(61): n is a, c, g, or t
  misc_feature (176)..(176): n is a, c, g, or t
ggcgattttgnccagcccgctgtgtgttgggatttnttgctttattgaatttagttgtaanggggggacaagttattatgatgaagaataattgaggtttcttttccatacttaataattatttttttagcatatgtcataatataatcctactataaattttattccagaacacntttataacaatataaagtgttttccataattatgtaaataataattaaatggcaagcaaagaagggtattataatggattttttgttatgctactgtattaccaggacctaataattatattttcatttgttaagctttatatgtatttatcactattttttttgtaaagggataatattattgttgatataggcacacacatcagataatccttaagttctgtttttgcctagaactttattttcgttgcttaaattagaattggttgctttctaggacctgatgctggctggatacctatgagtttttttttggaactttataaatgtgggtattttgaataccatggtttgttttccccacatttggtttggagggatatacttaaacaggtttaagagaaaatgg

SEQ ID NO: 637352 - DNA, 972 bp, Homo sapiens
ggctggcggcggcgacaggaccgaggggccttagttggtgggcaatgtcggggatcccagaaagagaagcgtgacccggaagcggaaacgggtgtcctgtcccagctccgtgcctgccagtgagcttctaccatcatggacctatttgttctggtgcgcctggaagacgccagagagagctactgcgtgcagaaccagagtgtgccctgaaccgtgccatgctgggagctggacctgcgagcgacagaaactagagacccagtgagaatgaaaatcattgcagacattcaagaagatggccaagcaatggccatgatggatgcttgttctgcatcagtggcaaaatgacttgtgtgctgcaccctggcgctatgtgcgcaagtttgtatatgattgcgggccaacatccattgctgtgtccctcaagatccagacaactcaatgtccaacaactcgatggccacaagccatgaaggggtgtcaccaaggccatgggcaccatgaacagacagctgaagttgccccagatccagaagaatcatgatggagatttgatcgggcacggaagagatcatggatatgaaggaggagatgattgactgatgccattgatgatgcacatggggtgactgaggaaggatgaagagggagacgtgatggctgctgtgtgttccccaggtttcctggcatggaggctggggacccttagccttacacagcatgcagctgttcgaaaccttaccctcaagctgtggggtgctcgactacagtgggtggacttagccatggttggtgacaacacacagcacgatggcgggcaggcctcaaagcgccttagctggattgctagagtgacagaacgcctggaggggacccggctaaaagaagccgtgcgggatggggagtggggtgccacattgccaagatacgagtgaataacccctgtggatcgcccgaggatcgtgtaccagg

SEQ ID NO: 637353 - DNA, 216 bp, Homo sapiens
agagatttatcagcttaactcagataaaatcattgaaggtaatagggtaaaggctagtctctaacttccaggcccacggctcaggtgaatttggaatactgcatttacagtgtggggtaacacataacattgtatgcatgggaacatggggggacagtattacgagtgtcctaccactctaatcgggaggggagttcgagatcctgattctacgag

SEQ ID NO: 637354 - DNA, 204 bp, Homo sapiens
tgactagaatggtatgcaatgaagcgacttttaggtctgtatgtcgtacgcgactgagcttgttatatattatgccatcactagggatagtacatggaaggggtaggctatgtgttttgtcagggggttgagattgagtgtgccgcgtattataccatagccgtctagtttcaatagtacttgccgcagtactcttgaaactag

SEQ ID NO: 637355 - DNA, 881 bp, Homo sapiens
gagtgggcgtcgcgcgaaaggctaagggagtgtggcgggcggctccgggagccaacatgcctcggtatgcgcagctggtcatgtggcccctgctggcaagcgggaagagcacctaacttgtgccacaattggtccagcactgtgaagccctcaaccggtcttgtccaaagttgtaaacctggcatccagacagcagaacatttcaaataatccgtgatgggtgacatccgggaaactgatcgagggtggactgatgtacatggaggatgattctcgtgacgattacggtcccaaagggagggaatgggtacattgcgcattgggagatatttgtgccaataattttgggacgtgtgcttggagaaacgggtctgtggcaatgtaagaaggaaggactaatatcgcttaggggacttgtccaaggtcaagcattgacggttgtaacactcaacctgccttgttgattgaaacatggtggtccagccaagatcgagagcaggtggggaagatcccgaagtctgtggaagtttaactttgtagattactcaagttccatgggtggaagtcattcaagttaaattatgtgggaaattcttggcaagcccttgaggtgccaatgatcttctctaagaaaattccggcaagtcaaatatcatggacaacacagtgggatctgcttgagttaaaaaaaggcaaaaacacggaacattggacgacacattattaagaatccagaagagtgtattgctaaatagagaaagaattctaccaagttgagttaagaaaggacaaaaaaattcaggaacattgaattaaagagctatatgtggacctggatggatgaactacggaatgagacaattataacgtttacgataaga

SEQ ID NO: 637356 - DNA, 410 bp, Homo sapiens
cgctatgatatgaaaaggctagagcagtcttagccctatgaactctcacaactaacaaagcaacactgtctttaaaaatgaaggccgggcgcagtggctcaggcctgtaatcccagcacttcgggaggctgaggaaggaggatcacaaggtccagagatcgagaccatcctggccaacatggtgaacccctgtctctactaaaaatacaaaaattagctgggcatggtagtgtgcacctgtggtcccagctactcaggaggccgaggcacgaagatcgcttgaacccggggggcggaggttgcagtgagctgagatcgtgccactgcactccagcctgggtgacagagcgagaccccgtctcaaaaaaacaacacggggcaaggtaaaaggtgctgaagttaaagggagg

SEQ ID NO: 637357 - DNA, 303 bp, Homo sapiens
tgagacagggtcttactctgtcacccaggcaggagtgcaatggtgagatctcggctcactgcagccttggcctcccaggctcaagcaattctcgtacctcagcctcccaagtagctgggactacaagggcacaccaccacgcccaggctaattttgtattttaggtaaagacagggttttgccatgttgcccaggctggtctcaaacccctgggctcatgcctcggcctcccaaagtgctaggattacaggcgcaaacttttcttaagtatgaaattatttcaaaatagaaaggtcgtcgacg

SEQ ID NO: 637358 - DNA, 160 bp, Homo sapiens
ataggcttggaggaacaaaccccttttttcaagcttggcgtaaaaaaggaaaaaggccggcaccgaatgccctttcccaaaaaatgtggaaactcttaaaggggaaaggggaaaatgttaagcggtaatattttgtttaaaaatccggggtaaaattttg

SEQ ID NO: 637359 - DNA, 129 bp, Homo sapiens
aactgtggagatgtcatgagcctttctcttgctcctgacaccagactgtacgtctctggtgcttgtgatacttcagccaaactctgtgatgtacgggaagtgcatatgccgacagaccttcactgagga

SEQ ID NO: 637360 - DNA, 380 bp, Homo sapiens
cttttgccaaccgaaggcactaatcctccaagaggcgtctggcatgggcgccctcctggccgagttccgggcagcacccgttcgtgcgctcagcacgggctttgcggctccaaggcccaggggggttcgcttccccggtctggagggtcatggattcggttcatcctcctcctataaaggaattgccgggaggagttgctcctcctctctggcctggggctggaaatgaaagcgtcacctcaattcccagcctactcggggggccgaggcaggagaatcgcctgaacctgggaggcagaggttgcagttagccgagatggcgccactgcactctagcctgtccttttttcttctatttttcagaaccctgggcggaaagc

SEQ ID NO: 637361 - DNA, 1117 bp, Homo sapiens
  misc_feature (556)..(556): n is a, c, g, or t
  misc_feature (784)..(784): n is a, c, g, or t
  misc_feature (800)..(800): n is a, c, g, or t
  misc_feature (821)..(821): n is a, c, g, or t
  misc_feature (877)..(878): n is a, c, g, or t
  misc_feature (900)..(900): n is a, c, g, or t
ggtagcgaggcctgggtggccgcgcaaggcgaggcgggcatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggctgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgatgctgtcttcctgattttatacaaagaattatactacaggcacatatatgccaaagtcagtgggggaccttccttggagcagaggtttgaatcctattacaactactgcaatctcttcaactacattcttaatgccgatggncctgctccccttgaactacccaacagtggctctgggatattatcgatgagttcatctaccagtttcagtcattcagtcagtaccgctgtaagactggcaagaagtcagaggaggagattgactttcttcgttccaatcccaaaatctggaatgttcatagtgtcctcaatgtccttcattccctggtagacaaatccaacattcaaccgacagttggaggtatacacnaagcggaggtgacccntgagagtgtggtggggagtantgggcggactccctctacaaaatgcttggttacttcagctggtcggggttctccgnnctgcactccctgttaggagatnactaccaaggcatcaaggtgctggagaacatcgaactgaacaagaagagtatgtattcccgtgtgccagagtgccaggtcaccagatactattatgttgggtttgcatatttgatgatgcgtcgattaccaggatgccatccggcgtcttcgccaacatcctccgtctacatccagaggagcacagagcatgttccagaggaccacgtacaagtatg

SEQ ID NO: 637362 - DNA, 446 bp, Homo sapiens
agcggaatggaggcttgggctgcgtgcggcgcgcgctcccggaacgcgcgcactgcagacggtgcggatcgcagggagccggtccgccgccggaactggtatcctggtgtgtgcgtgtggagtccggactcgtgggagacgatcgccgatgaacacggtgctgtccgttgtgcgaactacactgtatcggcctttcgtcgcctgacgctgtgattggcggcgcttcaccttctggcatgcttcaattcgagccaccgggccttcaagagacgacggatgcgtcccggttgcgtgattgcgacgttctcgcgggatcatcgcgtagacacaagatgtacaggaagaattttcacctttggaacccttagaggaaacggacaggtgatcatggggattttaatcaacaatatttggatataacctgcttgattcttaagaacgaattg

SEQ ID NO: 637363 - DNA, 156 bp, Homo sapiens
gcggaatcgggggtatgctgttcgaattcataagaacagggaggcaccatgttcttttttcctttcagatgttctaaaattcctttctcattttcttcctgtttagagaactgcctttagccattctttagggaagactttttttttttggagggg

SEQ ID NO: 637364 - DNA, 1008 bp, Homo sapiens
  misc_feature (675)..(675): n is a, c, g, or t
  misc_feature (691)..(691): n is a, c, g, or t
  misc_feature (712)..(712): n is a, c, g, or t
  misc_feature (768)..(769): n is a, c, g, or t
  misc_feature (791)..(791): n is a, c, g, or t
ggtagcgaggcctgggtggccgcgcaaggcgaggcgggcatgtcttatcccgctgatgattatgagtctgaggcggcttatgacccctacgcttatcccagcgactatgatatgcacacaggagatccaaagcaggaccttgcttatgaacgtcagtatgaacagcaaacctatcaggctgatccctgaggtgatcaaaaacttcatccagtatttccacaaaactgtctcagatttgattgaccagaaagtgtatgagctacaggccagtcgtgtctccagtgatgtcattgaccagaaggtgtatgagatccaggacatctatgagaacagctggaccaagctgactgaaagattcttcaagaatacaccttggcccgaggctgaagccattgctccacaggttggcaatgacaggcacatatatgccaaagtcagtgggggaccttccttggagcagaggtttgaatcctattctctgggatattatcgatgagttcatctaccagtttcagtcattcagtcagtaccgctgtaagactggcaagaagtcagaggaggagattgactttcttcgttccaatcccaaaatctggaatgttcatagtgtcctcaatgtccttcattccctggtagacaaatccaacattcaaccgacagttggaggtatacacnaagcggaggtgacccntgagagtgtggtggggagtantgggcggactccctctacaaaatgcttggttacttcagctggtcggggttctccgnnctgcactccctgttaggagatnactaccaaggcatcaaggtgctggagaacatcgaactgaacaagaagagtatgtattcccgtgtgccagagtgccaggtcaccagatactattatgttgggtttgcatatttgatgatgcgtcgattaccaggatgccatccggcgtcttcgccaacatcctccgtctacatccagaggagcacagagcatgttccagaggaccacgtacaagtatg

SEQ ID NO: 637365 - DNA, 135 bp, Homo sapiens
ggatcttagtccgctcggacgacaagaagtagaaggacgtggaaagtcggccaagaaagaccatagacccatgtgaacaaatccgggggcaggccgataaagaagaagtggtccagaggcaaagttcgggacaag

SEQ ID NO: 637366 - DNA, 260 bp, Homo sapiens
ggccaaaacccccctttccccttatatgggggatttaacggccaactccaaaaaacaaaagtcttcgggtttttcccccaactgggggaggaaaaaaatagttgttccatggggttttagggtcaacccccccaaaaggaaaaacctttttagattttttggataaaaaaaagcccataggttaccaaacttttcggggccccccaaggatgtgaaaagggtaattttttgtgtttttttccccataaaaattgttatta

SEQ ID NO: 637367 - DNA, 479 bp, Homo sapiens
tcactagagcaccgatcccagcatccggacactacagcggcccgttcgctccacgacagaaaaccacacttctcacaccttcactcaagcacttccttccccaaacgccacgaagtatgcacaaaggaggaacatgaagtggccatgtgctgcggggcacacaacccaagataaccataccttacacaaggtaccaaccgtataataccaagataccacaagaagagaacactccgatgcaccgatccatgtaacgtaactaggtacacactgattatcaaacaacacacacatcatatgcttgcaacaacctaggatgcattgatcctcggcagcttacattaggcactttgcgacactcaacttcccgactggacacatactagcgcgcaccagctgaactcgatagaaaagcgagaagagagcgcatgaaccccgtaggacagccgagcgacacgttaactggcccaatccgaaaa

SEQ ID NO: 637368 - DNA, 848 bp, Homo sapiens
  misc_feature (796)..(796): n is a, c, g, or t
gcagcatgccatcatattggagagaagactgcttgtctgtgtggcccagtaatccaagcagccagagttctggttggcgcagcacccgtaagaccaccgcgtttgacgtgagtacatgactgggaggtctggcactcggcagtcggcagtcagcatcgacaagattggtcacgacagagcgacgttagggacgggcggagagtgaagcactcctctcctggagtacagtatcacgagctgagtcgcaatcttgtcgagcttggacagatttgctggagctatggtgcagtcgatatcaatgtaaccgcgcagagagatgcaggttggcgtaggaaaaaaagaactgctgggctgcttccaccactacaataagatgttcgtagcgatgcgtgagctactacgaaatggttctgaggagagcctcgcaagggacgtctccctgtgacccgggcttgtcggtcgatgcaaggacgcaatagtatccgttccagcgatgacaggagctagaagagaagagagaattaaacggatgctgttgagtgagcagggaccctggtggtgccatgcggcggggtattaaaagagttcgccaattaagtaggaacgagattgacgagaccatccttgctgaagcctaatagtttcttggaaggcatccgttgtgccaacatagaagccagcatggggcctgcatcatttttaagaccagcttcgtgggcgatagttggatgagaatctgcaatgcctggtgcacacagggtgtcccttcgctgcgcgcgtgacataaggagctgancctcctaagctgtccgaccaactctcgaaggaagatagagatcagctgatcc

SEQ ID NO: 637369 - DNA, 121 bp, Homo sapiens
gtgagggtgtaggtgagtgaacgtgtccagggtgagtgagggtgtcaggttgcagagtgaggtgtccagggtgaggagtgacggtgtctcctaagttcagagccagggggtaccgagctcg

SEQ ID NO: 637370 - DNA, 277 bp, Homo sapiens
ggaagggcccggggggctggagctttaggttcaggagaggaatcataaccactctgtgccctgggtgctgctcttggcttatctttgggtccaggtgaggaaccagacctactgcccccaggggatagtcgacatttgctgccaacctatggagatgatccacaccgactcctgtgccaaaatggagaccgtgtcttgactttaaaatctggacaaaagcctcactcacttctttcctgaagggatacactgggtttcacataccactcgggagagg

SEQ ID NO: 637371 - DNA, 225 bp, Homo sapiens
attcgcggccgcgtcgacgataaatgcaattatcatctcattaaatacaaatgcagataaaatatctttagtgctgtaacattttacctaactttttatatgttttcatgactgtgtgttattttcaaaagctgttactacttcaccatgaggttttatggattgttatgtataataaatgttctatataagacagataaaaaaaaaattaacataagttgtccc

SEQ ID NO: 637372 - DNA, 207 bp, Homo sapiens
ccatatgaaatgacggggcctgtgtcttcaaggaaggtaaatacaagcagctttactacagtataagaagctcgtgtcttggctggagatatgagtctagtttttccaatgaggaagcacagaaagcactggcccttcgactggccgctgtcctccacatgggcatgtgtcatatgaaactacaggccttctctgctgtgatacctt

SEQ ID NO: 637373 - DNA, 970 bp, Homo sapiens
ctggcatgggccagtaatcgtgagccagcaggagctgggagctggtgtgtgaaacgactgccagtgaaatgctatcgcgccagagaggggggacggggtgctcgtgtgaatgccctgacatgttggctttttgctgcacatgcttgcctggctggcttgctaaccctgccccgtgccaagcccccgatgaactgctgctgaccatgtgcacccatgtcctggtgtcacctgcatgctggagatgctctgcctgctcgctgcagcgatgggcctggatgctgtgccctgcatgtggaccctccccaagacctgcctgggtgcctgccctggatgtgcactaaaatggaacatgcccttctaccactgactgactcatacacagctaccgtggatactgtgcctgtgtgcccctgtgtggcctctctctacactgactacaaactcctgaaaccgaagcctggctgtgtcaacctggcctgacccctacctggagtctcaaatgctgcctggtggctctgctggaccctgtgcccagagtggctggcgctgtgttgtgctgtgcatgctaccttttcttggtcagggctctgtgacacctggctgctgtctctcaagctctgcctcttctggaggcttggaactgcctgattgtccccaacagcaactggcgtgatcacgactgacgcctacaccccctggggacagtacttttaccccccgcgggggttggcatgcggtggatgtgtgcctgcgtggcgcacgggggcgggtgtcaccgaggaggcaggagggcttcgccgacggtttgtcaaagccctggacgatctgcaccaagatgaccacgtgaaccccccaagtgtccctggcgctaccgggggggccccggtgggccgtgggcgtctacgcggccgggcacctcctgtttaccagcttcgaggttctcccgctttcgtctctggagggccgggtc

SEQ ID NO: 637374 - DNA, 109 bp, Homo sapiens
gtgactctacaggatcgtcacactggcagtgctgatcctccccaagctcgttatcgaatgaagtacttggcccgggtcacgcgtgggtcctctccgggctcgagtagta

SEQ ID NO: 637375 - DNA, 1268 bp, Homo sapiens
tgctggtactggtctgcgaatgtatttggatatagtcgacccacagctgtcaggacccagaccctggctgacccacctacccgcgatcctgcccgtggctgacgggctgtttcggcgcagaccctggggtctcgagcagattcgccggaccccgagtcctgaaggcctgtttgacaagcctcccccggaagaccctcccgctgccctgcgggcccagtgtcggctgtcggcctgcggtgcaagaacgtgcttggtccggcagctgctgggcgtggagtgtgcagcagtggtggtgcctgcgcctgggcagcccccctgacaggcctgcatctgcgccccacctgccgcacagaaggaaggcgccatcacactggcacgaaggcgctggctatactcgcacacagttattccggcaccatcttccattctatcatactaccgcaagcgcgatcggccgttcatccattcacccgtccatggcaatcattttacgcgtattattcccacgtttctaccagagcatttgccattgaaggatggccccatgcgccaggcgaacatgggcgttgcgcgcacgcacagtgcacctgcagctgtgcgcaacgcgggacaacgtgcgacaaccacagcgggacttcgtagcatattatggtgctctccagacacacatgcagcatgctatacgcccatatcacttgtcagctttatcgaactgcgtgtggttttcgtttaccaggatcgtaattgtattgtcgacgtagtcgtatgtggtcctattcaagataactgacaagttacaaagaggttaggcattggccgggcaagtggacaataaggggggtggctggttattggagacgcgttgcaagcgttacgaggggatgaaaggcacgataagagacaatattatggggcggcatgcttcacttatgcaagcacacccggatgtgtacttacatttaaggaaacaattggtcccctgtgggaaagccccacataaaccaaaatcttcctttggttgaaccggcttgtctggggggccaaccgtccgtgactaggggtggaatttaccccatattcaaattatataggggatggataactggtagtgggacaagcacatacaacagaaagattggccggcaccacaacaattcccgtattgcggcagacttcacgtttacaaaaggtggacatggcatgtctcactggaagcgccacatggtaaccctcctgcgagtgtgaccatttcgactaaagaaagagag

SEQ ID NO: 637376 - DNA, 396 bp, Homo sapiens
cgatggtctcagcttggaggctgaagtgagctacagttgccctctgtactccagcctgggggacaaaaggagaccttgcctcttttttgaaaaaaagaagaaacaaaaaaatggaaggtttggttctaaaaaggagtagcttttgaaatatggaaaggaggagacatatttgctaaataaatgcccatgataagccaagaacaatgatcttttatatctctgtgattgcatttaatctttaacaagcttatgaagttagtatttttattttatttagacgaggcatagtcaaggattagataatatatataacaagtggtataagatttgaatttgagtctgtcttcccaccacactatattggctcccaaagtatcaaacattattttttgtttt

SEQ ID NO: 637377 - DNA, 339 bp, Homo sapiens
  misc_feature (82)..(82): n is a, c, g, or t
cacgcgcaccgcgtttcaaacaatatcactgcactgggaaacacccaagaggatgagagcactccaagtctctgccctgacnttgaagtgaggttgtcctccatttccaggtacaccccctcttcagcaataagggcaccagtccacacacaagctgaacaagtaaaaaagacaaccagtacctccagaaccccggctcttaacaggcttccaatcacccacaatgaagaaatgccaacgcaaaaggcaaatttcttccactggcatgaaacttgtctaagtgttttaacttataccggaaaattctaggatagtatccagccaggcaaattcatccgt

SEQ ID NO: 637378 - DNA, 1364 bp, Homo sapiens
  misc_feature (424)..(424): n is a, c, g, or t
  misc_feature (1177)..(1177): n is a, c, g, or t
  misc_feature (1202)..(1202): n is a, c, g, or t
ggactccttgtggcatccctacgaatagctagtcttcaatctccatcatgaagtgtgactctggaccgatccgcacagagacctgttacctacctacaccgaaaccagctgctgctctgagccggtcaactctaaactcattgttagccctggaaacttgactctgaacaagaggatagcaacgaagaggcgtaggatacacctagacgctctgtgcatcgccatggtaccacatggaaagatacaagatacattgtctcctacctgtaggcagctacagtactccgtgctggaatcagtctgggtcctattcctgagccacgtccgaccatgattcgcgacacctctctcgaaactagaaatgcctgtgggaatcggagtcagacagtcccaggacagcaattgaacagaagatcccgaggcncccacatcagcaatccggtcccttacccgggcagacaaggtcatgtgcttagtgtcagaaggacgtcaatgcacctgtaagagtaggcagtctcaacgaacccgtatttcctttgtgaaaaccatatagaacccattatagcatatgactggactagcagagattagacctacaagtacttgcaagaatgtcgcgtcaattggcccttttctaagtatataaggttctatgtatcttttggttgttttaatctaggatttggtctccgagatatttctatttttccttccttaaacaagagggctttgtcccacaccgctacgacggtgattaatgtaaaaaatcttccctttgggggcaatacggcgttattaaaaaatgtagcgttgaaaacaaaccaagggacgaacccagtgttgtggtgccaagcgcacaaagcccagcaaagttcactctgcgacaaaccgaggtgttcacggcccggattgtggtggaggtgttcacctcccacgttgtaacgccaatggtaaggcaaatggtcgcacagcggcaaaaatggcgttttgggagaataattcctataatattaacaataatcaagaaggtgccaaacttcgtcccgcaaccacaatcttatcgtggcacatgaaaacatcccttatgtgatggtgttcacccaaaccgaggaaaggatggttattctcccactattggataggcctcaaaccttggcgcctattcagatatgagggnaccccagggcgcaccccaaacattnttttccgggcttgctggtcacttcacaagagaggcgtaggcgcaacaagtgggcgttcccctccccaaaagagatcttcctttttaatctttcacacgcacattgcagggtgtcacacacgcgggaaaaccgttgggaagggggcgggcacggttgtaactt

SEQ ID NO: 637379 - DNA, 389 bp, Homo sapiens
  misc_feature (14)..(14): n is a, c, g, or t
  misc_feature (40)..(40): n is a, c, g, or t
  misc_feature (46)..(46): n is a, c, g, or t
  misc_feature (50)..(50): n is a, c, g, or t
  misc_feature (163)..(163): n is a, c, g, or t
  misc_feature (172)..(172): n is a, c, g, or t
  misc_feature (213)..(213): n is a, c, g, or t
  misc_feature (252)..(252): n is a, c, g, or t
  misc_feature (334)..(334): n is a, c, g, or t
gaacatgttctttnaacatacaacatagctttaggtttanttatgnctanatatttctagtgttattacattactctcaatggttgtaatacagtaggctgttatttctgtcaggcggtagctttgtcaagggaattggtgagtactgtagtttcatcatggntaagcaggnggtgtttgtcttgtgacattgcatgtattattaggtgtggnagtgaacaagtgacgaagacaacaactcggttttccctntaaactacataagtaatgtcaactcggccacctgaggtgtatactacttggggatccgtgcacgttaacgattactaggacnatgcagaaaccagagagtttaagaatcccgcatttggcactactcccttctttca

SEQ ID NO: 637380 - DNA, 152 bp, Homo sapiens
ctgctcctgaactcaggttggtctcaaactcctgagctcaggcaatccacccgccttgttctcccaaagtgctaggattacaggtgtgagccacgacacccagctattttttctttcgttttttaattttaaagttggtgggggtctcaatt

SEQ ID NO: 637381 - DNA, 239 bp, Homo sapiens
gggaaacagctatatacgggtagtggtatttgactctgggaaacagcaattcacggggtgtactgacgtcttgggcggggatggcttcattctgaccgtgagtggagcttaagctgagtgatggagaatgctggggggcctccagacccaccggggcctgaagagcatgatcaaggaggtggatgaggacttcgatggcaagctcagcttccgggagttcctgctcattttccacaagg

SEQ ID NO: 637382 - DNA, 821 bp, Homo sapiens
taaaaccgtgcccggttctgtggaaagtgggctgtgctgtgagccagtgtccctggaatggcggagactctgtcagtgcctagtgtgattctggagcggctggtgcgcgtgcgtgctctgacgctccgcctcgtcatgagacctgtggactgcggcgcctcagcgacctgcgagttgatctgatcttgctgggctggatgctgatggaaactgtgaatgttggactcgatgcgtgcaaccaagagcgttttgactggagctgtgctgacacgaacggcagattgacacgatgcaaggtggtaagtcctgagcgacacattgaaattacctccgagggaaacaagaacaaccatcaaaggaggtctagcaacatggtgcgcaaaccagaacgaagacgggtgtggaagataacgggctgcgaggaaacactctggggatggacaggacggactgtgacgaccagctctggagaacttgcacggacatcgacatcatggatatcagtgatgtaggatgacagcagaaattgactactggaacgcgttgcagacctcgctgtcgaagacgagtgatgctgactcacctccaggaggtccctgatcgggacttacggtagaaggagctaaggtcgaagggcggaacctgaccaggagctatccggcagccacgcttcaggggactcacgtgcgtatagagcgacggcgggacacgcgtgttaagcagctttaggatacgttgagtcatcgtgggcttcacctcatccttccagggagacgtggcccgcagcccatcccctgggcgcccggcacacaggacgcagc

SEQ ID NO: 637383 - DNA, 225 bp, Homo sapiens
tctggactgggctgggaacagagtgatcctggggcagtagtgaggaacactctgttcccagcccagtccagcaatcactatgtccgtaggacttgcatggaaccgttgagtactattcttagaagccatagacgtcctgatgaccaaccgtagcagtgtctaaaccctacccgttatcgtgcaaaggacagtagtgaggtagaccttgcaaggtaccagtgcccc

SEQ ID NO: 637384 - DNA, 563 bp, Homo sapiens
gccagcttgatgtttcaaccctggagggtttttttttgcctccctttattttgggcatggggaacactcctataagaaagttcaggcttgggggagtagaaaattttccttcccagagtcagaggaaaagagccatgtccttttcccttgttccttccttccaactaagccagagggtggaaccttaagaaagcgtggggtaccaaatggattaatggtcccggggtccagaccccttcccaaagttcagccttgccggggtccctttttttttttccccgggtccttcctttaggttgggttgttgccccatttgtttggttgggtgccaattaaaacccctcttgtgggaaaacaaagggggtcaaaaaaaacctttaaccccaaagggttaggggggtggggtcctttttttttacccgccagggggggaaaaaaaaatccaaaagtggccttattgtccctaatggaaaaaccccccgggttaggggatgaggggttttttgggtctttttcccccccccctttggggtcccacccattaagtccccgggttgacccta

SEQ ID NO: 637385 - DNA, 769 bp, Homo sapiens
ttggcaagaacaagcgccttacgaaaggcgggaaaagggagcccagaagaaagtggttgatccaattttctcacgaacgattggtcctgatgtgaaagcacctgcgttatgttcccatattaagacacatattggccaagacgctcgtcaccaggaccccaaaggtaacccaaaattgcgatctgatggtctccaagggtccgtgtgtttgaccgtcggagtcctcggcctgatatttggcgcaaccgcatgcaaagtcttgccctttccgagacaattcccagcgtgcatatcacttgcaaggatcgttccacacgggtgaaacaaagacttggcttgtactaaacttacccatagggccataggaatctattaaccccgttgccaacacatgtttgtcccattgggtcccaaaacataggcgcgacccattgatttgaaagctccacgcttgatagtctccagactacccgatagggttactctggctacgggcctagtccctggtgaccttgcggcgtatcagctatacaacaaacagccggcgcccacaaacatccagcaattaccgcggagagcgaaaccctcctttacgttgtccctccaggccacccacaacaaagggttcccgcgccaaaaatttcccggggaaaggacaccgacctgtacctgtgggcgcacctccacctgtgagcccccggagcaagaggtgtccatcgaacccacacttgagcctttgcacaaggacacgctggggtcccactaaaac

SEQ ID NO: 637386 - DNA, 214 bp, Homo sapiens
tgagattccgcggatggcagcagcaagcgtccatacgaagccagcatcacccactaggatacaacaaacctagcgacccttaacagtacatagtacatgaagccatttaccgtacatagcacattacagtcaaatcccttcacgtcaccatggataacccccctcagataggggtcccgttgaccaccatcctcgcgtgaaaatctccgcctca

SEQ ID NO: 637387 - DNA, 468 bp, Homo sapiens
ggcgcggcgtatattgttcaatcccgggaagacctcggtccccccgattgtctgtctgggccacccgcgcgtcactctgggcgacattggctgcgacggggtgcacaccaccgcgggggttgccacctccccggtgctgagcccccccccctgtggtatataacagctcctcccaacagttgttcgcatagatctcatggacgtgccccccccacgtaagggctatcaaaccaggaagcagcaattcccgggaggttctatactccacgcacccctttgcccccgttacacacagcccggggttaatacccacgggccaagtcttagtaaaacagttgggacgccgacaccacccaaattcttcacaacgcccttcggctcgcttaagaatgattccccctctaaattttttaataggccccctttttccctattcccccccctttcccccctttgagcccccaaaaa

SEQ ID NO: 637388 - DNA, 993 bp, Homo sapiens
ggaggctcgcaagtgcgcgtggccgtggcggctggtgtggggttgagtcagtttgtgggacccggagctgctgacccagacgggtggcccaccgaaccggtgacacagcggaaggcgttagggctcgggagccgcgagcctggccatcgtcctagagctcggccgagaccgtcagccgcacgatcgtcccccgaccccagtcagcaaaccgacgccgctgggctgcgccacccgctctgcagcttgtctctccgatggctgtccgactcaggggccatggggaaggcacgaagcagatcctggtcctcgatccgcccacagaccctcaaattcaaaggcacattcagagatgtagtcacgtacaaatcttaaatggcgaaatccatcggatagaaaagtgtgtatcaaagtgaagagtacagaacctcgtcggtactgtgtagaggaccaacaggtggacattttggagccagggatcaagtgtgagtgttcagataatgcatagaggagcctttgactatgatccagaatgaaacgagtaaacaccagtaaatggtacaagacagttattgatccagcaaacacttcagatatggaagcatgtgtggaaaggaggaaaactgaatgaattaaagggaattccagatttgagaatgcgtatttgaaatggcacaatgagaaatgataaattgagtgagtatggaaacatagaaaaggtggatacattggagtgcaattaaggaagatggaagcttttgcgaaagcaaccacaagtttacagaattcaagtgtgatacacgaacagcagcgaaacatactggacaagacgtgttgccgaggacgtcaccgggaaggcactgctaggaggaatattagacgaacaccttggtgaacgagtagacaagcgacgctttcagaggatcaacaacggggaacaacttgcgtaaaccctggaaccacctcagactgcacttttccgaccatagttagcat

SEQ ID NO: 637389 - DNA, 271 bp, Homo sapiens
  misc_feature (172)..(172): n is a, c, g, or t
aacgatggtcctcagctaatccagactctgcgctaaagggcagtgtcgggcagcagtggggtatagcatattaccaaagatgagaccagcaaaaacaacaatgtgtataaagctttaaattaacatagatcatatacgagcgctcagagatacagacaaaagcacatatgantacataaatgccaaaacaaacaagatactttggagatttacatgacaggcagacagttaactagcacacgtcaacagacatttaaactcacaatatatt

SEQ ID NO: 637390 - DNA, 216 bp, Homo sapiens
cttgtttgcaaaggcctgcaacgtcaacattggagcctcatctgcaatgtaggggccggtggacctgctccagcagcctggtgcttaaccagcagggagggtcctcccccttcactgcttgcttgcttcagctgaggagaagaaagtggaggcaaagaaaggaggattccaggagttttatgatgacatgggctttgggctttttgactaaacctc

SEQ ID NO: 637391 - DNA, 504 bp, Homo sapiens
agtactcatcacagctctgtaggttgaacctgaaggatcaagaaggaaacacaattcaactccctactttgtccatcaggtgatgaggttactcgaagaattatccctgaaactgccaacaaatgtggtcgaagcatctgcccgagcttctgtctcagttttgggcgacatattaggctctgccatgcaacacacacaaaatcttctccagatgccctatggctgtggagagcagaatatggtcctctttgctcctcacatctcatgtactggattatctaaatgaaacacagcagcttcactccagaggtcaagtccgaaggccattggctatctcaacactggataccaagagacagttgcactacaaacactatgatggctcctacagcacctatggggagcgatatggcaggaaccaagaaaagccctggctcacagcctttgtactgcagactttagcccaagctcgaacctacatcttcatcgatgcagcccacatca

SEQ ID NO: 637392 - DNA, 567 bp, Homo sapiens
caaaggagatcattcctttcagggggcctgcaggtgcttcagctgttgttgctgtggccttcggcatgagctcctgccctaacataaaaatgattttcccctcatcatgatgccatgatcccatccgctatatcctgctgccccgaatcattgaagccaagtacttggatgtcatggacgctgagcacaggccttgattggcagaccctgcccacgccccatttgccagccctccaggtcctcccaggctggctttgaaactgtaaggggaggtgtaggtgtgtgggtgactgctttgtgctgcgccttttcatggctgactcaggcctggggcatttgggcattgtaggggtgcagtggtatgtgcccccccctctcccattatcctttagctttaggccaaaagcgttgctcagggcagcttttgcccagggtgggtgggactaaacaggatggattttttttttataaaaaagtcgatgcctgaaaaaaaacccctttccttgattgtgtaaggaacttgctggacgcccattaaaaaataaagctcctgtttttaggctccta

SEQ ID NO: 637393 - DNA, 1361 bp, Homo sapiens
  misc_feature (852)..(852): n is a, c, g, or t
gcctccgtggcacatgtgacagtcgtctttaaaccctggcgtggcaattccctgaggcaccgcgcgtgatgccctagggaaggactgggcgaccttggaaggtgcggaactaacttccttaagatcatccaagctatttgtgctgatctattccgatagatgtctcaattggtgtgggatgcacgaacaaatgtcgcgcgtatccaacgcgagaatgactcgtacgcaatccagccactgcttaccatttcagcgggcaacagggctcgttgagtgcctgaatggagcaacgaatcacccactgattgcgcacaggcctactcgcagaaggcgcaaaccctgggatagagatcaacgcctacgactccttgagagacataccttgacttgcacttcaattatccgggcgtgcgaaaatcgcttgagggcctgttgtagtttcaaccccaactggtagtgatcctcgagcttagagattcagagggaacattggtttgcttagggccctaattacaggggattgcacatggcttgcgattgcgcccaagtggccatggggttagaacctacattttggctaaccacgaattgttgaacaggttccaacatgatgccacaatggccccacagtgaataccacaattgggtttctctctagagggaccccggacagggaaacgaactccctttcccactctatttattccccgaagggaccttttatgatgcagggggtctattcgacccccaaacggttacaaggaacaattctgttcctgccaaaggagggtaggcgcatacaccccatagattttgggaatcacacgttcgccattgcacggtagttgtacnttgcgttggaccacaggcgttgggaattccacaagggcaccccgtcgcggcccggcacactaaacaacgagttggaggggaaaacggccccgaacggcgaggaacacgcgccctcagctggtacagtggacccttgttaagagccgaccgtttggcgcattcgtaagagcaagcatttcttcggcacgcaacccgctattatacactttccgcccatagtatgatcgggtgaccattggagggatcaaaattcccccaaggcgaaaggagattggctgtacacctgaaacccgaaaacggtcgggagggccaagggtcccaatatttccagttagcccatacagcgcccacttttggtaaacacagacgctgacccttaggggcacgctatatttccaacacaagggtacaagggggaacacaaatcgacgttcctgatggtacgaacactttcccaatccctgacgcgttgttaacaccgcttgtgtgtaacgggcggcagatgggaa

SEQ ID NO: 637394 - DNA, 133 bp, Homo sapiens
gttctgggcgtatggcaagcgggctctgggggcctggattcctcagggacggaatgggagttaccagtggggaccagtgccgtgttggtttgctcgcaccccattcaactccgtcactttaccattcaggtat

SEQ ID NO: 637395 - DNA, 951 bp, Homo sapiens
gccggcttcgctatggcggcgaattcacccagattcctggcagccacccaaggtttacttggagactaccatgggaatcattgtgctggagctgtgactggtacatgcatgctccaaagacctgtaatgaactttgctgagcttggctctgctcgaggttaactacagatggccgcaaaattccacagaattatcacagacttcatgatccaaggaggtgacccaacagggacaggtcgaggtggtgcatctatctatggcaaacagtttgaagatgaacttcatccagacttgaaattcacggtgggctggaattcatctgcaatggccagtgaaccagtcttctagatgacatagaatgacgatgtcatgctataattcattgtggcttcgcaagtcatgaacgcttagcgaggcctggcatcttgggtgagttagacgatggaacgtacagttttgaatacgggaatgcatctctttctacatcccccagttgccttacggttcgccaggaaccatgtgcccaaagatgccccatggcctaatcaatctcaggctagactacgttactacacatgaaccataagtgcatgcttcttgtgcatgtctgctctgatatacgtcgaaccaatgtagccagccactgtcatttctcaactggttctgcctaaccaaaccttcttcctacggagcatagatattctggcctaccacagcagatccttgatggctgacaggcacagcaattccaaagccaaagtagtagactggtcagccctcttaactctgtgcacgcccgtatatcagacttttacatttgtacatctagggacactgtatggcatctctatatatattctccctgtcaaaacccagaacatcaacagggctgcttctgacacttcagaaatccaacggaaagccagtgaattttgccaattgaaaaggatc

SEQ ID NO: 637396 - DNA, 162 bp, Homo sapiens
gtggatatgcttattaatgcacttgtttcaaaatcccaattgcacaatgtgttaatattttagaacaaatgaatcctacaagggagagtgattttttagccacacataggggtggatcttgagagtgacctacagataaacgactttttaaataagtagtca

SEQ ID NO: 637397 - DNA, 998 bp, Homo sapiens
gggtggtggggaatcattaccgtgctgcttaggagcgggtggtgcatggatcgcggaagagtgaacgtgactgaatcagtctcagtcggaggtcagatggagtgggaagtacaagagagccggtaaagccccgaaaagatttgaaattccatccaggccggagcaataccgcggaggctcacgtaggtccgtccctcttatctgtgggacaggcccccgagaacttgagtgggtatgcaggatggctactgaggggtagccggtgagcaaaggcagtagagtacctttgttatcatggaggatggtcgcatcgccagaaacttgatcatggtgggagctgaaaaggtggcctgggggtcggtcaagaatacggtccatcttagaaatggttcatagacgcacacgagacgcagtaggctagagaatgatcgcggcaatgtgaggctgtcagtgacgacccagggagaaaacagggccctgatagggtggatgggcctgcctgtgcaggtacaggccaccttcaagcttctgggagagctccctatttgtcaaggaatccagctcctttcgaggtggactagctctaaggggccaggatgctttactccctagtcatgttgaccctgtatggcttccttactcaaggcccttgacgttttcattcctgtgccgcatttacctcctggtcatctcgcctaatggttggtgggttagatgaactctgcagagggtgcgtctgaggaatgatgcatctagttgcaactcaattgtttgaaggagcctcattgcaagctcaatggtaaagcacggcggacggggcaagggtcctgtttccgccaaattaagtcgaaagtagggtggaggggacgctgcacgttactggagtcgccaggacacgttgtgtcgttaatacagccagaccatcccaatcggccgggggacacaattctcgggaacccgtatgtgttatcgaaataagagatgctgtgtgcgcatta

SEQ ID NO: 637398 - DNA, 860 bp, Homo sapiens
gctgcccctgacagattctcctatcgtggtcacagggactctaagattgctacctgaacttacgttgaccatgctgtcccggttggtacttcactcgccgccgcacaggccagagtgtccctcgtacatctataacgaatgcagtcctgtgccttaactgaatcctcaaggtcgatagtatgcatgcgtccatccaagggacctgtgtccatgacacggtgcagtttcagcacccctttgttcccctgttgagcctaccgttctttacctcgcaagtaccaggagtgaaaaaaggtttcgttgcaatgagtacctggattcccccatgtagagaatatctatcgcaggatccctgttgattccttagcaacctgggtgttaaatacgcgaccactatgtacttcgcatacatggggctaggatcctctgttaaccggcatatataaatcccacaaagtagaactactcacttgctgatttaggcagccacgaagaatccgttccatctgccccgtactctaggtaacataggttggtgattgggatctagtggaactttacgccctaatttatttggtcccctattgatttgcccagacgtgtgtgcctgattactagcctcaattgcatgccaaacatactctggctccaacctacgaagagcatggtcgaataggcagtgcttttccagtcccaaccacaattccagcaaatgcctaatatggatatcgtgagaatggctcgaatcagggcacctgggattcaggaaagtctgcccctttaccctttctttgcatgctggcccacgggaagtaaccgtggcgtcttggctattgcgaagctcacttactcctgaacga

SEQ ID NO: 637399 - DNA, 711 bp, Homo sapiens
  misc_feature (51)..(51): n is a, c, g, or t
  misc_feature (98)..(98): n is a, c, g, or t
  misc_feature (114)..(114): n is a, c, g, or t
  misc_feature (130)..(130): n is a, c, g, or t
  misc_feature (223)..(223): n is a, c, g, or t
  misc_feature (232)..(233): n is a, c, g, or t
  misc_feature (243)..(243): n is a, c, g, or t
  misc_feature (246)..(246): n is a, c, g, or t
  misc_feature (259)..(259): n is a, c, g, or t
  misc_feature (476)..(476): n is a, c, g, or t
ggtaatgcttaacccagttacacaggatgccgtcttgtgtttcctcttgtntagttacccactacagtgattttgtgatctgctaatgggttgccacncacaaccattgctttngcacttttacttcaantcaatgaaggattgataaaagttctcctggtgtctccgcagagtgccttccaggaacagatctttgcatagaatatcagtggtttcctttttngtttcaaannagtggtcagnaanatacccacgtgcnttgactcagcgcaaggcaactccacgcttcctctttatccgcttttttattcgttctctctctctgttacacatttctatattttctgctttattttattttcattttatttctttgagacggagttccactctgtcgccaggctggagtgaagtggtacaatcttggctcactgcaacctccaactcccgggttcaagcaattctcctggctcagnctcctgagtgctgggactacaggcgcgtaccttctttagtagagactgggtttcaccatgtcggccaggatggtctctatctcctgaccttgtcgatctgcctgcctcagcttcccaaagtgctgagcatgacaggtgtgagccatcagacccagcatttttcctctccactcttccatttaaattttttccattttctctgacacgcgtcatatcggtccggtaacggtagccg

SEQ ID NO: 637400 - DNA, 164 bp, Homo sapiens
aggctcagataaacgatatatggaggtcagcacgatgctcacgtagtacgacggaacttgtacagggaggcatgcaccgcaatgataaatacacgtactaccaggatccatctatacgtatataaggagatacagcacggttctcacgtatagacggaacttgt

SEQ ID NO: 637401 - DNA, 237 bp, Homo sapiens
aacgggtgatgcggttgcagtgagccgaggtcgtgccacgcactccagcctgggtgacagagccagactccatctcaaaaaaaaaaaaggtggagtaggttgttcatcacagagctgaaatttaaaccaggccgtttagctccagaggctggggtcttaggcccagagtctggccatcaggggggggctcctaagtagtcagggagcagaaggagggattgagacctgggagggaga

SEQ ID NO: 637402 - DNA, 264 bp, Homo sapiens
tactgtggccccctcgagctcgacggtatagataagcttgatagtcaggagtacaagaccagcctgggcaacatggtgaaaccccgtctataccaaaatacaaacaagttagccaggcacgatggcaggtgcccgtaatacccagccaactcaggaggctgtagtacaagctaatacgcttgaacctagggaggcagaggtagcagtgagccgaaattgtgctattgcactccagcttgggcagcaagagcgaaactccatctc

SEQ ID NO: 637403 - DNA, 895 bp, Homo sapiens
  misc_feature (460)..(460): n is a, c, g, or t
gaggctggcaactcccggaacaacagccacaaccactcaggagcaggagcggcagcggcgacggcggcttgcagaccgtccgccagccccgcattccccacacgtcacctgcccgtgtcccgtgagagagcggacgagcaaggggcgcgagggagcgaagcagaacgtggcggacggtcggtcggtcttggtacttagatcagggtcaccgcttgtcgatgtacttttagtgctatggaggttttgtaatggtataggatggacctaagcgtgtctgtctactcggcatgtaccctctcgtgacctggtcccgtgtcgttgtatgttgtgtcaagtagttttctagcctgcacgcggtcctttgtgttctactgggtagagccgtctgccagtacttttaccctattacgccataccatttgtgatcccgcgtcatgatcgtctagggtggcctactcgnagtcttacacttaacaaaagatctttctcccattgacttgacattccctccatggctcttctccactcgaatagcttgggagccacctttcgttcgaccttgaatctcgcacgcgtcgatcgctcgagtctccgtaacttttctaccatcatttttgcttcacctagtaagcgtagccatggttgcgcgatcgacctttgtgcttgaactttgctagtatgcagttttgcttccttcggggccaacctctcctttcctggtgcgccccggtcagcgtgggaccggttcacttgccacttgctaggtccccccccgctgcataggttcttcgagtttgaccggggcaccgcctttcggatgatatggtgcctactcctcgcgggggacccggaatgcatctgtcgcccttgtcttacgttgggccggtgccgtcgc

SEQ ID NO: 637404 - DNA, 816 bp, Homo sapiens
cctgtgagaaaacactctcacaagctagtgtaactagtacttcatctgtacagaggaatagtctacaaaagaagactggtgacctggagaagagagctgtcatttactccatcctttatagtgatgctacgggacagaagaaggcaatggataatacacgattggcgagcaacgcaatctacagcggtatgaacgccttcctggcaggcatgcagtggagtacgagatccttgcagaaacaaggatattacgcgtcataatagacattgagaacatatcgagcagagaatacatgaacaactaggaacagatgctcaacttgagactagactagtgtcttgacacatgctacatacatcatcgagctctaacgtatgctatgttagaatgtgccactccgagacgatagacaatttatatggcctagcggttcccgtctgccttatggaatagacatgttgacaagcagaagacaagagatatattgagaactctctggatgcgatgctcgagcgaagaataagagtgatgaacagggaattgggccaaaggagcaccacaaagctcctcaagaggtgcttcacgagaagaccaacgcagggattatcgtaaccttcgctatgaaataaaggaaagaactatcagggccaacgaaggttccttggggccaggatccccttgggtcatccagttgaaagaaggggggataagtgatagtaaggacgtggactcatactggaggattcgtgataaggacaggagaaacatcagtaccacataggggctttgtgctggccaaaagaccgagagatgacc

SEQ ID NO: 637405 - DNA, 240 bp, Homo sapiens
agtgctccagtctatacgatatttggaggtcagcacggatgctcacgtgtcgacggaactatgtacaggaaggcatgcaccgcagtggtgaatacacgtcgaccaggctccatgtatgcgtgcttgggtggtgagcacggagctcatgtatctcaaggagctggtactagggaggtatgcaccggcagtggtgaatacacgtcgagctggaggcatgcatgcatgctcgggtcactgaac

SEQ ID NO: 637406 - DNA, 111 bp, Homo sapiens
cgacccagttcagcaatcatccagcatttgcagaaaaccaatcacgcagctgcggtgctggggctgaccgacacgccctatcgcctgggcaaaggctggatttaccagtat

SEQ ID NO: 637407 - DNA, 161 bp, Homo sapiens
attccgacattgctagtattcgctgctcagcatagaatatctgcaatgggaaaatccaagagtaataccttcgaacaacaagaggaattcagtctattagaggagcgtgtttacactgtctcaggtcgagtaatcatcgcgccgtgagagaagaacaagtg

SEQ ID NO: 637408 - DNA, 162 bp, Homo sapiens
cgccatagcccgacagatttggtagcaaaatggggcacttgaaaccattatgctagctgaaccacctgggtgcagactagtgcagagtgtacgagcatatgccagctgatctctgggtagcccagtgtacagtaatcccgtgctctagttgtgtaccgtcgt

SEQ ID NO: 637409 - DNA, 186 bp, Homo sapiens
ccttccccccgccccccccctttttttttgccgggttgcctgaggggggaatgcgggagggaggggggggggccgggggcggggggcggggggccgggggcccggggaggctgggaatgctgcccccctttgccattttttttttttttttttttgagagagggaaaggaaaaggccgaaacctta

SEQ ID NO: 637410 - DNA, 348 bp, Homo sapiens
caagcacagcgtttatatggggttgactgagctcgtgtaatatgtggatctctcttaagcttagtgccttcagttcggttggtgctcatatctcagaccttgtaaacggtggcctgatagatagaaagtagaaccgccatgagtcgatggaaggatcagcgtgtccctggctgcattttaacatgtcgcgaaacacagagtagacagtgtattagctgcctcccgccagcttcaagcgtgcagcgtcagtctgggtctggctccaggcagcttgtcagcgatgatagcctccgcatgtattcaccctcaggatgtaaagcatgcgcagcaagtgtgtgtgcgcggtct

SEQ ID NO: 637411 - DNA, 211 bp, Homo sapiens
ctttggatctgatgatgaggaggaaagtgaagaagcatagaggctatgggaagaatgtcttgcacaatatgaatcaaagaaagccttaaaacctgtacttgttgcccagtcttccatcttactagatgtgaaaccttgggatgatgagacagatatggcgagattagaggagtgcgtcagaagcattcgagcgaaggcttagtctggggct

SEQ ID NO: 637412 - DNA, 151 bp, Homo sapiens
cctccaggtctcctgatgcatttacattctaatttccaattgaaagtcaagaggctacaaggaagagtgaatggaggagagaatgcagaaggggtaatcagtgttggaattgaggagttaaaaggtctggagagtgcgtaggggtaggacg

SEQ ID NO: 637413 - DNA, 557 bp, Homo sapiens
ccgaggaaaaggaaatagatcaggtagggccttagtaagcatgcataaaggatttggatttatcctaaactcagatgagaaagcatctagaagggtaaggtggggtaggatcagtgtacatgacctatcagatttgcctacttattaaaggcttttatgagccatataaaaccattgtagcttttaaaacagaaaaaggaaaaaaacaacaatagttgtctaccccattctttcacctgactaaatcccagcactataaccaattggtgtacatcctttcagatttttccctaggaatatgcaaacacgaatttaaaaacgtgtgtgtgtgtgtgtgtgtgtgtgtgtgtgtgtgtgtgtgtctgtgatatatatgaggtatattgtgttgtgtagagagacaggctctcactcttatgccgaggctagagtgcagtggtgctcaagggatccttctgtcccaatatccccaataagtgagaatatggacatatgctaccatgcctggctaatttataaatatctcttgtgtagagatggggtcttgctacaaatag

SEQ ID NO: 637414 - DNA, 632 bp, Homo sapiens
gaggggccccccccaaagggtggctccggtctctttcccgagaggaaagcttaaaggctttcccgttgtggggtgaaggcgcccctccaacgtttcaattcccgcgcggagcttatgcccccgcggtcctccggcatgcgcccacagcgcgcgatcacacttcggcccgcccccacttgggccttctggtttttccgaggtttcgccctggcattttatacttcggccctcacttttctgccaccgacacgaatagaaggttaccaccttcccggaaggaataagatccatggccctcactttaagcaccccgcgtggtaaatgtttgagccctttttggccctgggcttggtttgcccaaggccctggccacaacgctcaaacacttgggagaccctcactttgccacaatgtataggggccggtgagcctgctccacgcacgctgtgtgctgcacccaaccacggaaggtcctgcccccctcacactgctgctgctccacgctgaaggaagaaagaaaagtggaacgccaaagaaaagaagaatccgaggagtctgatgatgacctgggctttggtctttttgactaaacctcttttataacctggtccaataaaaagctggacctttta

SEQ ID NO: 637415 - DNA, 529 bp, Homo sapiens
  misc_feature (15)..(15): n is a, c, g, or t
  misc_feature (70)..(70): n is a, c, g, or t
  misc_feature (87)..(87): n is a, c, g, or t
  misc_feature (107)..(107): n is a, c, g, or t
  misc_feature (239)..(239): n is a, c, g, or t
  misc_feature (274)..(274): n is a, c, g, or t
  misc_feature (342)..(342): n is a, c, g, or t
  misc_feature (355)..(355): n is a, c, g, or t
  misc_feature (388)..(388): n is a, c, g, or t
  misc_feature (402)..(402): n is a, c, g, or t
  misc_feature (522)..(522): n is a, c, g, or t
  misc_feature (527)..(527): n is a, c, g, or t
taaccctggaaatangaaggccattggaatttcccggggttattaatatggagattttcaacccttgaantgtttttttgcttctgnggaaaataatttggggattnttcagtatttgtagtagtttgatagaaataatgaggaaccatattcattttaggcattgtttatatttgaagttactgagtttgaggaatggcaaattaaatttgcctaacccccaaaacaaatgaaatatntcaattataaaagcaacatggccgggcacggtggntcaggcctgtaatcccagcactttgggaggctgagcaaggtgggtggatcacttgaggccaggagttngagaccagcttgnccaacacggtgagaccctttttttactaaaaanacaaaaattagccnggcgccccattgtattcccagttattcaggctgaggcaggggattcgcttgaattgaggcagaggttacagtgagtggagatcacgcccactgcaattccagtttggtgacagagtgagnccttntc

SEQ ID NO: 637416 - DNA, 832 bp, Homo sapiens
gacagtgattcggccgccgcgccggggggtgggggggctgcgcgggacttttttttttttcagactgaccgcggggcagctgcggagcttgtcgaccccggcccggaggaggctcatgcgggatttcaagcggttacaagaggacccacctgtgggtgtcagtgggcgcaccatctggaaaacaacatcaatgcaggggaatgcagttatattgggaccagaggggacacctttggaagatgggtacttttaacactagtaatagaatttctctggaagaatatccaaataaaaccaccaactggttaggtttttatccaaaaggttttcatccaaaggtgtatgctgatggtagcatatgttaagatatccttcagaatcgagggagtccacatatgaggtatcttctatcttaacatcaattcagtctcggtggatgaaccggaatcttaaagtccagccaatagccaggagcacagttttatcaggaaaacaaaggagaatttgagaaaagagttcggcctttgttgaacaaagctggattgattcataatagacaagtggtctgttaagtcttttccatcattgctggtatactttaccctctcattagaaggttaacaacttttagttgcacaggtttacggatttgagaacaaaacgaaaaaagtccttcagttagaactaaaaggtgtgttttggataaggcttacatggctggggactagtttggctattggaatatctgttgctttccaggatgggggggagtagaaaaattcattggaatcgctctcattgagctatgatctgattaggaagcaggtttgaa

SEQ ID NO: 637417 - DNA, 133 bp, Homo sapiens
tcggttcggaagcacacggaacatacactaggggaatcctctatagcactctagtaccttgcagaaagagagccctgctcttcaataataggaactatccaaaccctatctacccctaccatatggagaggat

SEQ ID NO: 637418 - DNA, 142 bp, Homo sapiens
  misc_feature (2)..(2): n is a, c, g, or t
gntcttttaagcctcgaggcacgcgcaagacttacccgccagtcgccctggcaggcagtacaacacagaaggcatagtgcgtgctatgcttatgttccgcacgaatcgcgtcaaaacgaaaataacaagcaaaagacaaagt

SEQ ID NO: 637419 - DNA, 520 bp, Homo sapiens
  misc_feature (56)..(56): n is a, c, g, or t
  misc_feature (59)..(59): n is a, c, g, or t
  misc_feature (90)..(90): n is a, c, g, or t
  misc_feature (155)..(155): n is a, c, g, or t
  misc_feature (191)..(191): n is a, c, g, or t
  misc_feature (203)..(203): n is a, c, g, or t
  misc_feature (206)..(206): n is a, c, g, or t
  misc_feature (248)..(249): n is a, c, g, or t
  misc_feature (275)..(275): n is a, c, g, or t
  misc_feature (395)..(395): n is a, c, g, or t
  misc_feature (465)..(465): n is a, c, g, or t
  misc_feature (480)..(480): n is a, c, g, or t
cgtaaggcgaaagatgacaaattataacctaagcataattataggatggactaacnccnataccttctgcatatgaattaactagaaatnactttgtcaaggagagcctaacagcataagactccccgataccagacgagctacttatgaacagntataatagcacacccgtctatgtagcataatattgngaagatttatangtngaggcgacaaacctaccgagcctggttatagctggttgcttnnctatgaatcattagttcaactttaantttgcccacagaaccctctaaatccccttgtaaatttaactgttagtccaaagaggaacagctctttggacactaggaaaaaaccttgtagagagagtaaaaaatttaacacccatagtnggcctaaaagcagccaccaattaagaaagcgttcaaacccactccaccttactaccagacaaccttagcnaaaccatttacccanataaagtataggcgatagaaattgaaacctggcgcaatag

SEQ ID NO: 637420 - DNA, 550 bp, Homo sapiens
  misc_feature (56)..(56): n is a, c, g, or t
  misc_feature (59)..(59): n is a, c, g, or t
  misc_feature (90)..(90): n is a, c, g, or t
  misc_feature (155)..(155): n is a, c, g, or t
  misc_feature (191)..(191): n is a, c, g, or t
  misc_feature (203)..(203): n is a, c, g, or t
  misc_feature (206)..(206): n is a, c, g, or t
  misc_feature (248)..(249): n is a, c, g, or t
  misc_feature (275)..(275): n is a, c, g, or t
  misc_feature (395)..(395): n is a, c, g, or t
  misc_feature (495)..(495): n is a, c, g, or t
  misc_feature (510)..(510): n is a, c, g, or t
cgtaaggcgaaagatgacaaattataacctaagcataattataggatggactaacnccnataccttctgcatatgaattaactagaaatnactttgtcaaggagagcctaacagcataagactccccgataccagacgagctacttatgaacagntataatagcacacccgtctatgtagcataatattgngaagatttatangtngaggcgacaaacctaccgagcctggttatagctggttgcttnnctatgaatcattagttcaactttaantttgcccacagaaccctctaaatccccttgtaaatttaactgttagtccaaagaggaacagctctttggacactaggaaaaaaccttgtagagagagtaaaaaatttaacacccatagtnggcctaaaagcagccaccaattaagaaagcgttcaagctcaacacccactacctaaaaaatcccaaacccactccaccttactaccagacaaccttagcnaaaccatttacccanataaagtataggcgatagaaattgaaacctggcgcaatag

SEQ ID NO: 637421 - DNA, 175 bp, Homo sapiens
ctaagcgtttggagagacgactgtatttgaaggggctcccatctgtctactcttggatctggctcatggctttgctggggtgatcctcataaagaaggctggagatatgatccaaagaagcatccaaaggctgctagggattcccatcccacggtgtgtaacaaggtgccaggca

SEQ ID NO: 637422 - DNA, 805 bp, Homo sapiens
gattttgcagacgcaccgccgagaaaaaccgtgtactattagccatggtcaaaccccaccgtgttcttcgacattgccgtcgacgggagcccttggtcggcgtctcctttgagctgtctgtggacacggtcccattaaagacagcagaacattttctgtgctctgagcatctggtggagacacggattcggttataagggttcctgtcttgcacagcaattgattccagggttgatgtgtcagggtggtgacttcacagcgctcatatagtgcactggtgcacatgtccatctatgcggagaatttcgacgactgagaacttcaatcctaaagcatagggttcctggctattgtgtcaagcggaaatatgtggaccaagaaaggtggttccgagtttatcatctgacatgccaatacgtgagtgtgtgtggatggcaagcatgtggtgtaggcaaagtgataagacgggtgaatagttgtggaggccgaattggaagcgcttgggtccaggactggcatgactagcaatgaagatcaacgattgctgactgttggacaactcgagtaacgttcgacttgggggttcaatcttgaagcaccagatttattccttctgtacgctcagggagagcaccctccaaccaattggtccgcagtacctagaaatctagtgccctcgtgaagtccttgggatcaatgttccttgtcctccatgctagtggttgagacgcgtcctgctctgaaacacacacggcagaacaaattggggtccgcaaaaattaacaatgtggcgcccagagaacgc

SEQ ID NO: 637423 - DNA, 193 bp, Homo sapiens
ctagctcaatgttttggagtgaaaggagcttgaaggtcatagttagctatgccagggttctcctggcctcatgtcagatacaggtcctaactcccaagcagcctaccatagtgtcctccttttttttgcgtgtgtgaagtggttacgcactaatagaccaggttgtagtgcaatggtgcaatctcgagctcac

SEQ ID NO: 637424 - DNA, 1054 bp, Homo sapiens
  misc_feature (327)..(327): n is a, c, g, or t
  misc_feature (332)..(332): n is a, c, g, or t
  misc_feature (454)..(454): n is a, c, g, or t
  misc_feature (995)..(995): n is a, c, g, or t
  misc_feature (1054)..(1054): n is a, c, g, or t
tccccttccgccatgattgtgtttcctgagactcccagccacgcttcctgtacagcctgcagaactgtgagtcaaccaaacttccttttaaaataaattacccagtctcagctaggtctttctagcagtgtgagaacggacacgtagagggtgtgagagccagaagactttaaggagagggacgagctggggcctggatgcccggggaggtggacctggaccaggacaggtgtcagcgggcagagatggggcagaggtgtggctgtctacctgcgaccggggccatgccctctcgggctcggttgaggagctgctcttcctccagangcgcncggacggaacgttaggaaggccctggtgagtggccccgacctcctcccccaggactggcttctccggccctctgccctttcgggcagaacagctcgtggctcttccaggacctggggctccntcttgcagaacagctcgtggctcttccaggacctggggctccatcttgcagaacagctcgtggctcttccaggacctggggctccatcttgcagaacagctcgtggctcttccaggacctggggctccatcttgcgaacagtcgtggctcttccaggacctggggctccatcttgcagaacagctcgtggctcttccaggacctgggggctccatcttgcagaacagctcgtggctcttccaggacctggggctccagtcttgcagaaccagtcgtggctcttccaggagctgagggctccatcttgctgaaggggtgcttcttgagactccttagggacgattctgattttccctggagctgtacaatggcggtctatctttcaaggtcccctgggcctgggctccgaggtagccactttccctggagcccgtgaaggaggtttggacgccagctgggctgcctgcctgtggcggggcaggaatgagagctggtgcggctggggcccctgggtgcctggtcctgctctcatgacgcccancccttgaaacctgacatgggcgccgaggattctcccgcaggctcgagattcactgatcn

SEQ ID NO: 637425 - DNA, 878 bp, Homo sapiens
  misc_feature (327)..(327): n is a, c, g, or t
  misc_feature (332)..(332): n is a, c, g, or t
  misc_feature (454)..(454): n is a, c, g, or t
  misc_feature (819)..(819): n is a, c, g, or t
  misc_feature (878)..(878): n is a, c, g, or t
tccccttccgccatgattgtgtttcctgagactcccagccacgcttcctgtacagcctgcagaactgtgagtcaaccaaacttccttttaaaataaattacccagtctcagctaggtctttctagcagtgtgagaacggacacgtagagggtgtgagagccagaagactttaaggagagggacgagctggggcctggatgcccggggaggtggacctggaccaggacaggtgtcagcgggcagagatggggcagaggtgtggctgtctacctgcgaccggggccatgccctctcgggctcggttgaggagctgctcttcctccagangcgcncggacggaacgttaggaaggccctggtgagtggccccgacctcctcccccaggactggcttctccggccctctgccctttcgggcagaacagctcgtggctcttccaggacctggggctccntcttgcagaacagctcgtggctcttccaggacctggggctccatcttgcagaacagctcgtggctcttccaggacctggggctccatcttgcagaacagctcgtggctcttccaggacctggggctccatcttgcaggggtgcttcttgagactccttagggacgattctgattttccctggagctgtacaatggcggtctatctttcaaggtcccctgggcctgggctccgaggtagccactttccctggagcccgtgaaggaggtttggacgccagctgggctgcctgcctgtggcggggcaggaatgagagctggtgcggctggggcccctgggtgcctggtcctgctctcatgacgcccancccttgaaacctgacatgggcgccgaggattctcccgcaggctcgagattcactgatcn

SEQ ID NO: 637426 - DNA, 504 bp, Homo sapiens
  misc_feature (226)..(226): n is a, c, g, or t
  misc_feature (253)..(253): n is a, c, g, or t
agaggacccacactggtcgagtcagcatgtaagaggtatacagtccatactcctgtctctctaggctgataatactgcaacttcatgtagctcagactgtctgagctattttctttctcagaacagtggtagtcgtctcaaaaatgttactggaaaaattgtgccatccatattaaaaaatagaaatcttacctatacctcacaccatttataaaaattaactcanagtagaccctatatctaattgtaaaanctaaaactctaatcaaacttttatcaaaaatcatagaagacattttttgattgtaggctaagcaaagtttttttacagataggacacaaaaaacataaaccataaaagaaaacataaataaattagacttcgttgaaattaaaatgttctactctttgaaagtccctgttaaaataagacaagtcaatattggagaaaatatttgccaaaaaaaaaaatctgataaaggactaatattccgaatatttaac

SEQ ID NO: 637427 - DNA, 116 bp, Homo sapiens
ggaaggccctgcgcacgcagctggacctgcgcaggttccgaatctattccaaccattctgcactggagtgggtggctctgaaaccattacaggcccctctggagaccatgctgcaa

SEQ ID NO: 637428 - DNA, 191 bp, Homo sapiens
  misc_feature (33)..(34): n is a, c, g, or t
gatagaaatttataaaattcagtgtatattatnntttaatgtgtaaatgaaactggatactaaaggctagtattatcataaagggtaacttaaaaaccactgagtgaactgatgataaatagtttgacacactatatttttaataatgagggttaaattaaaaggttaaatgcaagtgtagaactaaattt

SEQ ID NO: 637429 - DNA, 230 bp, Homo sapiens
  misc_feature (99)..(99): n is a, c, g, or t
  misc_feature (104)..(104): n is a, c, g, or t
tgtagtcccagccctttgggaggctgtggcaggaggaacacttgagcttaggagtttgagatcatcttaagaaacaagagtcctcctcttcgggtttgnaaaanagaagggatgaatacttatttatttttgcttttaacattatttactttttttctttttttttgggacggccttgctctgttgcccaggctggagtgccgcggcccgttctcggctcactgccgcct

SEQ ID NO: 637430 - DNA, 105 bp, Homo sapiens
ccaccaaccttactaccagacacccttagccaaaccatttcccaaataaaggtattggcgatagagatttaaccctggcgaaatgaattttgatccgtaggggaa

SEQ ID NO: 637431 - DNA, 235 bp, Homo sapiens
ggtttatgcagtgttatatatgggggccctcattatgccaactgtattaagggggttccatcggtgtgtgggccctcatcaggctaccacgatatacaatgagtgggatacttaagctcttgctgaattgtgtctgtaatgtaatctgactcaaggagaacaaatggagaggggctttgtcattctactgtgtcatgtgaatggcgtctgggtctggagtctaagttgtactgtg

SEQ ID NO: 637432 - DNA, 1034 bp, Homo sapiens
gtgaaggcaccgcacgtggtattgtatgtgtacactggcggatcgcactgtgatgggaagaattgccacacttgcttctgggctggaaggaggccagacccccattgctgcccacacttgacacattttatccacatcatcacgggctgtggctgctgtcctgggctgtgtcttccttcatccttcctctcatccttgacgtacacctggcttgcaggctgtccactcttcctcatcggctcctcatcgtacccccatgctcgccggcacacggctccgcctggccacttgtcacggctctgctctggaccccttccctggccataaccgcactggcccaccgcgacccccccttgtcccccctgcacagccccccttccccccccccttgctggcaggccccctaatggcgctggtcccaccgacatctcaccccactccttgcctccgtgcactaccacaacccttgcgcacacctccttgacgcctccaagaaaaccccgcgaccttgcccccacccttgccgcacccccaccccacttgcctccgcgattctcggcacccaccaagtcccaaacaccttccccaactgccaaacccccttgcgaatttaccggaaccaatgaacgcaaaaactccacccgaccgccttgcggcactgcgcatccataccgaacttatcatgtgtcaacccgtcgacgccaaccgctttctcgcacgccccttataaagcccctttgcggggcctctatgctgccacctccttagggcttacccccatgcgacaccatttctcggcccaagcgtgcattcccatactcagggcctcaacacccagaacgcacggctaccccacagccccggaccccgacactcccagccgcggcccgtatcaaagcccccaaggaccgccacccaaacacacgccctctaagccccccctaaacgataccccgctcgacgcacacggcccgaagagcacccacagggagtcggggccaaacgcggcaaccggcaactagggcccccatatc

SEQ ID NO: 637433 - DNA, 585 bp, Homo sapiens
tctccaagggcaaccatagacatcctagagtgatgtgcagctgatcaagactggagacaaagtgggagccagcgaagccacgctgctgaacatgctcaacatctccaccttctcctttgggatggtcatccagcaggtgtacgacaatggcagcatctacaaccatgaagtgcttgatatcacagaggaaactctgcattctcgcttactggagggtgtccgcagatgttgccagtgtctgtctgcagattggatacccaactgttgcatcagtacaccattctatcatcaacgagtacaaacgagtcctggccttgtctgtggagacggattacaccttcccacttgctgaaaaggtacaaggccttcttggctgatccatctgcctttgtgctgataccccattgctgctgccaccacagatgctactgtgcagctgcagccccagctaaggttgaagacaaggaaaatcggcggagtcggaagaagatatgggatttgatctctatgactaatcaccaaaaagcagccaacttacccagttttgtttgcaaaacacacgacataaaggcttacttctttaca

SEQ ID NO: 637434 - DNA, 127 bp, Homo sapiens
ttctccgggttctccctccatagccgctgtctgtgtccgtgtcgctgccgctctgctcgcagtcgagtgagcgcccgtccgcgtgctgactggcacgcagtttttcccaggacctttctgaaccctg

SEQ ID NO: 637435 - DNA, 150 bp, Homo sapiens
acgggacggctagcgtgcacttccatttgggcctccatcttcactgcctgggacggctgcttctcagcactggcctgcgagtcatttctgtgctactagtagatggaggatttcgatacctgtccttcaatgcttacagctggctgggca

SEQ ID NO: 637436 - DNA, 919 bp, Homo sapiens
  misc_feature (28)..(28): n is a, c, g, or t
  misc_feature (75)..(75): n is a, c, g, or t
  misc_feature (88)..(88): n is a, c, g, or t
  misc_feature (144)..(144): n is a, c, g, or t
  misc_feature (217)..(217): n is a, c, g, or t
  misc_feature (265)..(266): n is a, c, g, or t
  misc_feature (285)..(285): n is a, c, g, or t
  misc_feature (308)..(308): n is a, c, g, or t
  misc_feature (339)..(339): n is a, c, g, or t
  misc_feature (383)..(383): n is a, c, g, or t
  misc_feature (387)..(387): n is a, c, g, or t
  misc_feature (426)..(426): n is a, c, g, or t
  misc_feature (452)..(452): n is a, c, g, or t
  misc_feature (496)..(496): n is a, c, g, or t
  misc_feature (501)..(501): n is a, c, g, or t
  misc_feature (503)..(503): n is a, c, g, or t
  misc_feature (507)..(508): n is a, c, g, or t
  misc_feature (513)..(513): n is a, c, g, or t
  misc_feature (518)..(518): n is a, c, g, or t
  misc_feature (527)..(527): n is a, c, g, or t
  misc_feature (543)..(543): n is a, c, g, or t
  misc_feature (582)..(582): n is a, c, g, or t
  misc_feature (609)..(609): n is a, c, g, or t
  misc_feature (612)..(612): n is a, c, g, or t
  misc_feature (616)..(616): n is a, c, g, or t
  misc_feature (618)..(618): n is a, c, g, or t
  misc_feature (675)..(675): n is a, c, g, or t
  misc_feature (717)..(717): n is a, c, g, or t
  misc_feature (736)..(736): n is a, c, g, or t
  misc_feature (788)..(788): n is a, c, g, or t
  misc_feature (798)..(798): n is a, c, g, or t
  misc_feature (800)..(800): n is a, c, g, or t
  misc_feature (803)..(803): n is a, c, g, or t
  misc_feature (808)..(808): n is a, c, g, or t
  misc_feature (810)..(811): n is a, c, g, or t
  misc_feature (819)..(819): n is a, c, g, or t
  misc_feature (825)..(825): n is a, c, g, or t
  misc_feature (891)..(891): n is a, c, g, or t
ttgtcaaatattcctcattgccccagancagtgttttttttatttctatgcaaaagtatgccttcaaactgcttnaatgatatatganatgatacacaaaccagtcttcaaatagtaaagccagtcatcttgcaattgtaaganataggtaaaagattataagacaccttacacacacacacacacacacacacacacacacgtgtgcccgccaatnacaaaaaacaatttggcctctcctaaaataagaacatgaagacccttnnttgctgcgaggggggaacnctgtgtgacccctccctacaatncaggtagtttcctttaatccaatagcaaatntgggcatatttgagaggggtgattgtgacagcgacgttgaaatnctgnggggaaccattgatgtccacccgctggtgcgctgaaaanatgccaattatttttcgctcccactnctgctgctgtttctcccacatcctcacatagaccccagagccgntggcncntggnngggcntcgcnttgctggtngagctagtgataggtntcgtctttgacgtcacagagcgcgatagaccatattgcntgggcggtcattgtgataaccagagangtnaatncngccccctggcagccgcttagcaggagggctcaccccaatcttcataaattttctctngtggggctttttgagtcccaggagggcataatcataatccangccgatgttattggcattncccttgaaccaacccttgggcacatgggtgcgtatcacccggatccactganatttcatctncncgngcatngnngacgtcgngtcgtnggcccctcgaccaccatctttaaacttgggcttgaggaagccactcgaagcttctgggttcctttnacataggtttttccatcgtgtatgccgt

SEQ ID NO: 637437 - DNA, 236 bp, Homo sapiens
gggccttcacagacacagcattgagcattatctttaacaggcaggaggaacactggtgtatattaatttatgacacaggatcattatagggtaggccagctggtgttatggcatgcaggcatatgtatgccaccatgagggctggaagaaccagaagccaaagaagaatatgaccgcatctattctaaagctactgtggtggtttctcatgcttcagagtctcgtaagtctcctgg

SEQ ID NO: 637438 - DNA, 274 bp, Homo sapiens
gtaaaacccagcccatgacccctaacagggccctctcagccctcctaatgacctccggtctagccatgtgatttcactcccactccataacgctcctcatactaggcctacttaccaacacactaaccatataccaatgatggcgcgatgttaacaggggaagcacataccaagggcaccaaaaacaccttttccaaaagggccttcgatacgggataatctatttatacctcagaggttttttctcgcagattttctgagctttacactcagc

SEQ ID NO: 637439 - DNA, 818 bp, Homo sapiens
  misc_feature (818)..(818): n is a, c, g, or t
gacgagctgtctcgccgagcgcacgcgtgtccggcgcccggagaaatgcttcggttacccacagtcgtttcgccacgatgagaccggtgtccaggtactggctcctcatctcactcgggctttatgccaaagatgtagaatctctgggtgcatgatgcccgagcctttacatgcctgtgaagggtgtcacgacccttttagaccgagtgctgtggccgcttgacgagtggggccaaagggacagaacagctgattatggagcagaggtaggggaagtcccaaagtaactaaaagatggtgtgactgttgggagaaggtcaagggagcttaaaaggataatatacgaaagatacatgggagctaaacgttgtctcgaagagtgttgccaataagcgagaaatgaggaagactgggcgaatggggactaccgactgactactgtagctggcagcggcatcgtagtagtccaaggagagggcttgcgagacagattaggcaaaggtgactaatccagtggaaatcagagacgagggtgtgatggtagctgttgactgctgtcattgtgctgagattggaggaatgtcaggtacataaaacgcttgtggaacgcctcctgaaacaactggccccaagtgccgcattacggcagactcgtggcggaaaccgcgtgcgacccatgggcacaaactgggacgagcatcctacagatctcgggggacgtggccttggaggcgccgaaagttgggaaacgcagagcgtgagtacaacactgggcgccaagaggggttggacacaaacacgggaagggagcagaaacn

SEQ ID NO: 637440 - DNA, 192 bp, Homo sapiens
  misc_feature (4)..(4): n is a, c, g, or t
  misc_feature (29)..(29): n is a, c, g, or t
  misc_feature (46)..(46): n is a, c, g, or t
aatntctggtaccgtttggaatccatttnggaaagaattcaccctnaggtgaggctcctggcagaagatggtgactggagtgccagtccctgtcctccagataccactgagctcactcccatgatgcagagctttcaaggataggctttattctgaagcaatcaaataataaatctattctgctaagagaaa

SEQ ID NO: 637441 - DNA, 118 bp, Homo sapiens
ctgtcacccgaggctatgagtgcagatggctgcgatctcggttcactgtgaagctcggcctccagggttcacgcaatactcctgactcaggctctcgagtagctggtactagcagtac

SEQ ID NO: 637442 - DNA, 188 bp, Homo sapiens
ttagaggaccctgctgcttgactattgttgtttttaaataatgtcacattcaagctctagcgtctatggctagagattcctaacgggtaatatgcatcctttccccttgtacttaacctgtgtttgcattccagatcagtctgacactctccaatagaaccaaatacatttcgtatgaggcaacacaa

SEQ ID NO: 637443 - DNA, 114 bp, Homo sapiens
tggagaaatgctatgcattggctttggagtccaggactgctcatggtaattgcacttgttgtgtttgcaatgggaagcaaaatatacaataaaccaccccctgaaggaaacata

SEQ ID NO: 637444 - DNA, 248 bp, Homo sapiens
aaggagcaaacagacgaaaagacagcaaagagcacaagcaagagaagcacaacacacagaacaaacacaagcacaaaagtaaacaagagacgacgaacacagaaaagaaaaccaaacaacaaaagaaccacacacgaacacaaggagagacaacaagcagacagcaacagaaaccagacaaagacgaacagagacagaaagacgaacacatctaaatagagacaccacacgacagaacaacacagaca

SEQ ID NO: 637445 - DNA, 833 bp, Homo sapiens
agccccctgccgggggggggggtcataaagacacaacgagccttcctttgtgttggtcccccgccttccgtccgttctgctgggttgaggacgcccgcccccgccggtggttgtctcccccccgactaagaacaccgccgcgggggcagtgctttcgccctcccctcgcgcgtgattttgtactttattgcgtccgccggcgggcggagtgatcaatgcttcttctcccacgcggcgcgcagtcctgttggtccacctctcgtggccgctctgttgtatgtgggtgcccacctagtgcatgcacgatggtgtgtgtccaccaaataacaggaccgccggggttgggttcgcgctcgctcgcgcgcgattttctctctgcgcgagtagttttgttgccgcccaccccgcgctcgcgcgcgctgtgtttttgcaccacctggatctgtttgtctccgcgccctcctccacccacccatgtgggtgcgacgcgcgactgctttttctcatgatgatcttgggggaggcgtcgtctcactcagttgacgatgctgccgcccccctccccccagggatgtttgtcgtcgcgtcctcatcgctgctttgttgccggctcgctcttttgtagtggcgccctgacgacaccatcccgtcctcctcttttttttttctcggccggggggtgcttccaccaaccccccggctggtggtaccccccccccccctctcggtgggtggtattccctccctcccccccctcccccccaccccccccgttttttttttttttttctctttgactcccctctttttccccccccccctctggggcccca

SEQ ID NO: 637446 - DNA, 1095 bp, Homo sapiens
gtcgagggtttcctgcttcaacagtgcttggacggaacccggagctcgttccccaccccgggcggatcgaccatagaccagccctccctcacctcttcaccgcaccctcgtgactgccccaaggcccccgacctgacgtccagcgccgcgcagccaccgccgccgtcgccgcctctccttagtcgccgccatgacgacctggtccacctcgcaagagtgcgcaagaactaccaccaggactcagaggccggcatcaaccgccagatcaacctggagcctctacgcctcctaccgttttacctgtccatgatcttactactttgaccgcgcatgactgtggctactgaagaacttttgccgagaatacgttacttcaccacactctcatgaggagagggaacatgctgagcaaacctgacgacggctgcagacaaccaccgaggctggccggaatcttcccttcagcgatatcaaggaacaccagactgtgatgcactgcggcagagcgcgctgaatgccacaggagtgtgcatgacactaggacaacacactgtgcacatcagtcacaaagctggcaactgcacccacactgcgccaccttgcacccactaattgaaccccacgacataaggtgaccgactcttcgagttgcacgaaaaccatatagccagtgacactgacacaaggctgtaaaaaccgaatcacaaaaaatatggcggatgacccaaaggataaacgccgaaccatggagaccaaagaatcggcaggcgacaacgcaaacactgcgcattggacaagggagacgcaactcccccctatggaccagaccacacacaaccccatgcggaaccacacggccgactcacttgaaagatgagataacgggcccccgggcgagaaaaaagcggccgcagcaagcccagccgagacgacgcaccgcacaaaaccaacacaacacccagccaacgcgaccacgcgccccgcccgctaagccgacgcgcaatcaggcctaacaacaagacacaccgagcgacgcacagctacccacggcaaccaagccgacatgagggaaaaggatcgaacaaagcggccaaa

SEQ ID NO: 637447 - DNA, 186 bp, Homo sapiens
cgtgcagtagcatggtgtcaatgcgtgcacatctggctctcccaggcaagcgccgccacctgtgtcaggtcaggcatagtagtcgttgcggaccacaatctgcagccagcgactgcgcatctcagcgttcatcgagtccagcagggaaggagtagcacttggacaggctcatcaccacctcctgcg

SEQ ID NO: 637448 - DNA, 276 bp, Homo sapiens
ctctgaggattcctggcaggtggaaatcaggagggtgacatgaccagcagacaaatcttttttttttggaggcggagttctcgctctgtcacccaggcgtgattgcagtggcacgatctcggctcactgcaggctccacctccggggttcacgcctttcttctgcctcagcctctcgagtagctggaactacaggcccccgtaaccacgcccagcttatttttttggtatttttaagtagagattggggtttcaccggtgttagccaggagtgccc

SEQ ID NO: 637449 - DNA, 948 bp, Homo sapiens
  misc_feature (379)..(379): n is a, c, g, or t
ctttttttttcttcttttcttttggaggtgaggaggagaagagaacacaggggaggggcacgccgagcgccgaccctgttggggagttgtgccctcctctctggcctggcccacgcttctctcccccacattgtgttgcgccggcgcggcctctttatcttctctcctatgcctattccccttcctcgcctgactgcacctttggaggctccaaatatagacgccttgtcgctccccgaggctccagccctttgagtaggccctctcgttccgacagggcggacacttgcgctccaaacttcgggcgcgggagcctggcctcccccaggcccccccctttctggttgctctttgctttccccgttaagctttgcccacncgaggctctccctgccggatagagttactgtcacgccagccacctccaatttgccctagctggctggtggaagagatttgtggtgaaccagaagagtgctctcccaagctctaatttcccgggctttaaactacccctgagtgtggttgccccccaggattaatagttagagaaaatccaccatgccagcctcattttaagagaaatagagttccaaagactgcccgcgtccagctttgatgggaccaccagcttattttggaagttcgaaggggctgtcgtgtgtgtggccctgatcttcgcttgtcttgtcatcattcgtcagcgaccattggaccagcaaggctctggaaaaggtgcccggaagccaaatcgagtgcccataatagctaccattccacccctgtatcctgggttttagagacacctatttccagaccacatgtaaaatgataatggactgatattgcactcttggttctttggagacccttgtggtggaatccccctttccccctacttttttttttccagatccattaatgagccagaataaaaagagtaaaatg

SEQ ID NO: 637450 - DNA, 102 bp, Homo sapiens
gatattatcggcttgatagcacaaaaacaaggccgacatcccaaatgtgcgtatttaaaattccaagaattaggattcttggggtgcatgccctgctagacc

SEQ ID NO: 637451 - DNA, 253 bp, Homo sapiens
atgagagatatgggtcagtttcatgtagtagtgtggtggagtgagtgcttagtcctgagttctaattagatgcactgtggtctgagggactgttgttatgatttccaatctttgcatttgctgaggagtgtttgaattccaattatgtggtcaattttagaataagtgcaatgtattgctaagaagaatgtatattctattgatctggggtgaatagttctgcaaatgcccattaggtttgcttgttccgctg

SEQ ID NO: 637452 - DNA, 236 bp, Homo sapiens
tcccctctacgcgagacagggagagcttaaagggctcgggagctccctcggcacacataaatcggcgcggcgatgccagcgcccccccggcgccctctatttccagcttcagcactcgcaggtctttacagcacagggtgatggtgcccgagtcactcgcaaccctggagagggacgttccttcccaggagaggggcaacgagtttcccggattgggcttacgcaggagggcgcca

SEQ ID NO: 637453 - DNA, 273 bp, Homo sapiens
gggttaagctgaagaataaatagatctgagctttccgggtatttgtgtgtcctcttatagacgtccaaagtgcgttcaggcctctcaaacatgcttctttcccactcacaagcatatttagtcagttatctaacccctggtaaatgaggctactacataggcccagttaacaaactcctcttctcctcgggtaggccatgatacaagtggaactcatcaaataatttaaacccaaggcgataacaacgctatttccaatctgtcaatcataat

SEQ ID NO: 637454 - DNA, 131 bp, Homo sapiens
tgtctgtcactgaccaaagtccacgaatgggtcaggtggacagtggggcagaagctcgggttcggctctttaagatggtaatgcttcataccaagtttcgcaaagtagcctgaagggtcccgtcgaagtgg

SEQ ID NO: 637455 - DNA, 263 bp, Homo sapiens
  misc_feature (248)..(248): n is a, c, g, or t
gacttggcatgctttgatctacgtaggaatgcagaatgctcagctggaacaggaaagacctgggagtgcaacagacctggatttatagtcctggctctctatattagagacttgcttagtaatttcagaagaatcatttcacacgttaagactcaagtgctggatttgtcttctaaagagcggaaattgacatttgtgctttattaacctcacattattgatttgaccattgactcaggagaagctcntaacagctattgcaa

SEQ ID NO: 637456 - DNA, 227 bp, Homo sapiens
ggacaacatagtgagatccccctctctacacacacacacacacacaatttaaaattagccatgttctgcattgagaaaaatgaaaatgaagtatagaaattaaaaaaaatagctgggcatagtggtcacgcctgtggtccatgcatctgggaggctaggcaggaggatcacttgagcttggagttcaaggctacagtagctataatagcacactcactaagtctggg

SEQ ID NO: 637457 - DNA, 320 bp, Homo sapiens
gttttcttagaaactacatctttatgcaaaatgaggtataattatactaattttggctgtgcaaggtgtctcaggcctttattccctgcactttgggatactgaggcaggtgtatcacctgtgggtcgtgagctcatgaccagcctggccaatatgtgtataaccctatttctactaataatacaaaagttagcctcctgagttgctgggattgcagcgtcctctaccacaactggcttgtttttacatttttagtagagacgggggatattgctatgttggcctgtcttgtcttgagcttctgacctctgttgattgcc

SEQ ID NO: 637458 - DNA, 180 bp, Homo sapiens
actcgcgtggttcttgcagaataatggtaaggacaataatagccaccatttactgaagatgtcctccgtgcagtctctggtccaagaatactgcacaaattatcacatttaatcttcacaataagagtttatttatgatgccatttcacagatgaagaaactaaagcatgggcagaactt

SEQ ID NO: 637459 - DNA, 780 bp, Homo sapiens
  misc_feature (490)..(490): n is a, c, g, or t
  misc_feature (661)..(661): n is a, c, g, or t
  misc_feature (690)..(690): n is a, c, g, or t
tctccctccggagaacagcgtgcatgggggattttggagtgtaggaagactagttgactcattgaagcagatcactgcttccttttatttttataggaatagaggaagaaaggtcacatgcgtgcccagctcttcatcccacaatgtcttggtggggaggggtgtacctaaatatatatcatatccttgccctcgagtgctagctagagagaaagagaactactaagggaaataatattatttaaactcgctcctatagtgtctttgtgagacgtgtcaccgtatctcaggatgtgcagccacttgtctggaacacacccctgctcacatacagagtgacggagtccacactgtcaccttgtggtcgcctgagaccctgtgacaccccgcgccccccgcgcccctctttttccccttgatggaaattgaccatacaatttcatgctccttcacgggatcacaaagacgcagtgtggggacagagactctnattaggacacagtggtttccaacgctgtctatagatttaggagcacaaatgcgacgtgctgcatgacctaccagcacagaacttttcccaattacacggtgactcacagacacattggtgactcactttatgtgtcgttatcagctgctgtgtgtgagcagagcacacccnatgcaggggtgggttgacagacacacccncataggattaactaccttagtatatttgagacccaccaccacaaggagggcgcactgggtgtatccactttcggaggcgagcggaggttc

SEQ ID NO: 637460 - DNA, 397 bp, Homo sapiens
aaccgagctcttacccgtcctacatagtgttgcccatggttttcaacagtaaattcaatcctcctacacccatctttctacattatttccacagaagtcaccaagcctctgcatacttattttcttcagcctagtggaagtagcttccaataccaaccttttggtattcttttcctattcttaaatctacagcttctacaagcatgtcatacatatataaatttgcctttctttgggaggccaaggcggatcacctgaggtcaggagttagagaccagcctgaccaatatgatgaaaccccgcctctactaaaaatacaaaaattagccaggcatggtggcatgcgcctgtaatcccagctacgcaggaggctgagacagaagaatcacttgaacct

SEQ ID NO: 637461 - DNA, 183 bp, Homo sapiens
cgacaccaagtttatagaagaaaaaagaaacactagcctcattatccccagccatcatagccaccatcaccctgccttaaacgtctacttactacctacgcctaatctacaccacctacactcacactactcccgcatatctaaacaacgtaaacactagaatgacagttatgaacaatacaa

SEQ ID NO: 637462 - DNA, 191 bp, Homo sapiens
  misc_feature (42)..(42): n is a, c, g, or t
  misc_feature (45)..(45): n is a, c, g, or t
  misc_feature (50)..(50): n is a, c, g, or t
  misc_feature (53)..(53): n is a, c, g, or t
  misc_feature (63)..(63): n is a, c, g, or t
agcgcaaagtgaaaaccacaagttacagagcaactaagaaantgnctagncantttcttagtntacatgtttgaaatgggaaaggtgactgactgcctttcaccagagtcttagctgtttcacgttcacattttcactctgtatatggaagaatttctcacttcacctgaatgatttactttcattcctat

SEQ ID NO: 637463 - DNA, 736 bp, Homo sapiens
gactgtgagggaaaacaaataagtgtttttaaatctgctcccagaaaaataaagaaatcattttttgcctagccaaggctatggtacaaacctcttatgcccctcatcccaggaatgtgttcggctattgggcttttataggcagggtagattccaagcagggaggtcagcaccctggttaaacatgggtggttacgaccaacctccctgagcaatccacttcatggaacagggctcacgtcaggcatatgcctcctcaggtcaagcgtctaaacaaattatatctgaataaagatgggtttagacaggtttacgtcctcaggttttctctcgacattattataaagttcgcccagggggcttcttaaacatgagaggcaggaaaatattcataagccggtttggtcgcgtgaaaggtatcacagtaagatcaaacaggctggagtttgaattacgtccaaatatcttgttatagaataccggctctgtgtaagaacggaagtatgtaaagcctcatcctaggaaggagcaagcacctctgcaaggtccagtatgattctcctggtggtgtatgcaacattgtaaagagtcgtaggtcaatatttgggctagcacctctcattgttgtctggcactattgtggacacgtctgttaactgctgactatacacactatcgctatgtagtattttatcgccatgtgtcagcactaagtttttcgattgcgcgctactaa

SEQ ID NO: 637464 - DNA, 300 bp, Homo sapiens
acaataccataatttaatcacttaaaatcttactcaaaactaaatcaatgatcttttaggccaggtgtggtggctcatgatagtaatcacagtactttgggaggccaaggcaggaggatcacttgaggtcaggagttcaagaccagcatggccaacacaatgaaaatccatctctactaaaaatacaaaaattagccaggctaatggcacactcctgtaataccagctacttaggaggctgaggcaggagaatccttagagtcccacctgggcaacacagttgacaccttgtctcagcga

SEQ ID NO: 637465 - DNA, 411 bp, Homo sapiens
atcacctgtaaaacagcggatgtatagattacacctccatgtaagatgtcttccaacgctcgcagaccaaggtaaccttaggtttgataagcagacagaaggtttcccctcccgcaggtagttggacaaacactgcggtgtctttcatatgacagcccgcagatgtctctggcccacacgtatgccacgcatgttgaatagagcaatcaaagtgcatagaagtagagtgttaataacggggggtgcaagcaccaactcatgatgtgtgagtgctcggagctccgaccctttcggcctctgtgtcaggttggggaaacacctgaacggggagctccgagcttgtgcgcatgtcagggcacacgacagttgctaatacagtccagagtgcacaatgcctctcgcaactcgttc

SEQ ID NO: 637466 - DNA, 146 bp, Homo sapiens
cacgaggggaagacaaaccatcgacatgagaccggagagggacagccaccatcacgaccctcgacacgctcaacgttcgctcaaacaccgacaggcactgtttatgaggccctcttttaatgccggtcagtgtaaaattcttgtgg

SEQ ID NO: 637467 - DNA, 325 bp, Homo sapiens
cattccagaactaatcagttcatatagttcttagttacaccctgtgtgaagttgtgtctccacaaccttgtgaggttctgctctggtccatccaggacttgaatcatccctttgtcaagcatatccacactgtctacactacatgcctgttagtgacttagtagccatctagatcaaaaaaacatagaacataaaggatttggtaatatctgaggtttcaggcatccacaggggtcttcgaacttatcccccatggataaggggggactactgtacaagaagaatggatttgaacttcagactggttggacacgaatgttcaggc

SEQ ID NO: 637468 - DNA, 213 bp, Homo sapiens
ccgtgttatacatacgtattgatcgtcatgccttctgcagctgtaggaatacttctggtagggcactgtgcggaaactagaggatgaaatcagtgagctgcatgcacttgaacggcgtaggcctgtctcctcacttgagtagcaaggtccatcgtaccaaagccctgtaactagatcaatcactcatagtacagaccagggggcatcctacta

SEQ ID NO: 637469 - DNA, 194 bp, Homo sapiens
cggccttcccaaagtgctagaattattcatgagccaccacacctggcttggtaaatgtttcatgtgcccttgacacgaatgtgtattaagcccaagagtttgagaccagcctgggtaacatggcgaaactctgtctccacaaaaaatataaaaattggttggatgtgatggcatgtgcctgtaatgccagctac

SEQ ID NO: 637470 - DNA, 444 bp, Homo sapiens
cccagcaactaaaacaggtcaacaacatcactaaatgttggttgaataaaagagtaacaagaataattgaaagctttttttcttcctatataaagcatgaagactgtcattgtttctctaggaaatgtatgaattctaacctttgtgacttgaagaaaaacattcttttgttacagagatttggactttgatgataggttttaaaaatatttgataaatattttttgtacttgtttgatattttctttaaagactttacttcagaaagggaaagactgtttagaaagaatgcatattttttccctatttatttctggggttactgcttatggagttcaacagtgtttgtatttgatatttgtatatgtttgattgctatctttaaagcgccttataagatttatggctctgtgctattactttttgagctttgcaagttgtgta

SEQ ID NO: 637471 - DNA, 599 bp, Homo sapiens
ggaggcacttgaggagccaagtttcttcaccactggcgtgatgtggtccattggtgcaggagccctgggtggtctggtgccttggcgaatgcgtgcttgcgcgaacacagacgtgttgctgtccaagccccagaaagcggtgcctgtgagtacctggacggatatatgacctgagaaatcactggacgaatggaaccaacggagctttcaaagcgaaggagctatgggaagaaaacatggatgctgtgacttagtggctcgtgcggagggcacggttggttcctctgtcgagatggaagctgcggactctgtcctccctgagtagagcagtgttggaccagttgggcgtccccctctatgcagtggtaagggagcacatcaggactgaaggtgaatggatttcggcagctcttatttgcaagaggagaaatcttcctgtgatgaaaaggaaaaagttctatggtgccacaaaggcggaagatgatgtttatgggatttactccgtctggtgagtgtggtacagattcttacgaggctgtgacggcggcttctttggagatctgaaaggagaaggttcatacttggaggagtctgaggtg

SEQ ID NO: 637472 - DNA, 722 bp, Homo sapiens
cagaggttgaggtgagagaattgcttgacccagaagtgggaggctacagtgagttattattgcagcattgtactctggcctgggcaacagagtgagaccttgtctcttaaaaaaaaaatgttttaggccaggcgtggtggctcacatctgtaatctcagcactttgggaggctgaggcgggcggatcacaaggtcaggagttcaaaaccagcctgaccaacatgctgaaaccctgtctctactaaaaatacataaactagctgagcatggtggcgtgtgcccgtaatcccagctactcagaaggctgaggcaggagaatggcttgaactcgggaggcagaggctgcagtgagctgagattgcaccactgcactccagccagggcaactgagcgagactccatgtgaaaaaaaaatgtttttaaaaattaggaaaaatccagcctgggcaacatggtgaagctcagtctctacaaaaaatacaaaaatcagctgggcatggtggcgtgtgcctgtagtcccagccactcgggaggctgaaggtgggaggatcacctgagcctggggaggatgagactgcagtgagccatgattgtaccactgtaccccagcctgggtgacagagtgagaccccccgtcctcaaaaacaaaagcaaacaaagcaaaaaaacacagacttaagggggaaagaccttgcgcaggaagactaacagatagatacaac

SEQ ID NO: 637473 - DNA, 1021 bp, Homo sapiens
  misc_feature (474)..(474): n is a, c, g, or t
agcgggtgtcgtcgctatcgagctccccgcttgccctgggctctgctggctggcatccggcccggcggcagacgcgggacagcccttctgcaggtctgcggggccgaggtgtcccggctggtgcacctcgtggcgagaaatcgggagacagggcggaataactaacaacggataggccccaagcgaacttaaggggacttccaacatggagaaaacgaacgcagggacagcaggtcctcaggcaagtgggaacagagttggcccaaacagagaaacacaatggcaggacaagagggacaccaaaggttgcgttaattaagagggggttagccgccttgaggggcgtcacgcgttatgggactggccttgggctgaattaccttggtggtttgcctaaggaggcaaagccgtgacaggcagggttcccggcgtttaaggcagccactatatcttggcgaggaataaggactgggnattattggaccggtcattaggggccttgagcgagagaaccaccagggtcaacgggatggtagaagtaacgaaggaaagtaatgggggaacagggattagggggaagagaaggtggagggaacaggcttgaattgggaaaaaggcttgaagggaaaacaagaccaggggaggagtacacataagtcctgacagggggacgagttccatggtacattggagactacgcgctccttagaagctagtgggacccacttcaataggaatgaacgtttgtatgccgtataattggctcgcgttgcacatttccttggaatgggtttatcccctgaacaggtttatatacgggagaatcagtaccccgtgggggataaatgcgcgaaaatgtgtgagcgccattggtttgacactggaagtggaagaccccctatgggttgggtaagaaacgcttttgaaagctggtacaactttggttcaaccagtggggttcatcctaaatttacaccaacgcttcctaaatttgaaataataggagggggatgggaaacca

SEQ ID NO: 637474 - DNA, 114 bp, Homo sapiens
tcctaaagggctatctaagtttcatcacaacaattatcaatatgaaaccccgcgggcgataaccttaataccaaaggcccctgttcgtcgtgatccgtccttaattacagcgag

SEQ ID NO: 637475 - DNA, 850 bp, Homo sapiens
gtaattatgtatcctttgaccaacttcttcccatcacctactcccactcctaaccaccctatcctctggtaaccaccattttattctctacatctataagatcaatgtttttagattccatgtatgactgagatcatgcagtgtgtgtctttctgtgcatggcttatttcacttaatgaagaagacacaaataaataggaatatatcccatgttcatggattgggagaattaatattgttaaaatatccatactacccaaagtgatctacagactcaatgcaatccctattgaaatactaataatattcttcataaaaatagaaaaaaatgctaaaatttatatggaaccacaaaaggcccagaatagcccaagcaattctgagcaaaaagaacaaagctggaggcatcacattactcgatttcaaagtatactacaaagccataacaaccaaaatagcatgaaactggcataaaaatggacacatagaccaatggaagagaatagaaaacccagaaataaatccatgcatttacaagcaattgatttttggccaagatgccaagagcacacatttgggacacggacagcctctttaatacatggttgttggcaatctggatatccacaggcatagacagaaattagggccatacctctcatcatatgcacacataaactcagacatagatgaccaacttaactgtaagaaccagaaacttatacaagtctggcagcaaacaccaggggaaacccgttcgggacattggtgtaggcacagaattttctgggtaagaacgtcaaaagttacaggcaacacaaaaccaaatagaccactgtgacctttccaa

SEQ ID NO: 637476 - DNA, 144 bp, Homo sapiens
ggctgttacctcattctgctgacatctgtgcctggacggtctacctggcatccccatcagcgtcagcccccttttgattctgttgccctgcgcgtgtcttgtatgtgtgtgtgtccgtttacatcaccgcttcaagcttcaaaa

SEQ ID NO: 637477 - DNA, 894 bp, Homo sapiens
  misc_feature (97)..(97): n is a, c, g, or t
  misc_feature (104)..(104): n is a, c, g, or t
  misc_feature (112)..(112): n is a, c, g, or t
  misc_feature (121)..(121): n is a, c, g, or t
  misc_feature (136)..(136): n is a, c, g, or t
  misc_feature (167)..(167): n is a, c, g, or t
  misc_feature (194)..(194): n is a, c, g, or t
  misc_feature (293)..(293): n is a, c, g, or t
  misc_feature (301)..(301): n is a, c, g, or t
  misc_feature (385)..(385): n is a, c, g, or t
  misc_feature (393)..(394): n is a, c, g, or t
  misc_feature (396)..(396): n is a, c, g, or t
  misc_feature (409)..(409): n is a, c, g, or t
  misc_feature (437)..(437): n is a, c, g, or t
  misc_feature (450)..(450): n is a, c, g, or t
  misc_feature (452)..(453): n is a, c, g, or t
  misc_feature (455)..(455): n is a, c, g, or t
  misc_feature (489)..(489): n is a, c, g, or t
  misc_feature (507)..(507): n is a, c, g, or t
  misc_feature (523)..(523): n is a, c, g, or t
cagtaaggtccctcagagcttggtggctcaagactgtatagcctggcagagccagggtgaagggagaagctctatgagagcagtgcaggatgcccancgctgcntcagctgnctcctcgcncagctaccctttggncccattgggccctcgtctgcctctccaggantgtatgtttcaagccttgtcctgtgtncctttgtctgacgctctgtgtattgctctttgaatcgagtttggaggaagagttgagttgtatgagtggcggcatgttggtagtgccggacttcctgtnctaagttnttctggggcctcgctaattgaatgtggaacagtagcaccacttgacggctacaagtgccgactcctgaattttcccatggtgtnctgactannangggctggcagccnggagaatgggcccagggaagcaaagacntcttccctctgcngnntnctgtcccacttaactgacctcactggaggctacntcacccaaagtagatgtnagaaaacctaaattantgaaccatatttttaaagatcctattctttgcccaaacagggccctctggagcccatcctttccttccgtccttctgaaaccagatacgcccaggtgccaagcgccttgctgccacgcccgaacctcttaggagagaacgtatgactgcgtgtgtctaaacttaagccagcaggcaaacaacggtgctgtgtcctcgagaccctggcccgcgatgtaacccttcgctggagggcacttccatacactgggatctgcgggctaacagagcgttcaacacaagttacggcccgtagtcgcaaacaatggttgccgcggacatcacatggtaggactgcgtagcgagtggggtgaaaactggaggtctgcaaca

SEQ ID NO: 637478 - DNA, 1294 bp, Homo sapiens
ttttttttcaaacagtctgatttaattaggaagttaaataagttgaggtggggtggagtgtgggatcattcagaaggctgacagtgggaccgcgtggagttgtggcaatcattagcaggtgtgaggtgtggcaaggggagcaaccccctttcaagacaaggcacaacactattgggcaaggagagatgagggggtgggacctcacgtgtcaagtggacatgtgcctcagggaaggccaggtgggttacattgcaacaggaggactcattcaggcaatttcagctattgaggctgggcattctgtgagggcatgagaggcttcaaggcgtgattcttcaaagaggctttggtgtatctcacacctgtgggaagaagtgcttccacggccgtggtgaagatcttttccaaaacatcctcgtaggcaggcgacagtttaacaatgctccaaggtatattccccgagaatccacatgtgggatgtgcacccccaagtggatcccaacgtgccgatgtggaacaacacaggtggtgatctatagtggggggtgaaagttcagagggaaccacaggaatctccatcgtgacacaccggggggcaggcattcgttatagaccagggatgtgttccaaggcgtagagacaagcctcttggggtacaagcgtgggaaaggggctctcaagcacatttcatttgggcccatctgtgcatccagccattcggacctacgagaagactcagggcccccgtattgggacaaaagggcactcagagatttcccagcaaaagacatttcggtagaaaggaaacgacgggattatcttggcctacaggcgccttggaataaatgtacgcgtgggggcaacttaactctggcccattcaggatataggcaggcacacaagtatttggtagacagcctaccgaacgttcacgactgtaggcttctcccgcaacgccggggagcctcaaagattatatttttagccagcagggggagacacccgagtaccgtgagaggggcaacgtggtagggaccgcgtcacacaactggacgtgaaacgcgatgccaccagaccgggagaataaaacggggccccccacgattaagaaccgacgaaaacaggtgccgaggggggtgcaccccctactagagggcactcacaaacgacaacacaggcgtggacgacagcccacagaggagaaccacatagcggcggggccccgacacaacaacgggcaaacagcacaaaatgaagaacccaggagcataacaacgcaggagacgaaccaaag

SEQ ID NO: 637479 - DNA, 1229 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaatt

SEQ ID NO: 637480 - DNA, 968 bp, Homo sapiens
gaccgctcattggctactcgtctctgtgtcttgtacattcgtgttggggagcggatcagaattcgagagctgacttgtgcgcgtcatccggacggggcctttgaatgataatttgcgtattggatgcttctgggtcaatatcttatcgtgaccatacgtctctagtgtcacatgttacgcaagggcacaacacgggttgcgtgcggtaagtccctcgtccttagggaagtcgcaccattttactccgcagtaattttgggcgtgtcagttgatgacgttcgtaggcatggccgggtcgatgtctgctcatcgacgttagccccactattgatacaccctcgtaggtgcgtcctgaaggtctaagtgtctagttgagagcacgttatttgttggaatcgcggaatcacgtgtccttatgttgagcagggatgtcgacgaatatctaggtcgaggagttcgtactagatgcgcgcgtactacggtagtggacctaccaagccgcttttggtggctccatgtcaatcccacacagatttagagcacctggaatccatcctgtcatggcaattgagaaaaaccaggcctgcagtgttcagagggggtaataccgccatgctgcttttatgccgtgaaactgtcgacagtgatataccgggctgtgcctgtcctgatcaggaatacttacggtggcagggacctggttcgagagggaaccaccaggctcggggacttcctgagaagctccgtcgcggcacgagggacgcgcagcgttccatgcacgatgggtgaccgctgacaacttctcagggaggggtcacggtgcgctggcagtggaaatgtccgagaggccggtgccgccgaacaccagggatgggcgccttacggggccggcagcaggttagagaccgcccgacagagacaaatcaagcggccgaacctggagaaaaaaacggtgggcaacacaagcg

SEQ ID NO: 637481 - DNA, 1429 bp, Homo sapiens
  misc_feature (1246)..(1247): n is a, c, g, or t
  misc_feature (1250)..(1251): n is a, c, g, or t
  misc_feature (1256)..(1256): n is a, c, g, or t
  misc_feature (1265)..(1265): n is a, c, g, or t
  misc_feature (1269)..(1269): n is a, c, g, or t
  misc_feature (1271)..(1271): n is a, c, g, or t
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaattgaaaaaaaaacccgggnnttnnggggnggaaaaagnaagngntggccttgggaagtcttccctgcccccttctgaacgggggaatccggcccctagggggggaaattccagccggcatctgcacgagaatcaacagaagtatgaacgagctaacaaccgcacagggggggcccattagccccgaatcacatataagcacg

SEQ ID NO: 637482 - DNA, 1192 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcgggccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaatt

SEQ ID NO: 637483 - DNA, 1172 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagttaggtttcctcttcattcaacacttaatgttgagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaatt

SEQ ID NO: 637484 - DNA, 1157 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaatt

SEQ ID NO: 637485 - DNA, 1259 bp, Homo sapiens
  misc_feature (1193)..(1194): n is a, c, g, or t
  misc_feature (1197)..(1197): n is a, c, g, or t
  misc_feature (1199)..(1199): n is a, c, g, or t
  misc_feature (1223)..(1223): n is a, c, g, or t
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagtgacttgtcggtgcccnntantnaacacgtccgtctccgagggacanacattaagtatacctaggcgccctccctctttttgg

SEQ ID NO: 637486 - DNA, 1726 bp, Homo sapiens
  misc_feature (1017)..(1017): n is a, c, g, or t
  misc_feature (1066)..(1066): n is a, c, g, or t
  misc_feature (1474)..(1474): n is a, c, g, or t
  misc_feature (1542)..(1542): n is a, c, g, or t
  misc_feature (1638)..(1638): n is a, c, g, or t
tctgtatctaagactgactgctgattcgtggagactctgcgcgggttgggcgaagaccctgctggtaccatgggtaccagcgttcatccgatgagacggcctgtcacatggtccatctcttcgagatctccatccactatggacatcttgacatattaaccacgtaacaggagaccacataaagtcctcagacatgtgaccaggacgtaagttaaccagctgcgagatatggcgtgcaacgacgagtctcgggctacgagggaacctgggtgttccgcgctcggcatgctagctatagtgcgctcctcaactaacgatgcgggtagacataatgcgcgtcattcaagtaggctgattcctagcgtagcaaatacccactcactagcagcagggaaatggtccccgtatacggcacaaaaccgagtccctgtggaggatccttgcgccatttacctgactataccaactttagtactggggattgaccaaccggaccattgcatggccactcgatcggcttaccgtatcagcacacgcccttggacttatgcatccgggagcgttaccacccaacacgtgctggcgctcggcatatgtccttggatcccgttcgcacccacattgttgacaggaatcccaaaaggagtattctaccgaatacgtggggacaactctgatgcacggaaaacggaatacaaggcacgacgctgtagggggtccctccattcgacaacccctctaatttgtggccaaagctacgcaacattcctttccccagcttgcggacaagcataatcccaaagaaacagtgggccggaaacaatgttagcgcaccgaaggttaatggttcctaggaatggtgttggggtagaccatcaagaacctagggccagagcttatatatactgtcggcactctttttcaccattgcgggtgcccacaatggtacagcggacattttatttttccgagagacacagcggtgtgcgaacacgacacaaacagagtttggtgggnaaaccgcaaagagagccaacagccaaacttgtgcgggtgcacagaaggncgcgctcccaaaagcaaaaaggggagcccaccgacaccaaacggaggggtgggaaacgatgcgcacataacacggccagagagttgcgagacaccgaatcgcacagatacacaggtttccagcaaaggcccccggtggacacaccgaaggacgaacgcggaaaacggcaatgtaggcacggcccaaaaggccccactatcaagatagtcacacccgcaacatctgagtgtgataagcaccatatatatccgggttgggatcggaacaggtgggaaaacattggacgcggctgagcacaccgtttttcaccccatttccctagggcagtggtgcacaacgtgaaacacgatggggcattgcgatagcgacataaccgccaaaggagacagtgtgcaatctcagtgtggntgggggccacaccatgggccatagccgcgtagtgacagagtgctatgaagaaggcacggtctccccgnttatcttgaggagccttttgccaaattgtagcaccaggggttgagggggaaaccgcccgttctgacacccgcaccagcgcacggatccccatgtgnacggcgggctcctccactgacgaactctaatacgcaccccacgagagaggagaagcgcaaatacgcgcgcaggaggacgccacaacag

SEQ ID NO: 637487 - DNA, 1009 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaaggtgagaatcccagaactgcacactaggaagcgtggagaagtggctcaggatgacaccgtggtggctggcacagctcgttgtcacgccaaagctgctgccgtttccgtctgttcctcccagatgtgtgagcccggggagtagtcgttcacggagttctcgggtgccagccaaatactttttttttgggcgaccgcattctgccctgggttgcccccagggctcactcgctggcccatctccgctcactcccctctgtctgggttccttgtctct

SEQ ID NO: 637488 - DNA, 511 bp, Homo sapiens
catactgatctgatagtgacatactttcagcaatgttatccaggctaccataaaatccttggaacagcgtaggtaataggatagggaagtagcgatcccgctaaactcccattccatacctctgcatgatattcctcagccgtatgagtctaggtgagtagcagattaacaggtataatagagggattggattgtcgggagctatattaatttagagataaaataaggccagttgacagattctgtttccagcagtttaaacagcaacagtggagtgcttcagtatagtgtacctgtaaatataatttagatccgcaatcatttggtatacaatgctgtttgaagtttagtacctattggaaaaagtcttgtgtagcaggggtgcaagttaagatcttagtgatgaggactgggatggactactttatagccgttttcttggaattgggggcatggcaaatacagtagggtagtatagttctctacacagaacatgaataaatacacctgt

SEQ ID NO: 637489 - DNA, 666 bp, Homo sapiens
  misc_feature (626)..(626): n is a, c, g, or t
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccatttacagttgcggatgntgccaagggggagctatggaagtgacccaagttgccattg

SEQ ID NO: 637490 - DNA, 645 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaatt

SEQ ID NO: 637491 - DNA, 2460 bp, Homo sapiens
ggaggacacggctccagggcggcgcggcccaggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtggggagacagtctctcattctgtcacccaggctggagtgtagtggcacgatctcagctcattgcaacctctgcctcctgagttcaagcgattatcctgcctcagtctcccgagtatctgggattataggcatgcaccaccgtgcccagctaattttcatacttttagtagagacggggttttaccatgttggccaggctggtctcaaactcctgacctcaagtgatccactcatctcagcctcccaaagtgctaggattacaggcatgagccactgcacccagcctccagatgcattttcaaagatggttcatttgtagtacttttttcccccgttttttgaaagagggcgtctccctctgttgcccaggctggagtacagtggaacaagcaaagctcgctataacaactcttgggcccaagtgatcctcccgcttcagcctcccaaagtgctgggattacaggcgcgagccaccgtgcccggccacgccctcactttttaattctgccatttcttcatgtgttagcttgagtccttcccctctgaagtattacgttgtataataaggaggacaagactcatgattcctttgcttcttcctgctgtgcggatcagctgacagagccgcaggctctgtgggaggttctcgtggacgccttccctcagctcattgtgctgttgtgtgatgtgtggcctgcagtcacagcctttctggtcctacctttcctccggaaacaggacagcatttggagggagatgggatgagtaagggagggagagagggtgctggcacagccctggcaagaagggccagtggatgagactaggctggcacataacaggctctaggagtgcctgtcttcttcctgctcttccacgggagaggagaccctggcgtgtgtgtggcagaaaagacactgccaaggacctcgtgcctgtgtccggacccagctgctctgtgctgcaggcgttctaggccgggggtctccaggggttctgtacatagactgtttgctcctggccagcaggcctgtagctgcgctgggagggcctccatggggcctgggctgtgggtggcggggactggcagccgttctatctacctacttttctgtccacttgtctgtttacaaaggaaaaacaaaggtgacactggagaaaccgacacgtttgaggttctaaaaattaaacgagccacaatataaacagtctcacatcttggtacctcaccaaatgtcccctcattttttcctgtttttacgactttcgaaacaaaaacctagactacactaagctttaactgttgggttctttcttggcagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaatt

SEQ ID NO: 637492 - DNA, 366 bp, Homo sapiens
  misc_feature (52)..(52): n is a, c, g, or t
  misc_feature (79)..(79): n is a, c, g, or t
  misc_feature (83)..(83): n is a, c, g, or t
  misc_feature (96)..(96): n is a, c, g, or t
  misc_feature (186)..(186): n is a, c, g, or t
  misc_feature (191)..(191): n is a, c, g, or t
  misc_feature (196)..(196): n is a, c, g, or t
  misc_feature (213)..(213): n is a, c, g, or t
  misc_feature (220)..(220): n is a, c, g, or t
  misc_feature (255)..(255): n is a, c, g, or t
  misc_feature (265)..(265): n is a, c, g, or t
gcccaaggggtgtttttgccccttgctttcctcagagttgggtttttaaccnaagtgccctgggccaggtcagggcctncaantgtgttgtccagnacaggagccccgagcccaatgtggcatttgaatttgaattaacttagaaattcatttcctcccctgtagtggccccctttatatttaggngctcnataancaaaagtggtcggtggntgctgtnttgggcagcccaaaaaaaaatttccctccccccanaaaggtcggntggcagccctggccaaggtgatggggtgtgctacccagtgtatgtccctgtgtagtggatggagttttctgtttgtggaataaaaacggctgtttccgtta

SEQ ID NO: 637493 - DNA, 330 bp, Homo sapiens
  misc_feature (285)..(285): n is a, c, g, or t
tcgagccggtaccagtacgacggagactctctggaacagcaacagtttatacatataatggctgctatttactagagcaccaactcagtcaggcattgtcctatgcaattaagcgtggtagtgttaatctgttggctcctttcaatctctgatgggtagagtagttatgataactatttcctgctatatttatcaatgacagtgtgaggagttaacataatctcggctacgaagctctagttctgtgtgatcgtagtcactgtcgaagcgacacagtcccagtgnctgtaaatgaccgatctttgaccacgttgactccaccatgactta

SEQ ID NO: 637494 - DNA, 148 bp, Homo sapiens
gtggtgtgttatgtgctatgtgtcatgcatgtgtatgctgcgtatgatgtggtgtgtagggtgtgtggcatatagtgtggtatttgacgcgtgtgtatggagtgtatgatgcatgtaggatgtatggcatgtggtgtgttatgtgctg

SEQ ID NO: 637495 - DNA, 321 bp, Homo sapiens
gagcgggctgggggtacagacgccctgtctgatctcatgatctggaggtgtgttgatactaaattaaaggaggatccattggatgtattggacaattggatgataagtagtatttccagcattcttctcattgccaccattctcatcaggctgctgagtataggcactgctcaggcttgcttttggattatgatccatttgaaagggaccagtgagcctgcttttgtgttccccgcttttgtgttccggaacacaaaagcgggaaggggaatacttgggcagtggtgttcccatgtactgaacgtgcttgttccatctcac

SEQ ID NO: 637496 - DNA, 313 bp, Homo sapiens
  misc_feature (37)..(37): n is a, c, g, or t
  misc_feature (53)..(54): n is a, c, g, or t
  misc_feature (180)..(180): n is a, c, g, or t
gcaggctgtgtccttggtgggcagctttatttatttntttaatgtatttattnntgagacagaatctcgctcttgcccaggctgtgcagtggcatgatctcggctcgctgcaacctccgcctcacgggttcaagcggttctgctgcctctgcctcctgagtggctgggactacaggagtncgccaccacgcctggttaattttcgtatttttggtggagaggggatttcaccatgttggccgggctggtcttgaactcgtggcctcgggtgatccgtccacctcggcctcccaaagtgctgggattacaaggt

SEQ ID NO: 637497 - DNA, 124 bp, Homo sapiens
cccctgtgaactgggtcctatgaccacagtgttggtgacacagggataggtgaaatcaggataagcaaaacagatatgcatttctagaacaatgtagttgtgtccaggctgatgtttttattat

SEQ ID NO: 637498 - DNA, 521 bp, Homo sapiens
gacacgcttttcatctgtcccgctgcgtgtttcctcttgatcgggaactcctgcttctccttggctcgaaatggaccccaatgctcctgtcgcctgtggctcctgtgcttgtgcgggtcctgcaaatgcaaagagtgcaaatgcacctcctgcaagaagagctgctgctcctgttgccctgtgggtctggtgccatgtgtgcccaggttgcatctgcaaggggacgtcagacactgtgcagcttgcttgtgcctgttgccaggacagctgtggctctccagatgtaaataagaggcaagcctatattaaacctgtattttagtttgttatatttttttgggtgtacaaccctttgaacccgttcggtgcgtttggtgggtgcaaccatcttttgtgcactatatggaaattctttggtgattgggcacacaaattttctctttagactttaggcgaaacaacacagctatctctcagacaaaacgatccaagacagaaacaacaatgtttttgttgcgggc

SEQ ID NO: 637499 - DNA, 483 bp, Homo sapiens
  misc_feature (272)..(272): n is a, c, g, or t
  misc_feature (401)..(401): n is a, c, g, or t
ccttccaacatctcatttctcctccaaatgacacctattacatataacagttttatagaaatttggaggagaatgaggttactagtatggtgtggtccatgcaaagtttttttttttttctgagacagggtctcattctgttgcctaggctggagcgtagtggcgcgatctgggctcactgcaaccaccacctcctggcccaagcgattctcgtacttcagcctccgaagtagttagattataggcatgctccaccacacctggctaatttntgtattttttgtagagacagggtttcactatgttgcctaggctggtctcgaactcctgagctcaagtgacctgcctgccttggccttccaaagtgctggcatgagccaccgcccctgaccagttcatgnaacttaatagagaagatgggacttgacttacactttgaaagatggtatggatttatataagcagaaagaaatgagatggtgg

SEQ ID NO: 637500 - DNA, 633 bp, Homo sapiens
ggggtgcacccacattttctgtcaaataattttagctctttcaccacaaggaacccaccccccaaacgtcgccttcataagaagaagctccccccgccctccgttgctccacccgctcaccttagggcagatcctcccgcctcacggggtcctcttcatccgttcgcctctcctgttgcgcaccacgcagacagagtgtgtctatcgcgccacacaatcctccctacatgtgtggtgtctcctacaccgatcgagtctttggctgagtcatggggctctcctctgacaccccccccacttgtggtgaggtcagttctttcacccacatctttctgacacgagggtactcattgttccgccccagcctccagtagaccgtggcagtagtcacactatgtcgccacaccgcggtctccgcaggtctatccccccacgggtgctgtttccacctgtggtgtccccccggtttcccactgccgacccccaccacagactttcgaccgtacgaagttttttcttcccaaaagagacccacggagtgcgggccccccccccccccccccgggggtcatactcttcccagggcggggggtggcgcccccctttttttttcacccaaaaccggggcgggga

SEQ ID NO: 637501 - DNA, 1690 bp, Homo sapiens
  misc_feature (583)..(583): n is a, c, g, or t
ttggtacgtgcgtggggacgttcatgcttctgtgtggggtgcactgtgccagcatgttgtttgtttggtccagttgcttgttgcgtaccgggtgtatcgctggattgtgtgctcgttgtgtgatctctttctcggtcgaggggtggtgtgcgccgcttgtcctgcgtgtgtggcttttgtgtctcagttcgtttttgcctcccgttgggtgtttatgtcgttgttctggtgggtggtcgtagtgttgtttgtcttgcttgggggtgctcttgtactcagccccgcttctgcctccggtgttggggagtgtttggtctctccgtgtctcgctcgtcgttgtcgtgttgccgcgacgcgtgttttgtgtggcactttgcggtcacgtgggttttgcgttctggttgtgctcccctgtgtggtgtgtggaatcagtattctggagtgctcatcttctctcgggtggtggctctcttaggcgtggttttctctggaccgatactgcattcgttgtgtgtgtgtgtgtggttgttgtgtctgctcccttgttgtggtgccgaatatctcgtctttcgtctggtcggtngggccacgtcggtgtgtggtcccctttttccttgggtggtgtgggcttcgtgtcattctcacttcgtccttaccgcagcgttctctcggggtgtacctccgcctcttcgtgtggagtggtcttcttctcgtcgatgtctgggctggttatgcggccttgctcccctcggatgtttctgctgggcgattcctctggttttcttttgattcgtctactgagtggtgtctgtggtctgctgactgtacgtggggggattttatatggttgtggtggtatctccccagacctcttttttgttgggctcccgttgctttgggtgtatgtgctgcctgttggctgcgccgctctctggtcgtgtatgatgctcctcctgatcacggggattgttgctccgcgcgcgttgtttttgtggggtggagatttcttgttgagttgcctgagggaatcctgtgtctccacttgggacatagatggctgcgtggtgcgttttaatagaccttattctctgggggcgtgtgcttggtgagaggggtttaacccgccactggttgggcccgcagaacctcctctgtgattagcgcccgcacacataatgtctttgtgtgggggttgtttctcgttcgcacatttcgctggtctctccccggatagggccctcagagatatcacggctcgcaccgcctccaaaagaggtgtcttgccctctgtgcctgtctgtggcttattggggccccgggctcttggggttctctctcctccgtgtgcgcacctgaaggccccttatgtgatgctttgtgtttcatttctctctcaccgctcctcctccgggtctcctctggtgagtggaaggcacaggctcggcacccccacacactgtgcctgtaggccccggaaccctttgccacaccggccatgcgccccagatccaggcccgttttagaaagagcttttacattgggccgcccccccgtttttggcggcgaaccactggaaagccatatactactttatgtgctgtgtttttgtatttttggaaacatttgtattttttcaagtaaggccacaaagtaacttttataagagcgtgactgtgtaataaagggttta

SEQ ID NO: 637502 - DNA, 420 bp, Homo sapiens
tgacgagggcccaagatgccgcagtctaccaaggctcttcctcctcaccagaaaatccctgggcttccacaacgtgaactcactcattgtcagtatgctgcgtggagtgtttttggcatggtgacctgtctgggcccagcatgttgcagatgtgtatttatgcgcaatggtatgcatatctctgtgtgactgtcagtgttgcaagctggctggatccaaccatctcttctgaaataatgcatccaaagggttgatattctgggggaggtcactgcagaaggatggaactgacctttattccccagtgggcagttactgagctttcctcctcagagccatgctggcagccctgggacagagaacggtgtggctttggctgcctctgcatggaatcttgccccggactcctgattagaactg

SEQ ID NO: 637503 - DNA, 119 bp, Homo sapiens
gcggtgctgctgccggatgctatagcgagctcccacaccagcacacgccggtgtggtgcagacaactggtggccgggtccgacgctcgacacttcgtaactactggtcactacgcggtt

SEQ ID NO: 637504 - DNA, 203 bp, Homo sapiens
gcaaggacaagcttttttttttttggagatggagtttcgccgttgttgcccaggtgggggtgcagtggcgcaatctcagcccattgcagcctccgcctcccagttcaagtgattctcgtgcctcagcctcccgagtagctaaaattgcgggcttgtgccaccacacccagcttatttttgtatttttttttttttaattaaag

SEQ ID NO: 637505 - DNA, 316 bp, Homo sapiens
ggtattatgtaatatatgatgtatataccaaatgatctttatcaaatctgaaaaatctggaattaccaaatatatcagaccctaagggttttgattaacaaactctagaagtctggacaacacagcatgaccccctctctacaaaaaataaagataaaaaattagctggccatagtgcctgtagtcctagctactccagaagctgaggcgggaggactgctcgagcccagaagcttgagattacatgaaccatgatcgtgccacggcagtctagcctgtgtggacagagtgagactccatttctaaaataaaaatt

SEQ ID NO: 637506 - DNA, 513 bp, Homo sapiens
ctgccgatctccgtattctgtcattacgatcgaccttgacatacagtcagtgtgaaaattatcccagaatctatagtctattgttatgattgggtgaatgggaagtttaaacctaatacagatcacatccatccagtttacagattactcctctacatgagtgtgcccgtttgatcaaggtactatcggaacacatttgcaaaacgctgttgccttggttcatagaggctctgggaaggcaaccttgggggtggagatcggctgaccaccctggaacacctgaggtgagcgacaaggtatgctcgggtctggctcttcccttacagcagtctactcatcccaaggattcaggggccatctttccatgggactataaagctgcccaggttccctcgggccatgtcctctcttaaccactttagctgaagaaggtggtaaggcctctgctttgaaaggaaattgaagctgggttgagggtggaaattggctatagtttgaccctcagatctcact

SEQ ID NO: 637507 - DNA, 273 bp, Homo sapiens
  misc_feature (29)..(29): n is a, c, g, or t
  misc_feature (84)..(84): n is a, c, g, or t
caacagaaattgtcatgatatttgtatanaaaaactaaccatcaaacaagtgggtattgaccaactatacaatctgatttctancaacaccgaaacactgattaaccatggccgtaatggaagtctgaagaactcttaaacagccatttgtctcggggccgggtgcggtgctcacgcctgtaatcctagcactttaagaggccgaggcgggcagatcacgaggtcaggagatcgagaccatcctggctaacacagtgaaatcccgtctctact

SEQ ID NO: 637508 - DNA, 266 bp, Homo sapiens
gtctagcaacgtatattcttatgatcttacataaagcttatttgaaattatatcttgtaagcttcggtctatttcaattcttacctagctgtataactaaacctggagaataacttaagtatttctataaggctttgatccatctggaattatcttaagataggaacccaattattctcgagcgacgtgtccagcaccacttattaaataatctccccattcctcattgaaccggatagcttgcccgggggtaacccggaggctcg

SEQ ID NO: 637509 - DNA, 1703 bp, Homo sapiens
tccgagggtttttcatttaacatgttctagtgggtgagagggggtcccggcgccaagagagggaggggggtgggagggtgggggcaccgcgctggcgggggacaccagcgggacacccgcgaagagacaatgtggccgcgggggcccccaaactttctctgcgtggcgcgtgcggggagagagagagggtgagtgagaagagagacaccgagagacacgcgggggcgcgggagcagcgcgggggtgtggaagagagaggcggagagcggcgagacaccgcgggcgcgtggatttctccgcgcgcgcgcacccgcgagagagagaggccccctgtcgtgagagcgctcgtgtgagcagcccactctcgtgcgtcactccacgcgcgtggtgcgcggcccctatagagaaaactctcacatctctctctctctctctcgtgtcgcgctctcgtgtgcgcgcctctctcgggtgcgcgtctcttctcctctctcgtgtgcgtcccccctctgtgtaagctattgttcccccactgtgagagagagatatacccacgagagtgagagagagagcggagtgtatacacgagagggcgcgcgatgagaccccccgaacacaccccgcgaaagatagccaccccttgaagagatgagagagaggttcacaccaagcgcgtgtgtgcgcgcgcgccacgccggtgatgagagagtggcgcgcctctcctcactagacccacatcaacaccccgaggtagtatcaccacgccctctgttggtgggggagaccatgagctgctgatgtagtagctcccccgcccaactgcggtatcctcacctcataatcactcgctcactcacctctcactgcggtgtggtgacaaacacaaacaagagagaaaaacggaggggaacaaagaacaaaaagaggcgcacacaaaaaaaaacaccgccgcagaagagggaaagaagaggaaggcgactaccaattgaaaatagaacaccaaaccaggctgggtggagcaccaacagacaacagcacaaacttgattagaaacaagcggaggaacacaaacacaaaggcagagcaccacctcgcaagaaggcacggaacacagaacagcgcaggcgcacacacacacagaagcctgtcaccccacgtgtatgagactacacaaacacaaaggaacagagcaggaatcataggacgaggtactaataccccacagcgaacaacaataagaaaaagaggggaggagcataacaataggaaagcaggcagtgatgaaagacggcacacagaagacactcagctcgtcagacagcgcccaccccccctgctctgacgcccaacagaccgggcgctgaacaggcgaaggagcgagcctccactcagcgccaaacccccacgtcgcgctagtagcgcgaacgaaatacaagtcaaacgatagaaggtaaggagcacaggcacaaccaatacccatagccagtgtaaaatacaagtagacagtgcgtcgatgcgacaaaaagaaaacaagccacgtcgcagacagacgcacgcacagcacaggcttcccacacctctgcaaacaaaaaccagcctacgcttccccccatctacaacaacttcgaaggaagacgccctccaagggctagcagccacgcgacgaacacaacaggcacccgccagacaccacacacaagacgtgg

SEQ ID NO: 637510 - DNA, 352 bp, Homo sapiens
  misc_feature (352)..(352): n is a, c, g, or t
taacagcacattgctggctgcacaagaggcaggtgagttgcatcatgcacatgctgcatggacttcactgagatgctgttaaacaccacaggagccaacctatcagaatcccagcagcagaggattgattgcaaatgcctgccatgaatgattagtaagtaattatgcatgatccatcacagcagtattgtaggcttttgaattgacccagaggatccgggaccccattacactgtctctcttgatcgtgacaatgatgcaatcagaggtcaagacaggccccatgaagtatgactgcactgcgatggacaaatgaattatcttccactgggctctgtctcatacgcagccn

SEQ ID NO: 637511 - DNA, 218 bp, Homo sapiens
gcgcttcctcctagctcctggtatttgctggtaatctttggtgttgcttggcttatggcggcacaactccaatctctgcctccatcttcacgtgaccttataaggacaccagtcattggattaaggcctgtcctaatccagtatgacctcatttgaactcgactatgtttgcaaagaccctgtttccaaataaagtcccataaacaggtaaaaaaaaa

SEQ ID NO: 637512 - DNA, 625 bp, Homo sapiens
  misc_feature (94)..(94): n is a, c, g, or t
  misc_feature (104)..(104): n is a, c, g, or t
  misc_feature (167)..(167): n is a, c, g, or t
  misc_feature (186)..(186): n is a, c, g, or t
aaaatatttttaagatttcattcaaaagcacttctttaaaataaagcccctgcctgccttagattccgtgggtcatgagccatgagtccttggnacatctgagnattgggatttctttgttcaccccgcaaaatagttaatgaatggtctgcccctggcaaaaatgngggtggggcttggggaatnatgcatgttgcagaagccggcgttttttattagcggtcttgagtaatttcccttggcaaaatcccaagttttccactctctggaccaagatcctgggagctgtcaccaagagccaggtaagtgagcagttatggcaagcactttccatgtggtgcttccgaccctggctgtcaaagtaaaatgtaaagtcagggctctgtacagttttgccatttcactgttctgctttaagcttagcttattagaactcttggtggagggtgcgtacacacattccagaaaaggcttcactcgctgggaacgtcaacccagcgagaaaggagggctagccccttctccgtggaccttatctgtggactcaggaatgatggtgtttattgcaaatgcacaatctttttcccattgaaatgtcatcacactggaaattgtcctatatgta

SEQ ID NO: 637513 - DNA, 296 bp, Homo sapiens
tgatcggccgcgggtcttgtcgaccgctaggccaccaggttcaatgtggaggctcccaggcggcccacgccggcgcttcgggatgatccggacggcgtgtggagaagcatgtagccggagctgaagacggggagccatgacagtggcgggagcgaatggagcgcgcctgtagtcgcgctgcggtaccttctggaacccaacgctgagcctcgtcatacgtctttgtgctgatgagtatgccacaagatacatgcaggcgcgacccagagcgagcctcgtctggcgtcgagtcaata

SEQ ID NO: 637514 - DNA, 553 bp, Homo sapiens
  misc_feature (2)..(2): n is a, c, g, or t
  misc_feature (88)..(88): n is a, c, g, or t
  misc_feature (107)..(107): n is a, c, g, or t
  misc_feature (122)..(122): n is a, c, g, or t
  misc_feature (139)..(139): n is a, c, g, or t
  misc_feature (160)..(160): n is a, c, g, or t
  misc_feature (162)..(162): n is a, c, g, or t
  misc_feature (166)..(166): n is a, c, g, or t
  misc_feature (173)..(173): n is a, c, g, or t
  misc_feature (176)..(176): n is a, c, g, or t
  misc_feature (179)..(179): n is a, c, g, or t
  misc_feature (434)..(434): n is a, c, g, or t
  misc_feature (439)..(439): n is a, c, g, or t
  misc_feature (442)..(443): n is a, c, g, or t
  misc_feature (460)..(463): n is a, c, g, or t
  misc_feature (481)..(481): n is a, c, g, or t
  misc_feature (503)..(503): n is a, c, g, or t
gntgggggaatgtgaatcagggcttgtaaataacttcttctgggtggcttgtcttgaggatttcattgaaaatgcccgtctcttcatntttgagactttctgtcgcnccccccagtgtttcngcattaacatgttggcngataaattggacatcaccccngnagangctgaanggnggnttgtaaatttgattagaaatgcaaaactggatgccaagattgattctaaattgggtcatgtggttatgggtaacaatgcagtctcgccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaanaactntcnnagaaagatgaaataatnnnnctattatataaagggtgncttacattttggaaacaacatnttacgtataaattttgaagaattggaataaaattgattcattttaaaaaa

SEQ ID NO: 637515 - DNA, 287 bp, Homo sapiens
ttagctgggccttccgtgcctcctggaagcagcaagattggaatgaggggaaggagggtgttctgctgggtttatgtccccctccttacttacaaccaccaccctccctgtcatgggtgccctgagccagtggtgcttgtaacctgagcaggcaaatccttcttattcatgtcccgatggtctgaccacaaaacaggcgtttgtgcctgactgaaccccacccttggtccggcgcttactaaagccggacccttcagggggtgaattttgggatacagtaagtttgt

SEQ ID NO: 637516 - DNA, 152 bp, Homo sapiens
agtatcggtctgacgtagccagatattttcgttcactgcgattcaggcgcctgaccgacatagtgccaccgatggacggggatattgtgctggtttcgcctgctccatcgcaattgcacctgataatccgagcgatggtgcggctatgttgc

SEQ ID NO: 637517 - DNA, 1364 bp, Homo sapiens
  misc_feature (160)..(160): n is a, c, g, or t
  misc_feature (301)..(301): n is a, c, g, or t
  misc_feature (336)..(336): n is a, c, g, or t
tgcccctcactttacataaactattatactagcactttaccatctcacttctaggcaatactagctatatcgctcacacctcatatcctccctactatgcctagcaacggcaatacactactattcgcctgcttcacttactaacgctactcctcacttnaacccttctaacaactccacctccacctcctctacgcccacactactctgctggccatattatggcacactaccataacgctcctctctggcccggaccattgccgcacacgctacgcccgcgcctgcgcgcctcctcagncactcataacataagcctcctccaactcctcacgnagcaccactacttgcgccctacgcacctaacgctaacactacacctaaaaccctaactccaaatgcctaacaacctaatcgtcccaacaactcatattacctacccactgacactgactttccaaaaacaacacactaactccgacctccaaccacaacccacccacagccctaactctactcagccatcatcccctcatactaatcccctaacccaaactcaacaaccaaccctatcttagcctgttccccaaacctcttccctccgaccccctaacaaacccccctccctaatacctaactacctgactccctaacccctcacaactcatggccaaggccacagccaacttaattccagctgacaaccacctactcacgacaacacacactctatacctccatctaatacctaaatctcccttacaaatttccttaacctcataaccattccaacagcccaccgtacactcatcactctctcacaacatccccctcggaacccacacttataccccacactgcgcttcccactccccgagtagcaccagccacaacgccgtcacccagccataactccaccctctaagcccgagaggggacccgccgcccaaatcactgcgccgaactcaaccacaaaaccccggcccccacaacagtcccaccccccctcaggccacgaacaatccccgcggcacacccactactcgcacccccgcaccgacgagaacctgcggcaccagctccaactctctgcccgcgtgacagacgacactgagcgcagagcccaccgccgaccccccatccatgacacccgacgaccagccatcaccatacaccacaccacccccgccgccgcgaggcagcccacccaccacccatccgacccaccaaacccaacacaccaccccgaccaccaacacacaacccacgcgccgacacgcaccccgccccacgaccacccaccaacaccagcacaacacaccacacaacccacgccgaccagcgcctcacccccaccaccgccc

SEQ ID NO: 637518 - DNA, 199 bp, Homo sapiens
  misc_feature (4)..(4): n is a, c, g, or t
aggnagatcgaggaacaatacagatccctacaagcgggccgtgtactgtatcattggcagatgtgacgttaccgacaaccagagtgaagtggcggacaaaactgaggattacctgtggctgaagttgaaccaagtgtgttttgacgacgatggcaccagctccccacaagacaggctcactctctcacagtcccaggat

SEQ ID NO: 637519 - DNA, 910 bp, Homo sapiens
  misc_feature (11)..(11): n is a, c, g, or t
  misc_feature (15)..(15): n is a, c, g, or t
  misc_feature (19)..(19): n is a, c, g, or t
  misc_feature (24)..(24): n is a, c, g, or t
  misc_feature (38)..(38): n is a, c, g, or t
  misc_feature (56)..(56): n is a, c, g, or t
  misc_feature (67)..(67): n is a, c, g, or t
  misc_feature (82)..(82): n is a, c, g, or t
  misc_feature (85)..(85): n is a, c, g, or t
  misc_feature (236)..(236): n is a, c, g, or t
  misc_feature (297)..(297): n is a, c, g, or t
  misc_feature (305)..(305): n is a, c, g, or t
  misc_feature (448)..(448): n is a, c, g, or t
  misc_feature (686)..(686): n is a, c, g, or t
  misc_feature (819)..(820): n is a, c, g, or t
  misc_feature (897)..(897): n is a, c, g, or t
tattttaaatngttngaanttttntagagccaaaaagntcttaaagaagttgtttntcccaaaaacnaagccaggttaatgncantcaattctaaatgatacattggaattgtgccttttctaccacactggattaaataaacttgtcaaaatatggttttgtcattttctgagacacttggtaatttgctgttctttctttcatgtgcccgttagtacatttggccaactgaccncctgtaacagggaggtctcatgtttgttagtagatacgcaggtaaggaaacttgaattcancctctccncggctcaggtctttgcttttcttttaatatatgcatataaaatagtaggcatttgattctgcaaaggaagtagagtagttgaattaaagattgtgtcgagagggataataccagggtttcgttttcgtgatgtgtagtaagtntgaggtccttgaaagaaataggtggagtattcaaaatttgcttgagtgaatcgaaatgtgaaaaagggaagggaagtcgatgaaagtgtgtttcctcctgatttcccatgatgtgtgtgtgtttagtattgtttaaggaatgatagatgtagaccatgttttgttgaggttcatgagattgatgttgatcggggagtagtgtgaggaaaatgtggtgtttaaaatggagtgtgagtanagtgtccagcctgggtaagtttccacgtggtgttgacaggtgtgccccatgtccgggagagtaaggggggagtgtgtggataataaaatccttcttgatgtgtgaggaaaggagttgtttggtgccctccagnnggtctggaagtgtggtgaggaagcgagttaatggtcttgtaggaagagttgtggattccacctggaggagcaggtgngggggtatgcggg

SEQ ID NO: 637520 - DNA, 287 bp, Homo sapiens
ctagagccatatactcagatataaagcacagagattcatatctattaagatttatcatatataagcagcaaatctctggtccgctgtgcttctgcaacctaaaatctttaaagggaggtaggtgtgggcaggaggaggaatgataaatagggccagggcaagaaaaatctagcttcatataattagtctgggactatacaccctatataatgtaagatttacagaagtaatcatgacttttgattgctacataccacaaagagattaatgaacagcatgggctgtat

SEQ ID NO: 637521 - DNA, 256 bp, Homo sapiens
gaacgactcatgatcattgaattgaagatgaagatcttagaaaatcagatcttcattagatggaataaaatgaatctccacgggcgctcagacatacagcagagttttgtcttgaaaaaacacagaatgaggaggcatgagtcaatttgctccaccctgactgactgtatatagactttccccagctaatgagtctgaggcggggtgacctctatcgatatggcgttttacttcactaaaacccagtcaccgctta

SEQ ID NO: 637522 - DNA, 1394 bp, Homo sapiens
  misc_feature (63)..(63): n is a, c, g, or t
  misc_feature (72)..(72): n is a, c, g, or t
  misc_feature (102)..(102): n is a, c, g, or t
  misc_feature (337)..(337): n is a, c, g, or t
  misc_feature (1027)..(1027): n is a, c, g, or t
  misc_feature (1312)..(1312): n is a, c, g, or t
  misc_feature (1316)..(1316): n is a, c, g, or t
  misc_feature (1322)..(1322): n is a, c, g, or t
  misc_feature (1325)..(1325): n is a, c, g, or t
  misc_feature (1328)..(1328): n is a, c, g, or t
  misc_feature (1364)..(1364): n is a, c, g, or t
gggtggggacggcgccctcaccgcgagtcacttgtcagcccttgtctgaggcggaggagcccncgccgcgcnggacccgagcatatttcattttctgtcatnggactttgagccattagaaccatgagcaactacagtgtgtcactggtgtggcccagctcctgtggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattangggtggtacaggctctttgaatatgactctgcaaagagcatctgtgacccaaagcctgagccggttcctgttcaaaagaaaacacaagtgacaaataaccctggcactgtgaaaatcccacctaaaagcccaccaagaaaacacatgtgtggagcgctatacagagttttatcatgtacccactcacagtgatgccagcaagaagagactgatgtgaggatactgaagactggcgtccaaggactggaacaactcagtctcgctctttccgaatccttgcccagatcagtgggactgaacattgtgaaagaatctgaagcgataatacaaagaaggcaaggaaaaagatacccttcagtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaattggccttatgaaaaaatagaactttttctatacttttctaacaatttcctatggtggtgagaaaaggaagatgaacatgtttggtgctagtgggtagctcacaaatgtaaaaccaaaaaaaaaaaaaaattagaaatttaggggactagatctattgggggattggtatcngttgggtggggataaggggtagtaatcttgggaaaacgatttttttccaaaagtggaattggggtaagtgggtgggtggaagcagagggatattggagcaaataaaggtcctggtctaattggggcaaatacttcctttattttattatcttctcccaaggataacttttaaaggtccattattatggtaccttccaacggtggatggtaatttatcctaaataggtaatatatgggggcagataaccaaagactttttacagaagagtgggtgcttggcagatnaggnctcttnaanagnaggcctatccggaggctctatgaagaggagggaggnccaatgggctctggaaggcgagaggagatc

SEQ ID NO: 637523 - DNA, 105 bp, Homo sapiens
atcccgctgtgggtctagctctctgcaagccctggcattgatcgagtcggacctgatgcttggtgtgacctgagtaaatttgacctccctgaggaaccatctgca

SEQ ID NO: 637524 - DNA, 818 bp, Homo sapiens
gacagtgctgacactacaagggctcggagctccgggcactcagacgtcatgagttggtcctgtgcgcccccggtaattgatagttctgctagcttgctactgtctctgtttattgtgctcatctttcaagcagtggtgtatgcatagtgcttgcgtatcctagagtagcaagctgcgtggatcgttagtatgaatagattgctggtagttgattgtcgcaaccatacactgtgtgcatttgcgaagatttgcgtgtctacttagtcataatgcgaaaagtagacaagggatctggcagtctttggtaagactactcttactagtcgagaagttagataaagcaaaagcagtgcatgatagtcaagatcgggctgtataaaagcaatcctataactcgagcttgagtaatccgtgatgaatcatctaaaatcggaaatatggatagagtgcgtgttactttggaagtcgcaggacgaagatgttggaaggaaattatgaaggtatgaaagcatgcgattttaacacatgatctcaagtagttcggatagtttgcaggaaatatagtaatgtcgaggataatcaaatagattgtgtaaccgtgaagagagaaggtagcccagcttgaagacacagtgccatggcaaccttgccaaaagacacggtgcaaatccatgatatcgactgggaaccgattgtccggagacattgccaataagggagctgatacagacgcgggcttcactttaattaaacctctgaaagctaaccagcaattcttaggtctactgtgacactcgctgggtctcggaaattggatg

SEQ ID NO: 637525 - DNA, 812 bp, Homo sapiens
  misc_feature (445)..(445): n is a, c, g, or t
  misc_feature (730)..(730): n is a, c, g, or t
  misc_feature (734)..(734): n is a, c, g, or t
  misc_feature (740)..(740): n is a, c, g, or t
  misc_feature (743)..(743): n is a, c, g, or t
  misc_feature (746)..(746): n is a, c, g, or t
  misc_feature (782)..(782): n is a, c, g, or t
ctgtgcatgatggaattagtctaaaaccttataccttcatcttagtatgactcttctatcactcatatatgtgtgggaccagtgtatgtccacaggaaaaagatacccttcagtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaattggccttatgaaaaaatagaactttttctatacttttctaacaatttcctatggtggtgagaaaaggaagatgaacatgtttggtgctagtgggtagctcacaaatgtaaaaccaaaaaaaaaaaaaaattagaaatttaggggactagatctattgggggattggtatcngttgggtggggataaggggtagtaatcttgggaaaacgatttttttccaaaagtggaattggggtaagtgggtgggtggaagcagagggatattggagcaaataaaggtcctggtctaattggggcaaatacttcctttattttattatcttctcccaaggataacttttaaaggtccattattatggtaccttccaacggtggatggtaatttatcctaaataggtaatatatgggggcagataaccaaagactttttacagaagagtgggtgcttggcagatnaggnctcttnaanagnaggcctatccggaggctctatgaagaggagggaggnccaatgggctctggaaggcgagaggagatc

SEQ ID NO: 637526 - DNA, 660 bp, Homo sapiens
gagaaatgcacactaaggaaaattaaaaacaaaaaaacaaccattttgcctatagtcatctgaaatcttcacattcatacccctcgtgtctgcaaggcgaatatgaccatgtttcatccccatgtctgtgttggacacagcgtagtctcaatcagacccggtcacctccctttgctgccatttgagagctgatcgatgctggacccgctccctcctccctctctgcctagtttctcgcccctcagattaggctctgtctgtggctagcttgaggggtggccatgaggcctaaatgagggcgtatctatatggagacagcacttggcctgcggctctcccacattccctgttagtctctcacacaggcccaaaaccttgctttaaaaatgctgcctaccacgaaactttgcatcaggacgcgcccgtgaggaatttgttcttgtttaatgcccaggacgtttgcatgaaaacaggatcttccgtgcttaggaattgataacctcctgctgctgcttttccttgctgaaaggccagtcccatattgtgccaagcaaacccatcaccttgtgggatggttgggacctccccgattgaggatgttgctgctcagcctatgcacaggcatggagcggaagaataggaccattttgagagcgttgc

SEQ ID NO: 637527 - DNA, 661 bp, Homo sapiens
  misc_feature (294)..(294): n is a, c, g, or t
  misc_feature (579)..(579): n is a, c, g, or t
  misc_feature (583)..(583): n is a, c, g, or t
  misc_feature (589)..(589): n is a, c, g, or t
  misc_feature (592)..(592): n is a, c, g, or t
  misc_feature (595)..(595): n is a, c, g, or t
  misc_feature (631)..(631): n is a, c, g, or t
tcgttttccaagattactaccctaatcacaacaaaaacagatacaaatccacaaatagatctagtcacataccttttcatttactttttttttttcaacttcatagcaaaatctgtattaaattggccttatgaaaaaatagaactttttctatacttttctaacaatttcctatggtggtgagaaaaggaagatgaacatgtttggtgctagtgggtagctcacaaatgtaaaaccaaaaaaaaaaaaaaattagaaatttaggggactagatctattgggggattggtatcngttgggtggggataaggggtagtaatcttgggaaaacgatttttttccaaaagtggaattggggtaagtgggtgggtggaagcagagggatattggagcaaataaaggtcctggtctaattggggcaaatacttcctttattttattatcttctcccaaggataacttttaaaggtccattattatggtaccttccaacggtggatggtaatttatcctaaataggtaatatatgggggcagataaccaaagactttttacagaagagtgggtgcttggcagatnaggnctcttnaanagnaggcctatccggaggctctatgaagaggagggaggnccaatgggctctggaaggcgagaggagatc

SEQ ID NO: 637528 - DNA, 616 bp, Homo sapiens
  misc_feature (280)..(281): n is a, c, g, or t
ctcaactgttttgtgagtgttcaattctacagcatctacactcatccgatttgctgggttgtaatttcattttatgcatctctgcagcttttcttcttcttcacacaatattttacaaatctttttgaaatcctttctggtattgacaaaagcacgtccctttcagtccgacgacaaacacgtctgtttcatacctgcaatgcaggccacttcggctttggacttggccagttctttacacatggactcgagagctgacatgaggaatgtaccccatccnntctccgagactctcatctcaacgggagggtggcattgcacttgggccatgatccctctgaaatcccaacactttgggatgctgacgtgggagggctgcttaagaccaagagttcgacaccagcttggcaatagagtgagatccccttctctaccaaaaatttaaaaagtatccaggtgtggtacacgcctgttgtcccagctactcaggagcctgaggcaagaggatcacttgagcctaggagttcgacgctgcagtgacctatgaccacaccactgcactccagcttgggagacagaacaagaccccgagtcggccgcagcttattcccttagg

SEQ ID NO: 637529 - DNA, 149 bp, Homo sapiens
ggaaattggttcgctatttcactttgacccgggagaacccccacggaaatcattgcaaattcaaggagggttccaattctttcggtgtttcaacttttaaggaaccacttcggtgaaaacttccttcagggcccattcaagggggtatt

SEQ ID NO: 637530 - DNA, 443 bp, Homo sapiens
  misc_feature (292)..(292): n is a, c, g, or t
tcgtaccagatatgcaagaacccaggcgcgatggctcacgcctgtaatcccagcactttgggaagccgatgtgggaggatcacgatgtcaggagttcaagaccagcctggccaagatggtgaaaccccatctgtactaaataaaaaaattagccgggtgtggtggtgggcgcctgtaatcccagctactcaggaggctgaggcagagaattgcttgggcctgggaggcaaaggttgcagtgagctgcgatggcgccactgcactccagcctaggtgtcagatcaagactccntctcaaaaaaaaaaaaaaaaaaaaagggattagcacggtgtaattactaggctcttttgaatggctgattaatagtccatcttatgaagattcgagtttgggtcagcctacttattggggggacatggggggtcctcggcatcatcggggg

SEQ ID NO: 637531 - DNA, 303 bp, Homo sapiens
caaccttacatgcacaacccgcgggctacttacatgtccctcaatgtcctttcagaatatatggtattactgtacaatataatactggattaacatcgtcatcgttattgcctgtctaccatatgatggatgtgaaaatctacggccaaatactttagaaaacacctttctatattgcacagtgggcaaatggcttatgtgaggtaagacactagagggatacatttccagatcaacatggctatggtatttagtaatggcccagcttagagacttcagctactgatctcatcacttattaga

SEQ ID NO: 637532 - DNA, 528 bp, Homo sapiens
tagactgggcaaagagggaggctctgtctcaaaaaaaaaaaaaaataggaaaagaaagaaaatgaggtaacagagtcataattgtagtagcatgatttctataatatggaaaaaaaacatatccatggttaagttaacctactaaagaaaataaagttatatggctccagttcgtaaagttatttacaaaaccaaaataattaattaagtattttaaaaaagcaaatacaagtctgggacgggtaggtatgaacttaatgggagcaattttctgtacagtttcccttgagtggaggtaactaagtagctacagtataccttcagatggatttccagctcatggtaagcggagaacagggtcagctacagctatgttacgagatctgggtaatttaaaagaagtttccgttgcagttgtaacagatgtgatttactctagtaagcaacccagggaggtaaaatcgttaccctgtctctgtagccttctgtttactgaaaatgcttttcattctgcaaaccacagaatct

SEQ ID NO: 637533 - DNA, 420 bp, Homo sapiens
tgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctcaaa

SEQ ID NO: 637534 - DNA, 109 bp, Homo sapiens
ccgaagtagcccttttatatacccaagacatggagaatatgagtgatgatgatggttgggaatttgtgaaccttggacatcagcaaagctttggtattaaaactgcagg

SEQ ID NO: 637535 - DNA, 308 bp, Homo sapiens
tatagtatgataaataattggacgtatgtttagtttgaagattgtcctatttgcctatcttgctgcaggaaacatggacttctgattaggttaacagattgtgaacttttagtgtaaatgttaagtgctttcgaggagaccaaactattattaatatataaaatggccttgcccttaaggagcaaattaaatctcatggagattagactcaaaaggcaataaataatcgagggtatatgcaatgacatagaatttcagaagagttaggatctcaaagattgtccttcactctcagaaacaggcaagta

SEQ ID NO: 637536 - DNA, 1129 bp, Homo sapiens
ggcaagatggcggcgccaggccgccgcctgccaggctgtcgggcgtcatggtgccggcgcccatccaatgacctggaggccctgcgcgcgctcacggcgctcttcacagagcagcggaaccgagaaacagcacccaggactatcttccaaagagttctggatatcctaaagaaatcttctcatgctgttgagcttgcctgcagagatcatcccaagtggaaaacctggcttccagtctgcagttaataacagaatgcttcaggtgtcttcgcaatgcttgcatagagtgttctgtgaaccagaattcaatcaggaacttggatacgataggggttgctgttgatttgagttcttctgtttcgtgaactgggagtggaacaggaatctctgttgacagcgtttgcgctgtggtccgctgcagtgttgttaggcaacgattgctctcgacggaatgaagattcccagtctattgtgtgggtgcatgctttcccagaactgttcttcgtcttgcttaaatcatccggacaaaagaaattgttgcctactcttgcaagtagatttgtgtacatcccttaatcatgaaagaatgaaggaactggaggagaacctcgaaatatgcaattgatgtcatagatgcttgtaccaaaaacgatcctgaatcagaatggcgttctgtgattattacagacctctttctgaaaagcccggaattgggtacaaagccatgtttcccaaactgaacaatcaagaaagagttaccactgttagaccttatgatagccaaagataacgagtgatgagccactcaccaaggatgacatccctgtgtttgtgcggcatgctgagttgatgcaagcacctttgtggatcagtgcaagactgtgctcaagctggctcatgagggagccttctgatgatgaggaaggcactgggcacaataggctctcggaagtccgggggaaatgatgggatactggactgtcgctaattgaaggttcccggtgctggaagaaaaagactttgcggggacacagaggcgggaaaaaaccaagcttcaatgggggataagacaagggtacccaggcacagggaacatctacacaaggaaagttcacaacaacaccaaaaa

SEQ ID NO: 637537 - DNA, 121 bp, Homo sapiens
cctagcgggagcacatccttacgtgaaataccctcaacaactaagaaaatcacaaccactatatattaaatctatgatatctatatggaacaacaattacatatagaaatctagcatttct

SEQ ID NO: 637538 - DNA, 253 bp, Homo sapiens
  misc_feature (41)..(41): n is a, c, g, or t
caacgccacaactccggatctttttactgtttccatgattntgtcttttccacagtgtccaagtgttagaatgactcagtctgcagccatctcaaagtggattctttcccttagtcataagtatttaaacttcattcatgtcgttttatgagctaaccctttttttcttcctcttcttttttttttttttttttttttttttttttttttttttttttgaaacccgggggggttttaaattgggggggggaaa

SEQ ID NO: 637539 - DNA, 336 bp, Homo sapiens
ttttttttttgagatagagtctcgctctgtcactcaggctggaatgcagttgcatgatctccgctaactgcaacctccacctcccgggtccagggactcccctgccccaccctcccgagcagccgggaccacaggcgctcgcaccacgcccggccaatttcttttttttttcagtagagatggaatttcaccatatcggccaggctggtctcgaactcctgacgttgtgatgtacccgcctcggcctcccaaagtgcccggactacaggcgtaacgtattgcacccagccatgtgcaggtctttttaggcaaaacaatgccaggcactcaaagaat

SEQ ID NO: 637540 - DNA, 404 bp, Homo sapiens
gccatcctcaaagactctatgtgtacagtacagaagagcgcatataactaataagtagttgatcgcgctaggctgccctcacctctgagtgggaccgaggacttctaggaactagtacaatacagtgtccatctctgtagttcagttcacactttactcccaacttgcttcatccattgctattgcctcacagtggcaggcagatccttggataagaaagaattcaaatttgggaccacacactttgaattccaaatggaaacaccattccctggaattagactgcttccattgcaaaaagaatgatgtagttacttagtatgtccttgcttcttttttcatcgcatgtacctcctttaaacttaatatgaaaactctccaagtcttgatcaccaccaggacat

SEQ ID NO: 637541 - DNA, 535 bp, Homo sapiens
  misc_feature (58)..(58): n is a, c, g, or t
  misc_feature (60)..(60): n is a, c, g, or t
  misc_feature (66)..(66): n is a, c, g, or t
  misc_feature (86)..(86): n is a, c, g, or t
  misc_feature (112)..(112): n is a, c, g, or t
  misc_feature (516)..(516): n is a, c, g, or t
taagttgatctgattcgcaactaccttattagcataaatgaaatgtctctctgcatancntagcgntactgcctgatcgaaaacantaaccacttcttacgtaatcatgctnggctgccgtgggcagttgatcaaatgcgttcgaggacaagaacgttagataaagaggcgccgctctgttgatgattcccgaagcatgtaccgtgcttcacacaagacatcctaaaatgaacaatccagcaccatgacgacatctaatcaatcaggaggcgagcctaaattcttcagtccttccaatctcttacctctggcgccaacgtactctcaaatcagcatggcacatttcaccgccagctccagaattgtctgcataagcggtcaaccaggaatcggtgcaaacacagatatgtcctcgccaccatcattcccagagcaagtcaaagcggcccttgcgaacgtggataagtgccttgctgcagcaggagcctcaaagcaaaacatcgtacgcaacactcnatacatggttccacatggc

SEQ ID NO: 637542 - DNA, 171 bp, Homo sapiens
ttgtgaggacaagatcaactggggtggtgtgtgtgtttgtagacaagatacagctgtggtaggtgtgtgtgtgagacaagatcagctggggtggtagtgtgtgtctggtgaggccttcttgcatactcacatggcagaagcggggaagagggcaaacagggcctaaggtag

SEQ ID NO: 637543 - DNA, 410 bp, Homo sapiens
ttctcccctgacactgtaactaaaaatttagaaactaaaaatcatttttaaaaagtgcttccattgctgtgcttcacaaagcacaacatgatgaaaaaacaaacaaaaaggcagctgggcatggtgacatgcacccataatcccaactactcaaaactgaagcaggagaactgcctgaaccagagatgcagaggctgcagtgagccgagatgatgccactgcactccggcctgggtgacagagcaagactctgcttcaaaaagaaaaaagaagatcaggcgtggtaactcacacctgtaatcccagcactttgggagtccgaggcgggcggatcacctgaggtcaggagttcgggacctgcctggccaacatggtgaaaaacccatctctactaaaaatacaaaaattag

SEQ ID NO: 637544 - DNA, 762 bp, Homo sapiens
agcgggagtccggtcacggctccggcgcgagcgcgaggctagcagcccccgagtttctcggccgtctatcgccccctactccccctcctttcttctaattactctgactctacctgcctctcgccgctgcatacctacccgacgctcctaccggcactagaatcctacgaacctataaatgtgcataatcccacctaaaccctagaccgagtcccctacgcgtagccacaaatgcgccaccggcggagcagggcacaggcagaggacgacagagaccacaccacagcagaagcaaaacaacaaaagcaccaaacagaagaaagcgacaaagggaacatgcgactgtgacccggcacccacccagcgagtccgacaggcgagacacgaccgacagcgtcatgccgaccgccgtcacacgcgacacgagcaacatcggggacagccgccacaacccactgcgcgtgagcgcgcgcaagaagcccagcagatggacgagaccccactccgagcctcagcgatgacagacacccacaacacagcacaccacatcgacagtccatgacccacgcgcgcaacgccggccgcagagaagcacagcccgacggcacggaccgccaggaccgcagcgccgcagaaaccgcgcgtcaacaccggacactcaccggcggcccctcgaagcgactgcaaaccgaaccggagagcgcgacgatgtagacgcccgcagcagcgccccatccataacggcgctctggcgcggcgcct

SEQ ID NO: 637545 - DNA, 217 bp, Homo sapiens
tggagacaggggctcattttttcaccaaagtgggagggtgggggtgggaacatggctcactgcagcctctgggcctaaagggattcttctgcctaagcctctcaggtggctgggaccacaggcatgtgccgcctggttaatttttaaaattttttatttatttggaagagagggggtgcgcactatgttgccaaggctggtctctaactctgggcct

SEQ ID NO: 637546 - DNA, 339 bp, Homo sapiens
  misc_feature (209)..(209): n is a, c, g, or t
  misc_feature (305)..(305): n is a, c, g, or t
  misc_feature (315)..(315): n is a, c, g, or t
  misc_feature (330)..(330): n is a, c, g, or t
tttttttttgctttgttttgttgtttgttttttccatctctattgttgtaagtccaaaggccatgtttaagagtttgcttataggggtttagagtcccactgctgctctttttaggttcctcccaacatcaggggtagattgagtaataaaatgcacaaccaggagagtttgcccttccagggagtctgggtctgcattagtgtatttnttgagtacctcaacaaaaaggctctgaaacacagcaggacttttgtctttcccgagttacttctttaattttgtcatgtttaactggcttaacgangcatgttttnaaatatattaaacangttaccagg

SEQ ID NO: 637547 - DNA, 751 bp, Homo sapiens
agaacactgctatagaagaatttagcacaccaaaattccgctgaaagtctaaagtatgtgtccataacttacactctgaggcaatctgctcagtgtgtagccactttataaaaggataagttacgattgataacctggaaaggtggactatttgtaagtagctggtgtttatggattaaaccatggcacagtattcatgatagtccaagacatgtagctgaaatcggagtgcatcttgaaagagctgtggagtgataatgctgaaactttggatgttataatgaatctactcatgtgtgtaaggagtatttaagtctgtaggaccacaatgatagaaagctcagttagggctgcttacgtgacaattagttgacatattaatctggtaaggtagtgggaagtattgtgaatatttcacctgggagaggcagttagagacatcattagtgtaatacaggtgcaggcggggggaacgctccaaaatagcctacaagtatagtaaggtccaccaggctccaagaggaaaaagctgtgattatattacatcagtgactgtaatgctcgctgaccgcgctacgtactcagtagctaaacaaatcatacattagagactaccacagaaaaacaccaaccaagacacacccagccaaagaacgacggtcaaaaacacaaacaagaagccacacgcagcgccggccccacagccaacaagaaacaaagtcggggcaacgcacgcacacagacaacacgt

SEQ ID NO: 637548 - DNA, 1058 bp, Homo sapiens
  misc_feature (218)..(220): n is a, c, g, or t
  misc_feature (223)..(224): n is a, c, g, or t
  misc_feature (229)..(229): n is a, c, g, or t
  misc_feature (243)..(243): n is a, c, g, or t
  misc_feature (252)..(252): n is a, c, g, or t
  misc_feature (413)..(413): n is a, c, g, or t
  misc_feature (500)..(500): n is a, c, g, or t
  misc_feature (514)..(514): n is a, c, g, or t
  misc_feature (516)..(516): n is a, c, g, or t
  misc_feature (518)..(518): n is a, c, g, or t
  misc_feature (651)..(651): n is a, c, g, or t
  misc_feature (685)..(685): n is a, c, g, or t
  misc_feature (705)..(705): n is a, c, g, or t
  misc_feature (722)..(722): n is a, c, g, or t
  misc_feature (767)..(767): n is a, c, g, or t
ccttttccctcctcagttggccgagtcgtcccgctctcaccctccggcgcgcctatgtgaatgaggtggtgacgggcccccggatgaccccgagtcatcactgggagctctgcacctctgccgcgaggaggaggaggaaggaagaggacgagaaggtagctacaccaagctggtacctgcagatccaaggatatcatgaagtttacaggggcctttgnnnacnngagangtctctttcctgtnggaaaggcnatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtctttnggataggtttttagctaccgtaaaggctcatccaaaatacttgagttgtattgcaatcagctgttttttcctagctgccaagatgtngaggaagatgaganantnccagtataaggtatggcaagagacagtttctgtggatgttcctcatctgaaattttgagaatggagagaattattctggataagttgaattgggatcttcacacagccacaccattggattttcttcatattntccatgccattgcagtgtcaactaggcctcagtnacttttcagttgcccaaatngagccatctcaacattnggcagtccttaccaagcaatacttcactgtatggctgcaaccaanttctgcatcagaggatccatgcttgctctggcatgttagtctggaactggggaactcattcctgttgggttctcttaccattgacctggttcgaacgcacgttggtccccaggagccctggcggacttgtgcctcaccttttaccggggttccggccgaatcggggttaccggcctcaaggcctggcttgccaggggtcgtaatcttctgtcggccagttccgacagcgcagcgcaggagctccacccccgcgggccacacagggggtttacctataggttagcccccctt

SEQ ID NO: 637549 - DNA, 87 bp, Homo sapiens
  misc_feature (25)..(25): n is a, c, g, or t
ggtgtcatcaccattgaatcccagntgcacccgcagagcccactgtgtcccctgccaggctccgctttcactttgagcactcccagt

SEQ ID NO: 637550 - DNA, 1094 bp, Homo sapiens
  misc_feature (218)..(220): n is a, c, g, or t
  misc_feature (223)..(224): n is a, c, g, or t
  misc_feature (229)..(229): n is a, c, g, or t
  misc_feature (243)..(243): n is a, c, g, or t
  misc_feature (252)..(252): n is a, c, g, or t
  misc_feature (413)..(413): n is a, c, g, or t
  misc_feature (500)..(501): n is a, c, g, or t
  misc_feature (513)..(513): n is a, c, g, or t
  misc_feature (534)..(534): n is a, c, g, or t
  misc_feature (539)..(540): n is a, c, g, or t
  misc_feature (562)..(562): n is a, c, g, or t
  misc_feature (687)..(687): n is a, c, g, or t
  misc_feature (721)..(721): n is a, c, g, or t
  misc_feature (741)..(741): n is a, c, g, or t
  misc_feature (758)..(758): n is a, c, g, or t
  misc_feature (803)..(803): n is a, c, g, or t
ccttttccctcctcagttggccgagtcgtcccgctctcaccctccggcgcgcctatgtgaatgaggtggtgacgggcccccggatgaccccgagtcatcactgggagctctgcacctctgccgcgaggaggaggaggaaggaagaggacgagaaggtagctacaccaagctggtacctgcagatccaaggatatcatgaagtttacaggggcctttgnnnacnngagangtctctttcctgtnggaaaggcnatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtctttnggataggtttttagctaccgtaaaggctcatccaaaatacttgagttgtattgcaatcagctgttttttcctagctgccaagactgnnttgagggaacgnactgagaggacactctccagnttacnntaaaggggctaatttcggggcnccaaaaaaagcaggacagtttctgtggatgttcctcatctgaaattttgagaatggagagaattattctggataagttgaattgggatcttcacacagccacaccattggattttcttcatattntccatgccattgcagtgtcaactaggcctcagtnacttttcagttgcccaaatngagccatctcaacattnggcagtccttaccaagcaatacttcactgtatggctgcaaccaanttctgcatcagaggatccatgcttgctctggcatgttagtctggaactggggaactcattcctgttgggttctcttaccattgacctggttcgaacgcacgttggtccccaggagccctggcggacttgtgcctcaccttttaccggggttccggccgaatcggggttaccggcctcaaggcctggcttgccaggggtcgtaatcttctgtcggccagttccgacagcgcagcgcaggagctccacccccgcgggccacacagggggtttacctataggttagcccccctt

SEQ ID NO: 637551 - DNA, 253 bp, Homo sapiens
tctgtatacatctctgtgtccaaattttccctttttaaatagatatcaatcatattgtattaggggacaccttaatgaccttattttaacttgataacctctataaagactctaagtaccattgtgaggtacaaaggagtgaggacttcaatatatgaatttgggcggacacagttcaacccataacaatgctatatgttttaaagtgttttcacagtgtgcttttatttttgcttagagtaggactaaatga

SEQ ID NO: 637552 - DNA, 258 bp, Homo sapiens
  misc_feature (118)..(118): n is a, c, g, or t
acagctcaatgacttatcacaaagcaaagccccaagaagtcaccacccagctccagaaataacacattgaaaagctagaaaaatctcaaattgacatcctaacaccacaactaaaggntctagagaaccaagagtaaacaaaccacaaagctagcagaagacaagaaataaccaagctcagagcagaactgaaggcaataaagacacaaaaaacctttaaaaatagtcaatgaatccaggagctgtttttttgaaaaa

SEQ ID NO: 637553 - DNA, 231 bp, Homo sapiens
caggtctcctgggagtcggaggggccatggttccaccccaggcccacctcatcagcacagtgctctcaccatctgagcaccagcccagaggaaaaggagaaagaatgtgtgatgctgatcccccaagcagaatggtatcctccacctcccaccctcagtgccagggcccgttgttgggtgcttttgagggtgggaggtggaggggtttccattttgatgttggagcggccc

SEQ ID NO: 637554 - DNA, 729 bp, Homo sapiens
  misc_feature (55)..(55): n is a, c, g, or t
agtgacgtgacacgcagccaggtctgtactgacgcgcctcgcttcttcctctttntcgactccatcttcgcggtagctgggaccgccgttcagtcgccaatatgcagctctttgtccgcgcccaggagctacaccccttcgaggtgaccggccaggaaacggtcgcccagatcaaggctcatgtagcctcactggagggcattgccccggaagatcaagtcgtgctcctggcaggcgcgcccctggaggatgaggcccctctgggccagtgcggggtggaggccctgactaccctggaagtagcaggccgcatgcttggaggtaaagtccatggttccctggcccgtgctggaaaagtgagaggtcagactcctaaggtggccaaacaggagaaaaaaaaaaagaagacaggtcgggctaaacggcggatgcagtacaaccggcgctttgtcaacgttgtgcccccctttggcaaaaaaaagggccccaatgccaactcttaagtctttggtaattctggcttctctctaatccccaagccacttagctcagtacaaaaaaaagcaacacaacacacaccaacaatggggggggcagcatggccacacgaaagagggtcaccaacaaccgcggaggggggcggggggcacaaagaaagacagacgggaacaggtgtacccaggaaacacgtggaacagacacagggggggggtcccacacaaaaaaaag

SEQ ID NO: 637555 - DNA, 636 bp, Homo sapiens
  misc_feature (1)..(1): n is a, c, g, or t
  misc_feature (62)..(62): n is a, c, g, or t
  misc_feature (73)..(74): n is a, c, g, or t
  misc_feature (81)..(81): n is a, c, g, or t
  misc_feature (87)..(87): n is a, c, g, or t
  misc_feature (117)..(118): n is a, c, g, or t
  misc_feature (126)..(126): n is a, c, g, or t
  misc_feature (147)..(147): n is a, c, g, or t
  misc_feature (150)..(150): n is a, c, g, or t
  misc_feature (158)..(158): n is a, c, g, or t
ngattttggaggggaataacatttttcccccaaggaacaaccctttgccctgtgttttcccnagcccgatttnnccccccntaaggnacaaaaatggaggtccccccgggggggccnntcttaaantattggatcccccgggtccanaanttcggccnaagctggggcccccgttcagtcgccaatatgcagctctttgtccgcgcccaggagctacaccccttcgaggtgaccggccaggaaacggtcgcccagatcaaggctcatgtagcctcactggagggcattgccccggaagatcaagtcgtgctcctggcaggcgcgcccctggaggatgaggcccctctgggccagtgcggggtggaggccctgactaccctggaagtagcaggccgcatgcttggaggtaaagtccatggttccctggcccgtgctggaaaagtgagaggtcagactcctaaggtggccaaacaggagaaaaaaaaaaagaagacaggtcgggctaaacggcggatgcagtacaaccggcgctttgtcaacgttgtgcccccctttggcaaaaaaaagggccccaatgccaactcttaagtcttttggaattctggccttctctaataaaaaaccccctttgttccc

SEQ ID NO: 637556 - DNA, 647 bp, Homo sapiens
  misc_feature (446)..(446): n is a, c, g, or t
  misc_feature (464)..(464): n is a, c, g, or t
  misc_feature (474)..(474): n is a, c, g, or t
  misc_feature (493)..(493): n is a, c, g, or t
aggggtctgtacattggcctggcctgcaatacggctcgctatatttatatttcctacctggagaatgcctggactgttctccccatggaagttcttcaaggtaagttaacagctgggattgaaattatttctctgccttccctgagctgtggctaaaagcccagtggccttcagcatctgattctataaaggaagggcaggcctactgtttcatgtgattttgaagtggttgttaaggaagagatgacatcaggagggatggttccttggttaccctgagtgctgctttgtgttgagccaaacaaagctggacttgatccacaccctttgggattaaaccaaaggaagaggaacctctagaataaactcctgtgcacaactattagacatggacaatccagggtgtttttaagaaataaaaatatttatcttttaaagtttttggngttttaagtttggtgggntaactatagntacctgaaaaaaggatggnggcataaataatttatcttttaagtatttttatacaattggggactattacctaagtttatagcccacccggtgtttttccataacctttaaaaatttttctcaaaggccctgcctgaggtctttttggtcaaggacctgtccccatcaggaaa

SEQ ID NO: 637557 - DNA, 634 bp, Homo sapiens
  misc_feature (1)..(1): n is a, c, g, or t
  misc_feature (62)..(62): n is a, c, g, or t
  misc_feature (73)..(74): n is a, c, g, or t
  misc_feature (81)..(81): n is a, c, g, or t
  misc_feature (87)..(87): n is a, c, g, or t
  misc_feature (117)..(118): n is a, c, g, or t
  misc_feature (126)..(126): n is a, c, g, or t
  misc_feature (147)..(147): n is a, c, g, or t
  misc_feature (150)..(150): n is a, c, g, or t
  misc_feature (158)..(158): n is a, c, g, or t
ngattttggaggggaataacatttttcccccaaggaacaaccctttgccctgtgttttcccnagcccgatttnnccccccntaaggnacaaaaatggaggtccccccgggggggccnntcttaaantattggatcccccgggtccanaanttcggccnaagctggggcccccgttcagtcgccaatatgcagctctttgtccgcgcccaggagctacaccccttcgaggtgaccggccaggaaacggtcgcccagatcaaggctcatgtagcctcactggagggcattgccccggaagatcaagtcgtgctcctggcaggcgcgcccctggaggatgaggcccctctgggccagtgcggggtggaggccctgactaccctggaagtagcaggccgcatgcttggaggtaaagtccatggttccctggcccgtgctggaaaagtgagaggtcagactcctaaggtggccaaacaggagaaaaaaaaaaagaagacaggtcgggctaaacggcggatgcagtacaaccggcgctttgtcaacgttgtgcccccctttggcaaaaaaaagggccccaatgccaacttttaagttttttgtaattttggctttttttaataaaaaagccccttagttc

SEQ ID NO: 637558 - DNA, 290 bp, Homo sapiens
cgtcgacatgggaacgaatggagtgaaattgtacgcagtagaagagaatagaatggaatgcaagtgaaaggaaaggaatggattggaatggaatggaattcattggaatggaagggaatgtagtgtaatggacaggcctggaataaagtggaatgctacggtctcgaatggaataaaaatgtatggaatggaatgcaatgaaacggaatcgaatgtcatagaatgtaatggaatgcaaaaaaatggactccaaaatcattgactggaaaggctgggtgtcgagtcgacgc

SEQ ID NO: 637559 - DNA, 549 bp, Homo sapiens
  misc_feature (55)..(55): n is a, c, g, or t
agtgacgtgacacgcagccaggtctgtactgacgcgcctcgcttcttcctctttntcgactccatcttcgcggtagctgggaccgccgttcagtcgccaatatgcagctctttgtccgcgcccaggagctacaccccttcgaggtgaccggccaggaaacggtcgcccagatcaaggctcatgtagcctcactggagggcattgccccggaagatcaagtcgtgctcctggcaggcgcgcccctggaggatgaggcccctctgggccagtgcggggtggaggccctgactaccctggaagtagcaggccgcatgcttggaggtaaagtccatggttccctggcccgtgctggaaaagtgagaggtcagactcctaaggtggccaaacaggagaaaaaaaaaaagaagacaggtcgggctaaacggcggatgcagtacaaccggcgctttgtcaacgttgtgcccccctttggcaaaaaaaagggccccaatgccaacttttaagttttttgtaattttggctttttttaataaaaaagccccttagttc

SEQ ID NO: 637560 - DNA, 1125 bp, Homo sapiens
  misc_feature (23)..(23): n is a, c, g, or t
ggacgcgtgggtcgacccacgcngtcgcccacgcgtccgttctagatcgcgagcggcctcccctcaaaaaaaaaaaaaaaaaaaaaaaaaaaaaaaaaaaaaaaaaaaaagaaaaaaaaaaaaaaaaaaaaaaaaaaaaaaaaaaagaagagagagggggggggcggcgcgaggaggaagctagctccctcaggagggggagccgaacacagggcgacgccgaccaccacctagtttgtagcgggaggagagaggggggcgcgccgcaacaagagggaagggagcaaatatatataaacaaacaagaggaggcggggaggaaggaggactaacacaacacaaagacgaagagggagggaagcaagacggggctaacacggggaggagatcttatgttggggagaaggacgacgcgaccactatatataagtgagagggggggaggaggaacaatatattgaggtgtggaaagaaaacacataccaactatacgatgagtatatataaaacagaggcccgagggtggggagataataaataataaaaaattttagatcagagagagagtgaaaagagagagggagggagagacaaaaacaacccgacggagcgacgtataaaggtagggggggaggagcgcgcgagagagacagaaaatatgagtgaggaaaaaaggggcgagatggaactatataatttgtggagagtaaagatctatcttacatgaacgcggcggagcagagaagtgattggggtagtagtcaagaacgcgcagaggagaacagagaccacgaaggcgagcgagcagcagaagacgagaagggacaagcacgacacgcaaccaccagggcagcacaagagagagaaggacacgagagacgggagacacgggaagggcgcaaggagaaagagggagcacacacggagacgagcggacagagagagacgagaagagagcgagaaggagagaccaaggcgaggaagagagacgaacgagaggaaggagaggcaagcgcgagcgaggagagagaacagcgagagagaaaaagaaagaacaacaacgcaagaacagagagacaggagagaagccaagcgagacgacgaaggagacgagtactaagagag

SEQ ID NO: 637561 - DNA, 690 bp, Homo sapiens
  misc_feature (1)..(1): n is a, c, g, or t
  misc_feature (62)..(62): n is a, c, g, or t
  misc_feature (73)..(74): n is a, c, g, or t
  misc_feature (81)..(81): n is a, c, g, or t
  misc_feature (87)..(87): n is a, c, g, or t
  misc_feature (117)..(118): n is a, c, g, or t
  misc_feature (126)..(126): n is a, c, g, or t
  misc_feature (147)..(147): n is a, c, g, or t
  misc_feature (150)..(150): n is a, c, g, or t
  misc_feature (158)..(158): n is a, c, g, or t
ngattttggaggggaataacatttttcccccaaggaacaaccctttgccctgtgttttcccnagcccgatttnnccccccntaaggnacaaaaatggaggtccccccgggggggccnntcttaaantattggatcccccgggtccanaanttcggccnaagctggggcccccgttcagtcgccaatatgcagctctttgtccgcgcccaggagctacaccccttcgaggtgaccggccaggaaacggtcgcccagatcaaggctcatgtagcctcactggagggcattgccccggaagatcaagtcgtgctcctggcaggcgcgcccctggaggatgaggcccctctgggccagtgcggggtggaggccctgactaccctggaagtagcaggccgcatgcttggaggtaaagtccatggttccctggcccgtgctggaaaagtgagaggtcagactcctaaggtggccaaacaggagaaaaaaaaaaagaagacaggtcgggctaaacggcggatgcagtacaaccggcgctttgtcaacgttgtgcccccctttggcaaaaaaaagggccccaatgccaacttttaagttttttgtaattttggctttttttaataaaaaagccccttagttcctgtcaaagggatcgtggaaaaaaaaggggttgagagactaaggagacgaaacccg

SEQ ID NO: 637562 - DNA, 160 bp, Homo sapiens
ctttttttgggggccccttcccttcccctggggcggggttttttaggggccccccccccccctttttcggggggggggggggccgggggggccgggttttttttgggggtttttttttcccgggcccctttttgggggggcgggccctttaaaaggttta

SEQ ID NO: 637563 - DNA, 343 bp, Homo sapiens
ttcgattggcgggcacttagggagaccctgcttctgaaaaatccaaaaactagctgggcatggtggcttatgccatgttcccgctacttgggaggctgagacaggaggatcacttgagccaaggaggtcaaggctgcagagagctgtgatactgctactgaactccagcctgggtgacagagtaggaccctgtctcaataaataaatgaacaaggtctgggcgtggtggcttatgcctgttatcccagcactttgggagaccgaggtgggtggatcacttgaggtcaggaattcgagaccagcctggctaacatgatgaaaccccatctctactaaagataca

SEQ ID NO: 637564 - DNA, 290 bp, Homo sapiens
taaaggatttgaatttaaaaattttctttttagctttgaaaatattttgggggaaactttccttttgcccctcctgcccctcctggttttcggggggtaaagtgatttttttcccaattatttaaagttggatgccccccctatgaaaaaaatatttgttttttttcccctataaatatgcccaagggttctgggcctgctcctttttgttaccccctgcccctggaattatacttgttttttttgttgccccaatgaaaaataaatgaatgtttgttttttggggccga

SEQ ID NO: 637565 - DNA, 170 bp, Homo sapiens
aagaaaaacattgacagctataactgctgtgtctctcatattatttatactctttaccataaatcacttacaagacaagagtttcagtcctagtatttagccccaaactgaacctttaaacatttttttggtaatttttatattttctgtctttttacaactcttacatt

SEQ ID NO: 637566 - DNA, 326 bp, Homo sapiens
tagaaggaaagtcaggctagggaattcatgttctagcttgatctggtgtcagtgggatggactgcccaagtgatgggccacagaaaggcaaatttcgtgttggctcctcatccggtacctctttttccattaagaatcctgcctggaagtttaggtcaaagaggctgcttggagcaaaatacagtggtgtctcatcccaaatattctccaggcgtttcttccatccttccaggatttgaattcgggcgtctgctggagtgtgcccaatgctatatgtcagttgagattctaagacttggaagccacagaaatgcagaatgccactc

SEQ ID NO: 637567 - DNA, 127 bp, Homo sapiens
gcgcgggtcgtgcagagagtgccgattctatcgtcttcccgtggagaagattgaaactgccaaatactttcccgaaaagttcgagtggcttccgatatctgcaaggaacccacgcggtaccgagctc

SEQ ID NO: 637568 - DNA, 108 bp, Homo sapiens
ccactcctccacctttgactgcggtgctggatttgccctcaaggaacactttgtcaagctcatttcctggtatgacaacgagattaggcgtacaggaacagggttgtg

SEQ ID NO: 637569 - DNA, 529 bp, Homo sapiens
gggtgggtgatagtggagaaggtgggagtttggtgagaagaatgtaggtgggaagggggagagaagttggagggaggagggttgattagtggaggggttaggggatgggttggtggagggttggatattttcccccgccgctcccccccccccgtcgcctccgcgcccgcgcctccgcccgcgccgccccccccctctttttccgccccctccccgccgccccgccccccgacccccgtcctcccaccgcccgcgcgttcacgcccgcctcgcccgctccgatgcgtcgcttcagcgccccgcgctctcgcgccccccctgccagcgcccccccccccggctatgttaggtctgtttgtcgcaggcagatgccgcttgctatcactctgcctctccctctctctctctctctctctctctctctctctctctctctctctctctctcctgaacctccgtccccggccacgcgaccgagactgtcaccggttcgtcccgcccgcccgccgccgcggcgcccacactcacg

SEQ ID NO: 637570 - DNA, 238 bp, Homo sapiens
tatgcatacctagcttatcaaccatttcatctatataccgaaaatattagagtttacatgaacgtattcactttcagctgggcgtggtggctcacatctgtaatcccagcactttgggaggccaaggcaagtggatcaccgaggtcaggagttcgagaacagcttgtccaacatggcgaaacctcgtctctactgcttcttggcattttaaagtgctctgcttttggtagaatctccc

SEQ ID NO: 637571 - DNA, 168 bp, Homo sapiens
gcataagtagaatataaaaaaatataaccagtattttacttcagaagccaaacagaggcaataagagaagacactttgtggtggcctttatgtgtcctttagaattggtttctgtcaaacgtgtaataagttgagtatctaccgagagtatcaagttctgaagtttac

SEQ ID NO: 637572 - DNA, 343 bp, Homo sapiens
cctacaggatcccccttcgaaaccagtgtgttcgtgcaacatactccagaactgtgtaggtaatttgctataccttcagccttgtaattcaccttcaatttgaccccatcagcttcagggacctatctttacatttccactggcctgatccatgtatgcaatgctatttttgcagtgatatgtgatgttctgggaagctcggctggagagaagtcgaaggaatgccagctgcacatcacggacatcttccggaagttcaggattgccgtagctaaactgataaccaccatccatggactctccaaaccaaacgtgtttcttctcagcactagaatctgtccac

SEQ ID NO: 637573 - DNA, 590 bp, Homo sapiens
aagtatcttcaccatggggatgtgtgtccattggtgcaggagccctgggggctgctgccttggggtagctgcttgccaaacacagacgtgtatctgtccaaagccccagaaagcggacctggagtacctggaggatatagacgctgaaaatacactggaggaaaggaaccaaggacctgttcaagagccacaaggagcgtatgggacaagaaaacatgggggctgtgcattatggccgatgcgggaggccagcgctgtgaacctctgtcgagaggaagctgacggatctgtcctcccgtgaaaaagccatgttggaccagctgggcgtccccgctctagtgcaggggtaaggaggagcacagtcaggacgggaagtgaaggactgtccagccttatgtcaccggagaaatccttcctggagtgagacgcgagcagaagttctatggtccataaaggccggaagatgatgttaatgggatttatccgtctgggagtgtggtacaacgttcttccgagcctggaacggaggctctctggaacctggaaggagaaggttcatcttgggggagtaccgtggtggatccggaagg

SEQ ID NO: 637574 - DNA, 246 bp, Homo sapiens
ccatccaatacgaaaagggtgtatatgctagtatgttgcaagaagcctaaactgagtacaaggacgatgttactttaatcaagttccagaatgagggtaacacagcttcgaaaagcagtctgtagcagaagatgcaagggtgagtgatgccatgtatcagaatataccacaggcaacacaccacaaacccagctgtgcccctcagcgataccctcgatgctgctccatactgccgcgcagcccggc

SEQ ID NO: 637575 - DNA, 1028 bp, Homo sapiens
agggtttctttatccaccatttgttgcctccccccaatagatatgtatgttggttcgtctttgggttgatgttttctctcgctgggtgttctttctccagcaccctgggttgtgtgtggaaggaagatgtcttgtctcgtctacatcagcaaaatgttgtttttgctccacccggggtgtttctatgttgatgatcccacccctcttgtttttctatggatcctctcttggtggggcgccctgacgtactcaccatagtgtgacgcctcccccgcggattattttgccgcccccctctcttgtgtgggcacactcatttgggtagagacactagtacctatatatatgtggcggccccccacttctcgttgggggacgcacacactgcccgtccgtgctctttttggaggtctgtttccgggtggtttgcccccacccagctactatatcgcgggcgggcctgatctttcgcgtggagtgttagttcacttccgcgcgcgtgggctgtttgtttctatacagagcgtgctgcatgttcctttccttggcgggcggttgtgggctacgcgaagcgctttttttcactggcggcgggtctctccccacacactcatctgttcgtgtgccccgcggggagagaaaactgtatccgctagctgttgtgactccccaccaacaccttttgttgcgcgctgtctatcacgccgaccccaccacgcgggggcgccgcatatttccctcgtgcaagggcctctcccggttctaccaccagggcggcccccctgtctcacaccaccgggtgcctctcttaggtgtgttacggggccccccccgctgtggcgtctcatatcgagcggtgggcgacgtctccgctctacaaccagggtgctgccattttcctctttctccctacgaacttgggtcaacggaaaagggcccccctggcgctcccccccccgacttccttatttttttttcttggggaaccccccctttgtccctttttttaagagttcaaatttgttata

SEQ ID NO: 637576 - DNA, 475 bp, Homo sapiens
ggtacgctctgaatcccgtcgttgcgctaccgtgtaatcagcctgcctttggttttgacagcgaaggcaaagccaaaggcggattcacccgcgatggtcgcgccgacaccttggcggctcaggctgcgacaccgtttctggcagcgcatgagatggcaaacaaagatgcggccgacgtggtcagtaaagtacagcaaggcagctatgccaatgagtttaaagccgctttcggcagcacgattttcagtaataccgacaatgcgttcgaccgcattctgtacgccttgcagcagtatcagaaagaagatgcggattttcatccgtatgattccaaatacgatcggtttttagcaggccaggcagttctcagtgatgccgaattacgtggtctggccttgttcaataatccggtcaagggcgattgtgcggcctgccataccagcagcaagggcgcaaatggtttggcaccgttgtt

SEQ ID NO: 637577 - DNA, 217 bp, Homo sapiens
ccgctaccgacgcacgttcacgatgggagaaaggatcggcgccattaagcaagagttccaagaaccccccacaaaaaagaaccggatgccgcttttggatgatgaaaggcatttcacttgccgtgacctgatcagcttcccgtttctggggccggacccacaccaggcttctttctggctggccttctacctgatcccacctttaacgactggctac

SEQ ID NO: 637578 - DNA, 349 bp, Homo sapiens
taatttttaaaaaaagaaatagtcagggttttcctcctttcaaccgaaactatttctggattgtgtgctcctcgtcagttgacttgttttggcacacgttttcttaacttcagtgttcccctgtcaacaaccgtccgtgctccccacctcccccaggaaataaggggccgtgctcctctccctacgtgtgacccgtggaggctcttaagatgatgagtggtttttttatatggggctgagttcacgaaattaggggcaggagctggaagtcgccctaggaacaccagaatttccgggtctctgtctcaagtgggcatttctgggttgggaataacactatttctgggac

SEQ ID NO: 637579 - DNA, 161 bp, Homo sapiens
tcaaaacgcattttgcctatgccttgaacttaccagtctgcagaaattcatgggatcgggctaaaactaataggctaggacgttcttccgttttctactgttttaactcgaagtctcttttatggaccctatccgttgacattccacttacagtgtagtgc

SEQ ID NO: 637580 - DNA, 226 bp, Homo sapiens
agaccgcatggttattatgagatggcaccattgaggtagtcagaaaagggagcaaagtaaaagatctgaaatatgtcagaagcacttgcagatggataccatataaggcgggatgcagaaaaagagaatcaaggataattactagatccaaatttgacacaatcatgagtgctgctagtgttaagtaaaatggggagcatcacagacaagcaggtacaagtatgtg

SEQ ID NO: 637581 - DNA, 354 bp, Homo sapiens
ttcgaccgaagcactgttcactttagcaccactcagagggtgaccttgcaaggatggcttcacggaggccagactgcagcaggttaaggagggaaatgggaggggaggggagacacctctcaggaagtctggctgtggttagagaggaaagagggccgtagctggagggagaggcagaactagagaagggagtcagatgtttgtcagggtgggagagatgctgtgtgtttttaagttgaggagcttctgtgaaaactgcagttccaccctaccctctgtactctctgaaggctgaacttcacttcggaccaattaaaccagaacttctgaggggtggagcctaggcattgatac

SEQ ID NO: 637582 - DNA, 409 bp, Homo sapiens
  misc_feature (243)..(243): n is a, c, g, or t
  misc_feature (352)..(352): n is a, c, g, or t
  misc_feature (370)..(370): n is a, c, g, or t
  misc_feature (388)..(388): n is a, c, g, or t
cctgtggctgagcctcctccatggctgccccaaatccctttcctggtgcctgaggtctagggattcactcctcttgctcaggaggttttccagagggaagctcacatggatgcttcgcaggtggtcctggaaagactcacttctccttcaggcgctgcctttcatggggctcttctttgtcccagggcctcagagctggggtgtggtggctcacgcctataatcacagcactttagcaggctnaggagggaggattgcttgaggtcaggagtttaagaccagcctgggcaacatatcgaggccccatctctacaaaaaaatgcaaagggccaggcacagtggctcaggcctnataatcctaacacttttnggaggccaaggcgggcanattgcctgagctcaaggagct

SEQ ID NO: 637583 - DNA, 102 bp, Homo sapiens
ggtgagtggtaggaaggttttttcataggaggctgtatgaattggtcgtaacggaatcagggcgtatgctgttcgaattcataagaacagggaggttagaag

SEQ ID NO: 637584 - DNA, 151 bp, Homo sapiens
tcttgtttcctgcacttcacactggggcatcaccctgaattctttcttgcacaagatccaagaaccctctcttggggtctagattgggacccctttcctgtaactatcatgctactgcactccagcctggacagaagtgcaggaaacaaga

SEQ ID NO: 637585 - DNA, 438 bp, Homo sapiens
  misc_feature (273)..(273): n is a, c, g, or t
tcccgaagcccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctntgcccactccatcaccatgaagcctgggattgggccacgaggaacaaacagcagatgcccttgccttccagtccaagaaactgcttcttgaaatggatttaacaacagccaggagcttcctgtcagtaaccatgttttcaataaatactctttcatgtaaaaaaa

SEQ ID NO: 637586 - DNA, 202 bp, Homo sapiens
cagctgtgataaagcgttcgtatctgattcttgcgtgaatgatatgacctcaagtgctttattatatggtatactattaactagtgggtttagatgttctttatcatgctccataagttactttctattaccactgtgctaagttctgatgtccatttgttaaaatacacaagattatatgagaattttaaaactgttattt

SEQ ID NO: 637587 - DNA, 560 bp, Homo sapiens
attcccctttcttccgccacggtcatgcaggactctggctcttcgtcctctcctgccgagatgatgaagccccctgaggtagaaaggctccagagttctgacctcggggcccttggtatctgcagcgtcgctgcgggcagctccctcactcctgaatcaccccctagctgtcgcgtcctggggctgcggccccggcgcctgaggtctactcgccggtgaccccagtgcccaccatggcccccctcaactcctacatgaccctgaatcctctaagctctccctatccccctggggggctcccatgcctccccattgcctctggagccctggtacccccatgttcctgcagtctcccctggggcccactttcccatggcctgggtgtctagcggtgtgcctgcagacatggctccgggtagcgggggccccgggtcctgggctggtgcactgggaaggagatgcgcgaaggggtatcggcgtgcccctggtcgacaactggccaaagtccaccgatattcctatatctcactcatcaccatgggcatccagcaggcgccggg

SEQ ID NO: 637588 - DNA, 142 bp, Homo sapiens
ataaatcgtactcaaattattattgtagcatgaacgttgaagatcagatggtacttctgcagtgactgtggagataataatacatatggcggttcttattcctttccttaatggcatagattagtaattagggtagaaaaga

SEQ ID NO: 637589 - DNA, 783 bp, Homo sapiens
ttggggcccgtttgctgtgccgatttagtgccgcgcgctttgagtccgtgaggaacttgctagtgtgccccgagcggaacagagaatgctgaggtctaaccatgaatatcggaatgtcccatctatgaaggaggtttgctgctgcaacaggaatatccatgaacatggaggggtgtgctcatgtcccaggatctgtcctatagactgctctcaggaggaatgggagtgcctgacgctgctcagaaggcattataccagagatgtactgattggagaactacagcagcctgtctcactaggtctctctatcccaaagcctgattgtgatttccttactgagcatgggaaagagccctgatggtttcaagggacgtgctgggaggatggtgcggaggttgtgcgaccacggtatgacaccaaatacatcattcccagaagaccacattttctgaaaatacattagctgtaatacttcacaaaagagaagctgcccactgatgcttacttggatacccccccagtggttatggttcaccatagcgataccccaaagatatattctttccctttcaggatcacccgtgtttcacgataaataacttgggttcttattggtctgtgatcacctggttctttgctatgtgctacacagttggggcattcaactgcatttggggtcaccatataaatttactaatttcacgtgccgtttctcttttccaccatcattggcattttcttttccaccatcaaagtgggctatcttttccgactaatgcggtt

SEQ ID NO: 637590 - DNA, 572 bp, Homo sapiens
ccgcgagggtcggccgatgtcggtgcgtgagtatgtggctgtgcgcagaggctggggcttggtggtgaggacgggccagtgtcggcacgtgactgtgtcgtgggtgcggtggtgtgcggcgcggtttccgggtaggtgagactggtgtggaggccgcggtgattcctcctgactgcgccgggggcggagccccgcgtagcggttgctcctcccgtctcgggcgcacccataaggcgcctgcatgtcccttttgtctgggtactgctgagacagtagcacacttgtgggaagcgggcgttagaaggaagtggctagacacgcagatccggcgcgtcttttgggaggtgttgaaccgtcttcagctgccaccgcagtggtgatgactctcctggcatgcagctgcccccattggtgggggctgcgctgaacgtttggagtagtgcctgtaccccctcactcgctcgataatagagcaggcctgctcttcgcatgcaggacaaatcaatgggccccggtttcagccacaaacaataccgcgcgttccccatgcaaaaactcaccgcacatataaa

SEQ ID NO: 637591 - DNA, 1256 bp, Homo sapiens
gactgatctcgatggacctggaagaatgcagatggagccagacatggaggaagactgatgatcagaaatgctgtgaaatgatgaactgtaatacgcaaaggccagaccctggtgcgctgcctgatgaccccatcgtgggtgctagcacaccacatgcatgcaagctgcactgcctaccgaatgcctgctgtgcctcgcattgaatgtgatgtggctgtctgccctggaatacccatgtggaacctcctctgaacgtgacaccatcacccctcacacacctgtcctgttcaccccctgtctcttcacttctgcttatacagagtttattggaacagggatccatactccagtgcatgccacccttggtggggccttgtttcctagaaaccatgcatgtacttatttcataccatgagtctgtccagagtgcttgctacctgtgttctggagtctcgactgcctccctcccgcggggagtgtttctcctcttttttgaaaattcccgtcttgtggtgattcataagaccattaatcctgaccatcagggatatttgttccaccgttggaccattgcctcctctggaaacgccttgtcccccgatgttgttcacgttgactggagccgagaatggacattggtcactcagtcacgtctgcagtagttctgccacatgaatgatcatggctctagacattcaatgggtaaatgcaaattccggatcctgtcatggatgtccccatgcctggcaccacaacttgttttggcttgacaagcaacttatagcacctgctcaggagcattgaggcataaacactatacttcaatgacaagagtcaacagaactaagtagatgagacaaaaatgttacgaacattagctctataaacaagacagaatgagagctaagtaaaagagaaacccatctgacccatagatcacgcgggtatgaacattaccaccaacagacaccacaaaacaatcaatctcataactatccccaccttctttttataccaccacataaacaccttaccacccaaaacattattttatcacaacaaactaaataactaaacacggagcccaaaccaccttaacacaccacaacttatacaatttgatattacactcccctcatatcagctctccctaaacaccatccataccaataccatacaatcatctatcataacaaactcacataattactaccatacatcatacatcatctctactaccatctccacatacgaac

SEQ ID NO: 637592 - DNA, 243 bp, Homo sapiens
ggtccgagagaaattaggcctacgccgtcgcatttatgaatcattctattttccctccatcattttgatccccacctccatgtctctcatcatcatctgacgaattagccactcatcaatgtcttcttaactatcctctgtgatgaatgataaccatacacaacactaaaggacgaacttgatctcttatactagtatccttaatcatttttattgccgcaactaatttctctcggaccaatg

SEQ ID NO: 637593 - DNA, 731 bp, Homo sapiens
  misc_feature (48)..(48): n is a, c, g, or t
  misc_feature (65)..(65): n is a, c, g, or t
  misc_feature (70)..(70): n is a, c, g, or t
  misc_feature (99)..(99): n is a, c, g, or t
  misc_feature (114)..(114): n is a, c, g, or t
  misc_feature (116)..(116): n is a, c, g, or t
  misc_feature (118)..(120): n is a, c, g, or t
  misc_feature (124)..(125): n is a, c, g, or t
  misc_feature (155)..(155): n is a, c, g, or t
  misc_feature (178)..(178): n is a, c, g, or t
  misc_feature (182)..(182): n is a, c, g, or t
  misc_feature (186)..(186): n is a, c, g, or t
  misc_feature (193)..(193): n is a, c, g, or t
  misc_feature (203)..(203): n is a, c, g, or t
  misc_feature (206)..(206): n is a, c, g, or t
  misc_feature (227)..(227): n is a, c, g, or t
  misc_feature (282)..(282): n is a, c, g, or t
  misc_feature (300)..(300): n is a, c, g, or t
  misc_feature (416)..(416): n is a, c, g, or t
  misc_feature (421)..(421): n is a, c, g, or t
  misc_feature (514)..(514): n is a, c, g, or t
  misc_feature (520)..(520): n is a, c, g, or t
  misc_feature (523)..(523): n is a, c, g, or t
  misc_feature (625)..(625): n is a, c, g, or t
  misc_feature (711)..(711): n is a, c, g, or t
aaaaaaaaaaaaaaaaaaaaaaaaaaaaaaaaaaaaaaaaaaaatganaggaatgctagaaaaangaatnaattttgaagatctattaaaaataaaaanaattgtaccccctananannnatannaaaatagtatggatgaggtcctcaatgtcnataatgtcaatgcaagaaaaaanaaanaaanaagtagnaaaaaaaaanaanagcaattaattggggaaaaanaaaatatcatggccttcacaagaagcaacaacacagctttgtaacagggttatanaggtttcaaccgagaggnaaagatgcactaaactgcctacacatacccaggtatgtaacaagcaaggaggccacctcaagttcagtttccttcatgcatgacacatgctttttttctcctcatggacaattaangaagngtttcgtaacatgtctaaggcagcctgaagaaggtaggaaagccttagtagagggaaaatcaaaccaaatgagattaagtcaaaagaacaganaactancgnctgcttatcaactaaaaggggtgtggcatttaccacagtgaggagctaacaggagcctcccacactacatgcagggcccaaaggggccagcgatggtgtganaaccagccaccgatgatgagtttgcagttggaccaagtacagaaggaggtgtgctggcccatgcagggcctctgtgtgtgtgaggntcacaaggactagctgcagg

SEQ ID NO: 637594 - DNA, 308 bp, Homo sapiens
aatagtcgtatgccgaacaaagcaaagtataaccatgtacatattaatagggcacaaagagaatctggtagagtgccagcagtgtctaatcagataagtttatttcatatggaaaatgtgtgtcaatcttagatgaggctaatttgtagaaaataactgaattctggactcttatagatagtcagaaagggattcatttaacagtaaaattcaatccagatatatgtagacatatgtattaaaactttttaacccctgaaacttattgaaatatgtgccatattaatagtctcagcttgagacacgcg

SEQ ID NO: 637595 - DNA, 136 bp, Homo sapiens
  misc_feature (74)..(74): n is a, c, g, or t
ttgagacccccaccaactgcaaaatctgttcctggcattaattctccttcttctttgcaattcggtctttcttngtggtccatgaatgctttcttctcctcctggctggagcgagccatggcaaacttggaggagg

SEQ ID NO: 637596 - DNA, 139 bp, Homo sapiens
gatccccgtccaaagtatgatagaactattgtggcattgaacgtacccgaataattgttagttttagcatccaaaaagtaatattgatttgaaatgaatttttgtatgtgccaggttgaagagagtgctatgggtcaga

SEQ ID NO: 637597 - DNA, 927 bp, Homo sapiens
agctgatcacgcagatacctggctgagcttctgtgaaccccgatgagatgactcgcatgtggcttctacgttggcctatgtggcgcccttccagtgcttaccttctgaaagtgccggctccagcagtgttctcacaggtttaaagagcatgtaacccacacttcccccgaggacgtaatgtttatgcttgagtccagtgaggagacggcttgaaggccaatatgctgaggattttgccagactgattagggtgttgaaatgcagtgatccccagactgaaagtctgtgtgcggatgatgaagtgtttaccccagatttatctagtgctgcatgcttggtccttagaattgagaacatgaactataccctattgtggaccacagacattaggaggagatctgttgtgcacaaaccaatgtgggttccctgcaaacggtgctctgcccatttgaccccatgatccttgctttggacatcttggatcagcttcatcgctatggcactctgaacagcgcacagacactaggatgacaatggactcctaatgcgcccaaatatcttggttgacacagcaattcatttgtagctatgttagttggtgaaccccaagataagggacaaggttgacatacaatgtaattgtgcaccaggcatatctacgtaagtgcatacaaacatcaacgtgaactaagggagtttgaatatccgtggactggccataccattgcgtacattattgcaacaagtaccctacacaaattaacaacaaagtgatttacccacaaaccttaaagtgatgataacatgctgaaagcaagcagtcattaaacacagtgtatcagaagatgtagtggcacaccgtgacaaaacaatgtgataaagtacacgtatgagtaatgctcagtacagaacagaaatacgacacac

SEQ ID NO: 637598 - DNA, 414 bp, Homo sapiens
  misc_feature (314)..(314): n is a, c, g, or t
  misc_feature (340)..(340): n is a, c, g, or t
ccaacggggacggcagcggggccctggcttctcagaacagcaggtgcgggctgcctgggtcccatgcccggtgggggaggctgcacggttgggcccttgttcttcgctgtgtggccgccgaggctctccggaaggttctatgagcccgtcctaatatcttgtattgggttccattaagctggccagagtgggttctgccggttccaagtggtgtgtgggatggggaagtgctctcagctctgtccctgggacaggtggggggtgggcgcgtcacatgccagagatctggggtgaaggcctgaagacccttcccnctcctgctggaggagagccgacctcncccacagggcctcgtgggagtacaggcgcagcaggcccgtgggagatcaggagggagatgtgttcatagccggc

SEQ ID NO: 637599 - DNA, 273 bp, Homo sapiens
ggggaacccctatcaggtatgtattgaaaggaaaagacatcattatatcgaagagatatctgtaccctaatgtttactgtagcactgttcacggtaaccaagatacagaatcaacctaggtgtccaacaacagatgactggatcaagaaaatgtggtaagccataaaaaagaatgacatcctgtcatttgcagcaacatcgcatggacctggaagtcatgttaagtgagataagccaagacaagaacgaaaacatcttatgtttacaccaatg

SEQ ID NO: 637600 - DNA, 183 bp, Homo sapiens
tgtggtggcgcacgactgtggtcccgactactcgggaggcttatgcaggaggatcatttgagcccagaaggtgaggctgcactgagccgtgattacatcatcactgcactccagcttgggtgacagagcaagactctctctcaaaaaaataaaaaattataaagtatgtgagacttctggttg

SEQ ID NO: 637601 - DNA, 247 bp, Homo sapiens
tggtaatattggtatatttggtatatttgagcaacttgttctaactgtagggttttgaaaaaaaccattttttgtggatcttaaatattgtagtaaatggaaacgccctttttatgggagcctgtgctgggcgttcacacgtcacacacgagttgcctcttgagaaacaaggcaatccagttatacaactcatgtacaagttggcggggtcaccgcagctcgcaattcgataatccatgggtcatta

SEQ ID NO: 637602 - DNA, 349 bp, Homo sapiens
tccataatgtgtgccaggctggttcaaactactgagctcaagcgatctgcctgcctaggactcccaaaatgctaggattacaggcatgagccaccatgcctgtacttactcttttttttttttttctcggaaagggagttccattctggtggcccaggttgcagggcaagggcgcaatctgggctcacaacaacctcggcctcccaggtccaaggtgattctcgggcctcagcctcccaagttagcgggaataacgggcatgtgtaatcaccaccacaccttgacataatttttgggatattttaagataaaacagggggttccaccacagggggcacacatttaggga

SEQ ID NO: 637603 - DNA, 300 bp, Homo sapiens
ggtgactctagcggatctcacgggagccttaaacctctaaaaggcagaatttctgggaaacaggtaacagacaaaaactaaagtgcatcagttaaatgaacatttatctactggcccgaatctctgtgttgacactaactactggtgtccaagtggagacacggcttaaattggactggaggactattaagattggtggctcctaaattaacacaggctccctctggtgatgttgaattaaggaaattggttgggtggtaaaagggaagattttggtccctggtggcccaaaaaggtcct

SEQ ID NO: 637604 - DNA, 149 bp, Homo sapiens
catatcaggactagagagtgaatatattaatactaaggtcattctgtcccacgggaaacctgtctgggaagtctcccaatttatactcagagagacaacccatcagatgtcaccacggaacaccacacgatgaccacttcccacatgtg

SEQ ID NO: 637605 - DNA, 429 bp, Homo sapiens
  misc_feature (9)..(9): n is a, c, g, or t
  misc_feature (15)..(15): n is a, c, g, or t
  misc_feature (79)..(79): n is a, c, g, or t
cgtagtgangcgaangtgccggcctggccagggtcagggaagggaccgtagtgaggcgaaggtgccagcctggccaggntcagggaagggaccgtagtgaggcgaaggcaactggcctggccagggtcagggaagggaccgtagtgaggcgaaggtgccggcctggccagggtcagggaagggaccgtagtgaggcaaaggtgctgtgtctgccagggccagcgaagggaccgtagtgaggcgaaggtgccagcctggccagggtcagggaagggtgtgccaggcagggcaccccagggtcacaggccagtacagggaagggcttggtgtgctgagcatggcggtgaggtcagcatagccagggctgaggtgagtgcgggcagctgaggtctcagaggtcagcagggcagggtagaacccagggagggc

SEQ ID NO: 637606 - DNA, 318 bp, Homo sapiens
agggaaaggaggggagaaagaaagagggaggagagaagggagaggaggaagaggagaaaagagagggaggagggcagaaggaggagggaagagggagggagagggagggagagaggaaagagagagaagaagggagagaaagagagagggaagagggaaagagggagagagaaaggaaagggaaaaaaggggggaagggagagagggagagcaggagtcactatgactggctctaactctctctctctatatatctactactactactactactactactactactactatatatatatatatatatataacacgtgc

SEQ ID NO: 637607 - DNA, 105 bp, Homo sapiens
  misc_feature (26)..(26): n is a, c, g, or t
aggatcccttcaatttctacacttanaaagtggttcaattcccctgttggcatatgattatttttactaaaattaatcatatgccaacttggtgttagaaattga

SEQ ID NO: 637608 - DNA, 1014 bp, Homo sapiens
gtgaaatcggtaaaggaggttttgcacttttctgtgaccagacgttgaggagactgaccaagctctcgcagccccggaggtctggcatcgtgcttgagaagcgggcgtccattagcactatgcgggggaagcagacatccgtatacagacacgtggcagacatgcagcgcagacaagaaggacgcgtgttgcccacacgcagacagccagccgccgtgatgacctgggagcatgctccgtgtgcatggacggtcgcgtgctcccgcggtggcctgcccctgtggacggcagtcacctgagtcgtggcgcggatcgcggcttcggcagggataggacccagctggcgcttgcagagtctgcactgtgctgtgctagttccgcggcgagcgagcactggaaggcacatgtgaggctgggaagccagtcatacaatcatggctacggggaagacggcacttccctgcaacaagcgcctgcagcagctcatggcccgagctagccgcggctgcgcactgacgttccaggagagctgcttcagaagctccgattgggcagccagatcttcatcgagcacgtggccgatgtggacaccttgttggagtgtgtgaattaagaaggtccccgtactgctgtctcggggcatggctcgcctggtggtcatcgactcggtggcagcgccattccgctgtgacttggacagccgggccgtccggccgcagggaccgggcaatctgcggtcccctgggggccacgctgcgtgagctgagcagtgcttccagagccctgtgctgtgctcaacagtgacagaggcatggaggagcagggcgcacacacgggccgcaggagtctggacgaaacgggttaccccagggcctggggcataacaggggcaacaaggtccggtagaacacgggaagaccgcacccggaagaacaggggacacagagccagcagaacccgcagcgacacggccaacagccccacaggcacagaacggaaggccaaacagaagcg

SEQ ID NO: 637609 - DNA, 204 bp, Homo sapiens
tgagatacccatgccccctagcggggggtaaaatagagacccagtaaaattgtaataagtagtgcttgaattatttggattcggttgtgggctattatactatggtgagctcaggccattgatactcctgatgcgagtaatacggatgtgtttaggagcgggacttctaggggatttagcggggtgatgcccgctagcggacat

SEQ ID NO: 637610 - DNA, 314 bp, Homo sapiens
ttctcctgcctcagactcctgtgtagctgggagtacaggcactgcaccatgcccggtaattttatatatttttagcagagacagtgttcatggttagtagatggtctcgattcctgacctcgtgatcgccgctcagcctcccaaagtgctgggattacaggcgtgcaccgcgcccacaaggcgggtcttgctgtgtttcccagactagactggtcttgaattccagggctcaagagatctcccacctcagcctcccacagtgctgggattacaggcgtgcgctcacacccagcctattcaaaatttttttttct

SEQ ID NO: 637611 - DNA, 245 bp, Homo sapiens
  misc_feature (156)..(156): n is a, c, g, or t
ggatccccagtgactatgattacatcttcactgaccgttttactgcgattttaacacgtatcatgagatctaccttcttagcagatttttaagcgggtgggggcttcccgttgactgcagttgccgtgttgtagggcagctctctagagcttattnctcttgctgcactgaaaccttgtgcccattgattggcaactccacattttcccccactgcagtccctgaccaccaccattccactcttc

SEQ ID NO: 637612 - DNA, 222 bp, Homo sapiens
gtcctctcttatacacggttttgctttccatagtttcggttacttgcagtcaaccgtggtccaaaaatatgcgatggaaaattccagaaataaatccttcataagttttaaattgtgcaccattctgagtagtgggatgaaatgcgtctttctgatccattgcctcctgcatgcgaatcatcatttgcccggagtccccacctgcccatcacttagtagcca

SEQ ID NO: 637613 - DNA, 111 bp, Homo sapiens
gcggccgcctactactactactactgctcgaattcaagcttctaacgatgtacggggacatgttttaaatgaatttgataatgaaattatactattatcattcttaaaaaa

SEQ ID NO: 637614 - DNA, 1372 bp, Homo sapiens
gttcctgcctggcaggtgcaggtgctggccatctgcaggtggaaggaggtgggaatcttggatttttggttattttttggtcttattttttatttggagaatgaagtctcgactctgacaccctaggctgggcagtgcaagaggagtgtcgatctcgagatcactggcaaactccagcattccggggttcaagtgggttctaccggccccaagactcccaagtaagctggggattaaccaggcatggcggccaaccagcgcatcagcagtgactataagggaatattacagctagagcacgtgggagttacaccagggtgggcacaagacggggtctcaaacctccgtgaccctcaaggtgatcggcacacgcacatgcggacctcccagaaggtgcgtggcgacttaacaggcgttgagacacaggtgaaacccggagggaactctgggacattcacatagacgggcaccatcagatatcgggcatccagaacggaacacctccgtgccctcgtacgcaaggaccggggagtcgccacgcccaacgacccagagagcccaggggccaagggtccccgtggcgctcctatcaccccaccccggtacggcactgggacaggtagaggcacaatcacagtactagagagaaacataatacccagctggatgcagacatggcacaacagtgataacagcggggactaggagaacccagaaatgggctgaggagccccggggtgcaccacggcaccacacaaaagaggagcaactgggaactgtggaaacaccacggctggcgtgactggaccacaggtggtgtcactcgattgatcacccgtcacagagcacaccccaacgacagggaccaaccgatggagcgacgcaccagcagggtagtaccagaggccaatggccctggggagaacaactcacaaagtaaacaccacccaaagggcagcacaacgaggactcacctccacgtacgaaggagcgacatatcgtggaaggaacgagggggccacaccggtgaaagacacagatgacagtacggggtacctagcgaaccaccaagtcgcccaggagggccaagagcggagcaagaacacaagagggtatcaaaacggggaggataaaccaccacagatcggcgactgccacggaccacccagcgggagaccacggtgaccagcacagtcagcaggtagcagcagcgacggaagcacgccgtcaagcaacgagtcacgcaccgaaccaactcgagaccagtgactagtagcagtgcaagccagggtggcacgtcacacatcagacaacaacgacgcaccagatcgcacaacgctaagaagcgaggagagacaccgcggtgagccac

SEQ ID NO: 637615 - DNA, 1206 bp, Homo sapiens
taaattagggcttatttggaaaaattctgagtttaattcaaatgtttgccaataccttccaaagttaagggtaatatccagaagaacagtgtgtgtggtgactcagaagtggcttaaagaaaattctcgtggaatattcacatttcgaagatcccttattaatgaagtgtcttgtgacttaaatctaaccaaaaatgtgcaaccatttatctctttgtgtaccattttccatttattattaggtgtcttaaccaaagcctttaggtgtgacaaaccacaattaaaactactataagccatatttgtgcgtcttaaacaaacaacaacaaaaaaaaaaagcaagacaaaaacacaacaaacaacaacaagaacacaacaacaacaagaacaacagacaaaaacaaagaaaataagaacacaaacaacaaacaaataacagaaacaacaacaaaaagaaaacataaaaaacaaaagaaacagctccgagaagagaggagagaggaaggcgaagaaaggcaagaggcaagcaccggcgggcagacacaccaccagcccaacaacggcagaacacacactgaaaggaagagagaaaggacacaagaacgagaacaacggagagcggggcctgcgtagaaaggaacgagaggcggcaggcccccccgctgaacctaacaccgaggacgcagacagagagacaacgaacaagaaagagagagaaaacgagccagcaaagacagacaaaggcaaacaaccaaaaacgaggagaggggacgcggaaacaccaaggacgcaccacgaccaggaaggcgcaaggacaaaaagacaacgagacaaaaagacgaaaaacgggcggagcggaaagcaagagaccagaaccaccgcgacctccgcgcaggaacagacccaccgacgagcgcgctacggggcagccacaacaaaataagacggcgacaagaacaaaaaaacaacagtcagccgaccgcagcgacgcacacagggcagactaacgaccgcaacaccctgagtgccgaacataagtaccgcgtgacccacctcacagtacaacacccctaacaaaaacacagcaccaataaccagcaacccaccccacatcccacaccaagagcccacaccaaaacacagcaaacccgaagcatccacaacaaaaatcgtgagccgcgaagtcacatcaaagcaagactaacg

SEQ ID NO: 637616 - DNA, 285 bp, Homo sapiens
  misc_feature (60)..(60): n is a, c, g, or t
  misc_feature (283)..(283): n is a, c, g, or t
gaaaaaaaaaaaaaaaaaagctttttccctagatcagcatatacaaaaaaacattcttcnaacatgaaggagaaataaagacattagctgacaaacagatttaactcaaagattacctcaaggcatttagtagtcaaactcccaaaggtcaagaatgaggaaaggatctgaaaagcagcaagaaaaaaaaaataacatacaatggagaaccaatacatctagcagcagagttttcagtggaaactcaaaagccagaagagagtgacatgacataaagagctgnca

SEQ ID NO: 637617 - DNA, 103 bp, Homo sapiens
tatcgatagcccgacagcaggacatgctttattctgagcaggctgggaccttcggccagcagctgagagcacagactgggtggggctgtacgtccacaaggtc

SEQ ID NO: 637618 - DNA, 983 bp, Homo sapiens
cccacgcgtatgcagccgggctgctgcccgagcccggggtggtggggtggcgtctccccgtgccctgtccctgtcccctgtgcctgggctgctgggctgtgatgtggaccaccctcccctgtgtgctccctggtggtgtgcctgcactcccatcacgactgtgcttcccatgccctgcctgctcatgtgtgcttgctctctgtgtgaagcatgataatgaacctgaggggaaccaggacagcaagcgaggtgaccgaatcggctgccagactgtagagggaccagagcagaacaaggataccgacgagagccagctagcagagaagcggagcaaccgcacggtacatacccgaggccactgcagcacgaccatagctgactgactagaggtagctgcgacgaactcatgcgtacaacacgcagccgatatgtgcaacgcacgcagtgacggagtccctgacactgatacaaactgggctaccacactgtgacgacggcgcgtgcacgacacgacggaacaccagccagagctagacaaaggaagacaagcacgcagatcgagtgacgacaggcaaacacaaacgtgcaaatgacagtcaacaaagcaaaccatgaacagcagagcgacttgcacaccatatgtaggcctgccgatgaagcagacctaggtgcccacccagatgagagcatggccaaagcccacgagaaccagttaccgagtaggactacatacaagagtgtcgatgaacgtagcctgacataagaataacccatccacgaattactatgaggcatggccaggctcatggagtagaggaagaaagaagagcatagactgacgaggagcgcacaaacgagtaacaagatgatttgagttggggacaagaaatatctggaaaaaatacaacgtgataaaacggaagaaaaggtagcgggaataatggacatgtaaaaatgagagaatagataggaataaagaaaaa

SEQ ID NO: 637619 - DNA, 409 bp, Homo sapiens
  misc_feature (77)..(77): n is a, c, g, or t
ccagttttgccccttttgtccccctgtaagtactcagaaccaggaggactagaaaaccccttttggccagataagantacgttttttattgcagcttttgaaccagagactgatgttgcccccctttttttccctttggcaggaatgggagtccagtgcccttaggccccgcaagtgccccaggaattttgaatccagatggttatcccccccactccaatgaatattttgtatataacccccccccggtccgtatgcgggcccttttaaaggttcagtttaatttccttcccctggggggaatgttgatattaaataacccaaagttttgtttttccaccaaaaaaataaccagggttggccttgtgaattttgtgattttttttgtaataaaaacgggcccggttta

SEQ ID NO: 637620 - DNA, 123 bp, Homo sapiens
caggatcgcttatctaaatgctgtactaaatggctgttacctaaatggctgtacctaaatggctgttacctaaatggctgtacctaaatggctgtacctgccatttaggtaacagccatttag

SEQ ID NO: 637621 - DNA, 347 bp, Homo sapiens
tagaacatggccagacgcggtggctcacgcctgtaatcccagcagtttgggaggccgaggaggctggatagcctgaagttgggagtttgagaccagcctgacctacatggagaaacctcatgtctactaaacatacaaaattagccaggcgtggtggcgcctgcctgtaaccacagctactcgggaggctgaggcaggagaatcgcttgaacccaggaggtagaggttgtgagctgagatcacgccgttgcactccagtctgggcaacaagagtgaaactccatctccaaaatatacataggaatgatatatacctcatggtgctatttgctagggtaagagggggt

SEQ ID NO: 637622 - DNA, 539 bp, Homo sapiens
tagaaataggagtgcaggtaaaggctaatcagcctcccaaagtgctggttattacaggcatgagccaccgcgcccagctgccagcgttgttcttagagcccagagatgggaggaaaattaaccagaggcaggtatttgaaggcagtgggacaggaagaggcttgttctggacttccaaatggcttcctttaaaaagaggcatttaaatttttccagttgctttttatagttgatctaggatagaaaaattatggccatcatggtttcctttcatattgttaaaaatgatcaaggggactttaagattttatgagaaaggcaaattaccattgttttattcctcagtgaacctggaggagccagacctttatcagtcgtgttgtgttccaaatataacagctatattctcaatacaaaagactctgatgagagcaacatgggagcaaaaaagagaatgtcctactttcattttttaaatatgtttcagaggactcattaacaggaagtatatctaaaatgcaaaaggtcaactttgtact

SEQ ID NO: 637623 - DNA, 153 bp, Homo sapiens
  misc_feature (7)..(7): n is a, c, g, or t
ggaattncggccgcatccgcactagaaagttcatgaccaaccgactacttcagaggaaacaaatggtattgatgtctcaccgggagcgacagtgcctagacagaatcggaaactagcaatgtacagacacacgatgtactgatgatcgactat

SEQ ID NO: 637624 - DNA, 170 bp, Homo sapiens
gggcccaccataattacccccatactccttacactatttcctcatcacccacctaaaattatttaaccacaaacttaccacctacctccctaaccacaagcccataaaattaaaaaatatataccacaccctgagacccaaatatgacgcgagatctctgttgcgttaca

SEQ ID NO: 637625 - DNA, 554 bp, Homo sapiens
  misc_feature (40)..(40): n is a, c, g, or t
  misc_feature (153)..(153): n is a, c, g, or t
  misc_feature (183)..(183): n is a, c, g, or t
  misc_feature (185)..(185): n is a, c, g, or t
  misc_feature (207)..(208): n is a, c, g, or t
  misc_feature (210)..(211): n is a, c, g, or t
  misc_feature (219)..(219): n is a, c, g, or t
  misc_feature (222)..(222): n is a, c, g, or t
  misc_feature (226)..(226): n is a, c, g, or t
  misc_feature (234)..(234): n is a, c, g, or t
  misc_feature (237)..(237): n is a, c, g, or t
  misc_feature (256)..(256): n is a, c, g, or t
  misc_feature (260)..(260): n is a, c, g, or t
  misc_feature (276)..(276): n is a, c, g, or t
  misc_feature (292)..(292): n is a, c, g, or t
  misc_feature (340)..(341): n is a, c, g, or t
  misc_feature (343)..(345): n is a, c, g, or t
  misc_feature (347)..(348): n is a, c, g, or t
  misc_feature (351)..(351): n is a, c, g, or t
  misc_feature (359)..(359): n is a, c, g, or t
  misc_feature (381)..(381): n is a, c, g, or t
  misc_feature (400)..(400): n is a, c, g, or t
  misc_feature (422)..(422): n is a, c, g, or t
  misc_feature (449)..(449): n is a, c, g, or t
  misc_feature (470)..(470): n is a, c, g, or t
  misc_feature (473)..(473): n is a, c, g, or t
  misc_feature (475)..(475): n is a, c, g, or t
  misc_feature (477)..(478): n is a, c, g, or t
  misc_feature (498)..(498): n is a, c, g, or t
  misc_feature (505)..(505): n is a, c, g, or t
  misc_feature (513)..(513): n is a, c, g, or t
  misc_feature (547)..(547): n is a, c, g, or t
  misc_feature (554)..(554): n is a, c, g, or t
ctttgcgatagatgaacaaaatggcccatatcatactganaaatccctttaaaataatagactataatttgaaagatgaaattttatcagtataacacacatttaaactaatattttaaaatttaaaatttgtaaaaagcctacatttgaganagctaattattcacaagtagggacattaanantcattccataatcatcattatnngnnccacaganagnctgntgcaaatnggnatatctaaattcaaaattnaggncatgcagatatgattncgacatctttctcttngggagcttgagtttacgtatttagataaacacaacacagtattatttnncnnnannccncccggccngacgcaggcttgccttcaagantccaatatgatgcaaagcntaacacatttctccagtctggnggtgctgctgctccctgagtgtaactntctctgtcatgtatttcctanagngncnntttgagagaagagagatgcnaaatgcnatcaattntgagagtgtcccacacttaaacctataccaaganattcagn

SEQ ID NO: 637626 - DNA, 233 bp, Homo sapiens
ggggagccaaaaagggtcatcatctctgcccccttctggctgatgcccccatgttcgtcgggggggtgaaccatgagaagtatgacaacagcctcaagatcatcagcaatgcctcctgcaccaccaattgcttagcaccccgggccaaggtcatccatgacaacttgggtatcgtggcagtgatggcatggccgggggtcatgagtcctgccacgataccaaggggggtaccg

SEQ ID NO: 637627 - DNA, 176 bp, Homo sapiens
  misc_feature (65)..(65): n is a, c, g, or t
  misc_feature (80)..(80): n is a, c, g, or t
ggacatcaccccattagagagacagcaagtggagctgtcccctactttgtgccagttggcctctnggactggacatctcnggctgcgtatcttgaacgtggccctcctttggaactactcgcacaaggacgatgctgggctggagagatcattcctcgcttccatcctgagtgacc

SEQ ID NO: 637628 - DNA, 493 bp, Homo sapiens
atctagaggtcccgtctggagcagctggggaaggcctcagaacctggacaatcagggcagagggggagggggagcaatgcaccttcttcgcagggcaggaagagagagagagagcaagggggggaggtgccacacacgtccaaacaactagatctcatgagacctcactaacacaggaacagcaagggggaaatcggcacccatgatcccatcacctcccaccaggtccctcccttaggagtgggggataacaatccagcatgagagtggggggggggacagggagccaaaccatatcaccaatgctcagtgtgatttttcagaatataagcagtacaaggaatggcaaatatggcaaaatatccaattgggtcatggcatctatgcagcctccaaaatactatgcacttgatacggggcatgtcaagaacacccactccagtcgtgtccctaggaatccaagccacaccaagggattgtttttcaaaggttc

SEQ ID NO: 637629 - DNA, 637 bp, Homo sapiens
cccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaatttggtatttttagtagagacggggtttctccatgttggttaggctggcctcaaactcccgacctcaggtgatccgcccgcctgggcctcccaaagtgctgggattacaggcgtgagccactgctcctggcccaagatctgatggtttcgtaagggaattttcccccttagcttggcacttcttcctgctgccatgtgaagaaggatgtgtaggcttccccttccaccatgatggtaagtttcatgaggcctccccagcctgtgggactgtgagtcaattaaacgtgttactttatacattaaccaaacacaccac

SEQ ID NO: 637630 - DNA, 294 bp, Homo sapiens
  misc_feature (206)..(206): n is a, c, g, or t
gaaagccctgtagaaaagtgatataaatggtaggctaaatttagctatccttagacccctggccttcatgccattataatagcacaaaaagaaacccgggactctttgaattatttacatcctcataattatggtgttaagggggatagttacaaagatggaggacagtttacctgccatcaagaagttcatagtcttacataggngacactcatataaataatgaaatcttgttccatagggacaaaaatataggggagcatatttggattctgctctggtgtataaagcagg

SEQ ID NO: 637631 - DNA, 164 bp, Homo sapiens
tccttcgaagcccgccaacgggtcccccactcacgcatggggccctggcgataaggacccccctccctccgggggccccggggcgcgtccccttagagccatgcccggctgccccgcccgccccggaggaccctagagaagcgtcgtgggggccatggcggccg

SEQ ID NO: 637632 - DNA, 117 bp, Homo sapiens
tcagctcggtacctgctgggcggcatccagggcggtgaagttctagtatccattgagacaagctctagtacagtagcatgcagtcccacaacttgtaccagcatcccccgccgtatg

SEQ ID NO: 637633 - DNA, 272 bp, Homo sapiens
tcctgcccggcaaattccaccaacctcagccctgggagactcagccctaagacctggggatgacaatagcctggggtccctgcttcccgctggcctgtacctctcagggcctggaactcaccccctccacacctgggactccaaggtgcggaatatccttcaggccaggacacctgggactatccaggtcgtcgggaccccagcttccaccaaaggggcatccaaggtcccctcggccagcccccttccctcagaagcgctcccactccctg

SEQ ID NO: 637634 - DNA, 114 bp, Homo sapiens
tgctccgcctctctggtacgttccctagcgtggttgcttgttagtgatagatagggtggcgtgcgtgagctctcacttgacatgagtccttgactgccagccaggctcgctgga

SEQ ID NO: 637635 - DNA, 468 bp, Homo sapiens
  misc_feature (3)..(3): n is a, c, g, or t
  misc_feature (43)..(43): n is a, c, g, or t
  misc_feature (156)..(156): n is a, c, g, or t
  misc_feature (166)..(166): n is a, c, g, or t
  misc_feature (208)..(208): n is a, c, g, or t
  misc_feature (234)..(234): n is a, c, g, or t
  misc_feature (404)..(404): n is a, c, g, or t
gcntcgtacctgtcaggttggaggcttcaccatccaggagacnagagatgctgagccgcatcgagaacagttcaacgccgcgccatggcccccagtgtctgagcacgcatcattcaaggattcaccaagcagaatacccggagcagccatccacangtgctgcagntcatgctgcggcgctgcgaatccagcatcgcatgcagcgcangttctttacgcctcaatgagtcgcgnccgctcatggactcatggatcgcccacgcctcgccttacctgccgctgcctgccattgacaatgttgctgggacctctgcctccccactgcagccctcgaacttcccaggcaccctcctttctgccccagaggaaggagctgtagtgtcctgctgcctctgggcgcccgnctctagcgcggttctgggaagtgtgcggcatccgttaataataaagtccacggtgtgttcaggg

SEQ ID NO: 637636 - DNA, 111 bp, Homo sapiens
caaggtatgctgttactgggacttcctcgtccatggggaatattgcaatccccgatgcatacaccacatgaaatatcctatcatctgtaggttcattcatttctctaacag

SEQ ID NO: 637637 - DNA, 854 bp, Homo sapiens
cagaagtaggcttcagaaggttgataataacaaacttatctgagctaaaggagcatgttctaacccatcgcaaggaagctaaaaaccttgaaaaaatattacacgaatggctaactagaattaccagtgtagagaagagcttaaatgacttgatggagctggaaagcacactacaagaacttcgcgaagcaaacacaagcttcaatagccgattcgatcaagcagaagaaaggatatcaatgatgaagatcaaattaatgaaataaagcgagaagacaagattagagaaaaaagagtgaaaagaaacgaacaaaacctccaagaaatatgggactacgtgaaaagaccaaatctacatttgactggtgtacctgaaagtgacagggagaatggaaccaagttagaaaacactcttcaggatattatgcaggagaacttccccaacctagcaaggcaggccaacattcaaattcaggaaatacagagaacaccacagagatactcctcaagaagagcaacccgagacacataattatcagattcaccaaggttgaaatgaacggacacaactggtctacgggagtgagagagaaaggtgggttacccacaaagggaaggcaatcagactaacagtggatctctctgagaaacctacaacagaaaaggtagggcaatatcacattcttaagcaagaatctcaactagaattctatcagcactaagtcctaggagggacattactgttcacgacaccatgcggagattggccccagccgctaagactggggggcacacggtgcacggtcccggcaacgctggactctgacacgcccggacaccacaagggccaactg

SEQ ID NO: 637638 - DNA, 401 bp, Homo sapiens
tgtgaatacaccagcggcgttactcataatagtcaaaaagtggcgacaacccaaatgtccatcaactgacaaacggagaaacattttcgtctaacaaacaaaacatagtacatccatgcaatgggaatatattcagtgataaaaaggaattaagcacctgaaacatgccacaacgtagatgaacctccaaaacattatgctaagtaaaagaagaaacaaaaggccacatatgattctatttatatgaaatgtccagaataggcaaatctagagacaggaagtaggttagcaggttgcctgggctggaggggttggggagaaatgaggagtgactactacaggtatggggtttctttttcgggtgaggaaaatattacagggtgggtgcgcggtgtattccg

SEQ ID NO: 637639 - DNA, 944 bp, Homo sapiens
  misc_feature (413)..(413): n is a, c, g, or t
ggcggggcggtgacggtgtgggaggtggtctcactctcgggaaaacggctgggcaccgtcgtcgcgctgacggtggttctgtacctgctccgagtgtgcttagcgatggactggaaatccgtgcggcgccagtcactcggagctaatccagaatctgcgcaaaaatggaatcagtcaatgcacagtataaaggatactgttgaaggtagactcgctgggctgacagaaccgtctcccactgagttgccaaaactgtaaaccatacatggattctccacaatcaattcggtttccaaagtcaagaatcgagatgctccacagcagtgacgaatgcatatgcgctagaatctgtactattggagtcaggttgcgactgaaggagcgaaagctctgggatgtagggaatctgtganatgtgagaatccttgtactgcattgttgttggcaacttggattggtgagcgagttgtacgtgggaaaagaggtcgatatggaatctggactcaacatttaatagagcgttacggtaagactgaagtcacgtaaaattaagttgtcaatcggaaggggtagagatcctagaacgaaattcgtggttcgtaatccaggcggaagaagtacacgttggttacgtatgcggggcgatcggaagaaactggcgatcattgccgaaggaaggcgccgatagtgatagccgaattccatgatgggacgctggagcgccgtgatatagtaaccgccagggcgtctaactagactccatgtaaacagccccggcacgggaaagaatacgctattcgacctggtggggtcccagctgggcgggagacgccaaactggtcgcggagcacacatgaccgaggtaccacagatgccagcaattgcaacgggaagcccactgcaatgggccgccaacatagtgccctgcacaacactcaacgaaa

SEQ ID NO: 637640 - DNA, 548 bp, Homo sapiens
atcgcttgaaccagggaggcagaggttgcagcaagccaaggtcgcgccattgtactccagcgaaactatgtctcaaaaaaaataaataaaagaaagaaaagaaaaagaaaaagaaaccacacaaagtatgttgtcaggacacaataaaattaaactagaaatcaataacagaaagctagctggaaaaaccccaaaatatctggagattaaacaacacatttcttttttgagacagtttcactcttgttgccagggtggagtgcatggcgcatctcggctcactgcaaccttcgcttccggtttcaagcgatctctgctcagctctcagtagctgggattacaggatgcgtcacatactcagctagttttgtattagtagaacgggttcacgtgtggtcagactggtcttgactctgactcaggaatcaccgctcagctccaagtgctgggatacaggtgtgagcactgcgcggcacacacgctttgagtacacatggcaagagaatccagaagtttaacatgtgtcatgattaatctatgaatgaatc

SEQ ID NO: 637641 - DNA, 567 bp, Homo sapiens
  misc_feature (12)..(12): n is a, c, g, or t
cgtcacagagcncagagagcgtcctgtaggaacgtcacagagcccagagggcgtcctgtaggaacgtcacagagcccagagagcgtcctgtaggaacgtcacagagcccagagaacgcctggggacggtcggggaggcagttcggggaggggacgattaagttccctcagagaggaagccgcgggccgactggagtcgttttcgtgctctccgcacccgcccgccgcgggtagcatcttctcagcgccccggcgcccaggaacgcccaggaaacccagtcctcctcctaagcaacctgcggcgcggggacgcccgccttttgctattattataaacgtgcgtgcgactaaaccttcggatttttagactttcttctcgcttcctctgacccaggctgagggagcccccgaggctactgcggggcggggccggggcggggtggggcgccctcgccgcctcaggcagcgccccggccgctggcgggaggcggcagcggcgcgggccgagcggcgcggggattggctgcggcgggcggagacgtcaggctcccgcggcccaagcggccgc

SEQ ID NO: 637642 - DNA, 402 bp, Homo sapiens
tcctaaatgagtcgctggatcctcatgcgtccttgcatagtttggtttactaaaacaacacattggctgggtgcagtggctcacatctgtaatcccagcactttgagaggccgaggcagggggatcacgaggtcaggagttcaagaccagcctggccgacatggtgaaaccccatctctactaaaaatacaaaaattagctgggcgtggtggcgcgtgcctgtagtcccagctactcgggaagctgagacaagagaatagcttgaacccgggaggcggaggttgtggtgagccgagatcacgccactgcactccagcctgggcgatagagggagactccatctcaaaaaataaataaataaataaataagaaataaaacaacacattacggtttatctttat

SEQ ID NO: 637643 - DNA, 477 bp, Homo sapiens
  misc_feature (12)..(12): n is a, c, g, or t
cgtcacagagcncagagagcgtcctgtaggaacgtcacagagcccagagggcgtcctgtaggaacgtcacagagcccagagagcgtcctgtaggaacgtcacagagcccagagaacgcctggggacggtcggggaggcagttcggggaggggacgattaagttccctcagagaggaagccgcgggccgactggagtcgttttcgtgctctccgcggggacgcccgccttttgctattattataaacgtgcgtgcgactaaaccttcggatttttagactttcttctcgcttcctctgacccaggctgagggagcccccgaggctactgcggggcggggccggggcggggtggggcgccctcgccgcctcaggcagcgccccggccgctggcgggaggcggcagcggcgcgggccgagcggcgcggggattggctgcggcgggcggagacgtcaggctcccgcggcccaagcggccgc

SEQ ID NO: 637644 - DNA, 240 bp, Homo sapiens
actctagaggattcccagtgagccgagatcgtgcactgtacccagcctgggggacaagagcgagacttcatctcaaaaaaaaaaaaaaatcagttggccttggtggtgcacttttatagtcccagcctatgtgggaggctgaaacaggaaaattgttttaccccaggagttcaaagttacagggagttaggatcacacaattgcactccagcctgggtgacagattgagcacactgtctc

SEQ ID NO: 637645 - DNA, 432 bp, Homo sapiens
tgagcaatcgaccggctcactgcagccattccaagaagtatcttgctcacggtaaatgcaaagtaaacaaaataccacactgcatatttgaaacaaacaaatgtgacgttgcctatactggcctcatgtgcagaaggaattttggtcagacaatgacaaaaaaaaaaaaaacagatggtgaaggggaataaaaagcacaattcttggtatcgggaaacgttccacgggcaacacaaacgtgtatgatacagacgtaaccgggaacagtagttatgtttctcttcctatccccaaagaagcacaatagaaaaaatagacgcaaaagggaggagggtgtggttaccagggtaattccacgtgcacgccgggggaaatgaatacacggggccacagtgagcagtgccctgggtggatatcccgggggatcctcaa

SEQ ID NO: 637646 - DNA, 657 bp, Homo sapiens
  misc_feature (548)..(548): n is a, c, g, or t
gcgccgtcttgatactttcagaaagaatgcattccctgtaaaaaaaaaaaaaaaaatacggagagagggagagagagagagaagaagagagagagacggagggagagcgaaacagagcgagcaacgcaatcggaccgagcaggtcgtacgccgccgcctcctcctcctctctgggtcttcgctacccagggtgacccgaggaggggactccgcctccgagcgggctggaggaccccgggtgcagaggagcctgggctcgcagaattggcagagtctgtcgcccctttttacaacctgggtcccgttttattctggccatacccagttttggggattttggtgtttcccctttcttctcttgggctaaacggacccctccaagataatgttttaaaaaaccttctcctttgggctcaccttgggctttcccagcctttccaatccccccaaccggaaagcaaatcattcaaggaccccggaacctccggaggcaggagcccccggacctccaagggggacaggcctccctccccggggcgcggggtcangggcccgggcgagagggcgcgagcaaagccgaggcatggaggtgacgggggacaagtcgagctgggtgagccaccaacaccccgcgggtgccaaggggagcaccgggaa

SEQ ID NO: 637647 - DNA, 175 bp, Homo sapiens
cctgggtggcccatctgctggctacagtaagtcttaacgagcaggtagagcatgtccgtttaattgggtggaacgttcatgcgctgtataaaataacagtaccctttcatttgaaagagctgctgtgtgcaacatactcatatttggtaactgtatatgacccttttaagctgga

SEQ ID NO: 637648 - DNA, 383 bp, Homo sapiens
  misc_feature (137)..(137): n is a, c, g, or t
tacagaaattagcagggcatgttggtatgcacccgtaatcccagcaaatcgcttgaacctgggaggtggaggttgcagtgagccgaggtggcgctactgtgctccaggcccgtgcaaacagaagcgaggacactgtnccaaaaaaaaaacaaacaaacaaaaaaaaaaacaaccaaatgggggagaaacatgtgggaacaaaattttaagccattttttggaaaaaacaaaaaacaaacaaaaaaaaaaaacttttgtgcgggcccgccgcgcccacaaaaaagtttcattcacaacacctcacttggtggggcgggggccccacaatagtgtaagggagaacagcgggccaaacagtgggtcccaagaaatctcggggccaa

SEQ ID NO: 637649 - DNA, 273 bp, Homo sapiens
  misc_feature (251)..(251): n is a, c, g, or t
ctggagcggttttctccatgtttgcccaggctggtctcgaatgcctagactcatggcgatctgcccgcctcggacctgcacaaagtgctggggttacaggcatgcagccactgtgcccggcctaaagtcttaaatatagctctgtggtctgagaaaaattaggctgaagtcattggtgcctacctattacggtagatcagacggctttcttaccaactcttttccctcccgttccccatccttcaaatatnattctaagttttagtctctgct

SEQ ID NO: 637650 - DNA, 355 bp, Homo sapiens
agagaactagtgttctgttatatacttttttttagatgctttccattacctattgattgaagcacaaagaagagaggctgattaaagaaatttatggtttatagaccgggtgttggctttacaccaacgtacaagaatagcagatgaataagctattgatctacattttctttctcttattctcatggaatgctgagatgctctttgtgatgttataagcctaaggtagctagactcgcagcagcaagttagttaccctcctcggcgaatcatggcttattatcgacagtcttgcgacacttctctaccttgtgcttcacgctcagcacgtgcactgtgtggcttgtttgtctgt

SEQ ID NO: 637651 - DNA, 225 bp, Homo sapiens
ctacggaggagcacagcaagtgccactcaggagtggctagagaagcaggcccacgctgagaaggagctcggtgctacgccctgcaggacaagaaatgccttgaagagaagaacgaaatccttcaggggaaaactttcacagctggaagaacacttctcccagctgcaggataacccagcccaggagaagggcgaggtgctgggtgatgtcttgcagctagaaagc

SEQ ID NO: 637652 - DNA, 144 bp, Homo sapiens
cacgaggcctgattgtgacgcaaacagtgccggtggctcggtcgtgccctctgagtgtctgaacgccatggaggagcacgaccatggtgccctgctgctgctctcatgcacgactcacccccatggacagtctgtcatcacggt

SEQ ID NO: 637653 - DNA, 272 bp, Homo sapiens
tggctgggaagttgggaaagaagagagccccagcgcgtgcattcaagagagtataaacctgagtgccattcaagcattggtgggtgcttggaggtccggtgcaggtctcttagaagtttaccctgaagacggctagaatggctagttctgtgaggctggttctccccagggatactcggctccgggttccctccctccagtccgggctcggggtaaaaggccaagtcagcaatcatccatctccccacctccttcgggccgggggtacggag

SEQ ID NO: 637654 - DNA, 899 bp, Homo sapiens
gttccccaacttttcctccgaccccctaacaacccccctcctaatactaactacctgatcctacccctcacaatcatggaagccaacgccattatccagtgaaccactatcactgaaaaaaatctacctctctatactaatctccctacaaatctccttaattataacattcacagccacagaacgtaatcatatttgatatcttcttcgaaagcaaattatcccaccttggtatcatcacccgatgaggcaaccagccagaacgcctgaacgcaggcacatacttcctattctacaccctagtaggtccccttcccctatcatcgcactgatttacactcacaaaagcctaggtcactaaaagttctactactcatctcactgccaagaactatcaaagtcctgagccaacaattaatatgactagctttagcacaaatagcttttatagttaaagatacctcttaacggactccacttatgactccctaaagcccatgttgaagcacccatcgctgggtccaaaagtacttgccgagtactcttaagacctaggcggtatggatcatacgcctcagactcatttctcaacccccctggagagaataagtaggcttacccctttccttgtacttatcccttattgaggcataatttgtaacaagtcatggtgcttacgaaaaaagagacctaaatcccgcctggatattcttacatcaggcaaatagcctcgatgtaaccagctttcaaccagacccctgagtcaccggcggaggtccctaatcgcagagacacactacaccgcggaacaatacagagagcaagcggtaaatcctcagggaaaacacccaatgttgggttgagcgacgctcacaatctggcttcacctcgaaccccga

SEQ ID NO: 637655 - DNA, 134 bp, Homo sapiens
  misc_feature (38)..(38): n is a, c, g, or t
gtgaattcgcgctctccttcccgacgccccggcttctnggagcgtcagagcaacggaagtacgtacaggaggaccgagagcagcagggaagtttggccggtgggctggggtcggcgcgaagattcccctgcccg

SEQ ID NO: 637656 - DNA, 452 bp, Homo sapiens
tatgtgtatatacacgtttttgcgttctgtgaatacgtcttggcgttgattacgtcttcatatgtatgtgttgtggatatgcttggttatgtattctgttctcagtcttccctagctttagtctccgtagaagatactcagggtggtacggccggggtgatagccccgggtgttctgtgggggcttttatttgttctggttggttttctgttttttttcgccggcctggttgtctttaaaacgcgtgggtacatatgggtttgtctgaggttctgtgtggtgtatcccgtatttcttcagtctctgatcttggtctgtattgtttatgtaaaggggtggggagaggggtaaaggggggttttgggttgggggggggggggcccccttccccaggccttcccttcccttgttgcaggggttttggagagaaacaataaagagtttcacaccca

SEQ ID NO: 637657 - DNA, 134 bp, Homo sapiens
cggcacctaatgtattggtgaactttgaaagctcgacagtcatctcagagtgtgagaccttgtccaggtagatgatgagggtcccctatcgagtgaaggctttgtccagctcatacttggaagaaagtccatta

SEQ ID NO: 637658 - DNA, 374 bp, Homo sapiens
  misc_feature (68)..(68): n is a, c, g, or t
  misc_feature (134)..(134): n is a, c, g, or t
  misc_feature (302)..(302): n is a, c, g, or t
  misc_feature (327)..(327): n is a, c, g, or t
  misc_feature (348)..(348): n is a, c, g, or t
cttaggctgtagtgcagtggtgtgatctcagctcactgactgcaacctcccacctcccgggttgaaancgttgctcctgcctcaatctcccaattagctgggattacaggtgtgctccatcatgcccggctaanttttctattattagtagagacagggttttaccatgttggccaggctggtctggaacccctgacctcaagtgatccgcctgcctcggcctcccaaagtgctgggattacaggcatgagccattgtgcctggccctacacgtggacacttctttagcatatggttagggncctttctagaaattccaaagacagnctttaagaagccccgtcgggnaaccttaggccaatgatgtggttaca

SEQ ID NO: 637659 - DNA, 113 bp, Homo sapiens
caccagggatgactgcagccatatggcgggaggacttcctgttattcagcatcaggcggatgaaggacacaaggcattcccatagtgccccctggcgctcgctgcggaacacg

SEQ ID NO: 637660 - DNA, 534 bp, Homo sapiens
tgattatggagtctttttctgtcgcccaggctggagcgcagtggcgcgatcttgggtcactgcaacctctgccttccgtgtttgagcaattctcctgcctcagcctcccgagtagctgggattacaggcatgcaccaccacgccaggctaatttttgtattttttttagtattaaaaaatcaccattttttagtatataaaatcaccatgttgttcagggtgttttcaaactcctgacctcgtgatctgcccaccttggcctcccaaagttctgggattacaggcttgagccaccactttctgtgtgtgtatatgcgtgtgtgtgtgagtgtgagtgtataattgggtgtgtataactgagtgcgtataatcgggagatatagattcaatatagatccatatatacatgcaggataaatgaatggcaaaacgtttttaaaagtcaggaaagatagactggtgaaggactcacgtaagggcctgggtatgggagaagagcagaaagtcacagaatgaggacgccatccaagggta

SEQ ID NO: 637661 - DNA, 323 bp, Homo sapiens
gcacggatccccttcttcgaaaaacaatggcattcttaagcatttgcttctgtgtatactcagagttcatatcctccattcccacttgttcttccctgcctattcttcctcttcctgccttctactgcaacatattggcacctcacgtgaggctctcaaaatgatccagagttatttgttgcacctcacgctcattccgaattctttgggccatttggcctcagcagagagctgtcatgtgccaaggctccgttggcattcttagctctgctttctgtagcactgagagttcattcctccatccctatcttgttcttcgagag

SEQ ID NO: 637662 - DNA, 294 bp, Homo sapiens
tattcgtgtacgcactcaagagtagcgatgtatgagccagaagacagtcagagaggtgtgacaggacagacgaatgtcgggacggagtctcgtgtgatgtcgatcaggtggacttggaaggatggtgctggggggtgcccccagcaaaagcacctcatgtgcctccttgtgcatcttctggcttgggggaaggaagtgttgagtgaaggtttgcgaagtgtggtattctgcgtggagcgaaaggcccgttgtggtgtcgggaatgctgggagggtgctcagtgagacctccttc

SEQ ID NO: 637663 - DNA, 750 bp, Homo sapiens
gatcgctgctgagctgggcgcctgcagcgtggagctgggagcctggatgctgcgatggctgcggcgctagagctgtgggctgctgcggtggcctgggctgagctgggaccagtgcgggagccatggacctgctaggtgccctggcctatgcccctgctgatgcctgcctggctgatgtgtgcccccatgctgttcctctgctgctggcatgttgcctgctgcatgggtgctgctgctctggcatgcgcctccctgggctcccggcaagtcgcctgccggagccccccagcccgcaggagatcctgatcaaggtgcaggtgtatgtgagctggggagctggtgcccctggcccgggcctcagtggatgtgtaggggaaccggactctgctggcagctggcaccacagactcagagggtgtggccaccctgcccctcagttatcgcttgggcacctgggtgctggtcactgctgcccgccctggcttcctcaccaactctgtgccctggcgtgttgacaagctgcccttgtatgcgtctgtcagcctctacctgctccctgagcggccggccacgctcatcctctatgaggacctggtgcacattctcctaggctctcccggtgccgatcccagcccttggtgcagttccagcgccgggctggccgcctgcctgtcagatccaactacagccagctctgggcgtcacttacgccttgcaggaccagcaggaaaatggggctatccttgccta

SEQ ID NO: 637664 - DNA, 174 bp, Homo sapiens
aaaatgaaacttgtaaatttttgtgtaattgtatgtaagtttactttttatggaggaaggattctagataatgacaaatgaagattatgacatgtatttaactcctgtgattaggttatacgaacatgggtaataactagaatgtagagacacatctagtgaagggtaggagag

SEQ ID NO: 637665 - DNA, 258 bp, Homo sapiens
  misc_feature (177)..(177): n is a, c, g, or t
  misc_feature (180)..(180): n is a, c, g, or t
tccggtctgctccacgctggttccaggcttccgttttagatgtaaaattctcactgggaggggtgaaaatcaaattcatccctacaggtttctgtttagccattttctatgttgtttcttaccgaatcaaaaccaaatcagagcagctttgaactctccctccaaagggaccgaagntcntcataggcctttgaaaaggaagcagtgggggagacttacagcttgcaaacccaaataaataaatcttcagaaaagaga

SEQ ID NO: 637666 - DNA, 126 bp, Homo sapiens
  misc_feature (35)..(35): n is a, c, g, or t
  misc_feature (95)..(95): n is a, c, g, or t
ggtttaaaaatattttattctttagaaaatacagnattcaaccatcccaaactgcagtgacccctgccccagtctttattgaccccagtttttgnggccaaaggtttctgggctgtgttgtgaccc

SEQ ID NO: 637667 - DNA, 3003 bp, Homo sapiens
ggggagcggggagcctaatcctgctggcaagaaaaagaagtatctcaaggccgctctgtacgtgggtgacttggacccagatgtcaccgaggacatgctctataagaagttcaggcctgctggccctctgcgattcacccgaatctgccgtgatccggtgacccgcagccccctgggctatgggtatgttaacttccgctttcccgcggatgcagagtgggccttgaacaccatgaattttgatttgattaatggaaaaccattccgccttatgtggtctcagccagatgaccgcttaagaaagtctggagtgggaaatatattcatcaaaaacctggacaaatccatagacaatagggccctgttttacttattttctgcttttgggaacattctgtcctgcaaagtcgtatgcgatgacaacggctctaagggttatgcctatgttcactttgacagcctggccgctgccaatagagccatctggcacatgaatggagtgcggctcaacaaccgccaggtgtatgttggcagattcaaattcccagaagagcgggcggctgaggtcagaaccagggatagagcaactttcaccaatgttttcgttaaaaacattggagacgacatagatgacgaaaaactgaaggaacttttctgtgaatatgggccaactgagagtgttaaagtaataagagatgccagtgggaaatctaaaggctttggatttgtgagatatgagacacacgaggctgcccaaaaggctgtgctagacttgcatggaaagtccatcgatggaaaagtcctctatgtagggcgagcacagaagaaaattgaacgcctggctgagttgaggcggagatttgaacggctgaggttaaaagaaaaaagtcggcccccaggggtgcctatctatattaagaacttggatgagacaatcaatgatgaaaaactgaaggaggaattttcttcctttgggtcaattagtcgggccaaagtgatgatggaagtggggcaaggcaaaggatttggtgtggtctgcttttcctcttttgaagaggctaccaaagcagtggatgagatgaatggccgcatagtgggctccaagcccctgcatgtcaccctgggccaggccaggcgcaggtgctgagaataagaatgctcagtttgtttcagccttagttggtgcctccttagtttgggctcctttgtgataaggggttattttatgctaattcacaagttttttttgaagtgaattcttttgaaaaaaaaatgcaaaactagaaaactttattcattttagaatagaacataatttctaactgtaaaattgtcattttgtactttttttgatgtaatatccttagaaatctgtagaataaagtgtattcctccacttttttttcctgaacagtcaaggtgaggcaattgattgagtatatttcccttcttatttcagtaatactctattttttttcatgaaaatgtcaacatggttcttctgaatctatcacagtgaaaagttctaacttgtttttgagaagtcagtacagcaggggaaaacatatgtgatgcaattaacatctgcataatttcacttaaaattattatgcaaaaatgaatgttttttcaaaaaatgtgaaatgtattttattttctttatttgtattcttgtttcattttttaatatgttgtgaacatgctacagatttgatagtacttttgactaaatgttgggagtggtcgtattaacttcttgcccaaagaagtaagcatattggtgttttctcaattagtcactgagaaaattaacactttaggcagtggctatttaaagtaggaattgcatcttaaaaacctttcctaagagatttggtatgtgaggatactttcagtaccactcctaccattcatttttctaaattccttagtacatatacttggatcatgttaaattaacaagaaagatgaataactgcgctgaattgcctttacctataaataatttaatattttaccttcgggttttatcaactgtcaatataaaaggcagtactccacagaatgatgttgaaaaacttcttcgaagaacaccttctattaaacttgttatctcttgtaaattattgtgtgtgtccttttgataatattcacaggtgtttcaaaggtaaggaataggttgtctcttggattaagtcatatgcctccagccattatatgagaactgtgaaaccaatatggttttctttatgtcttggctgcttgaaaattaaaaaaaaaaaaggtttgttcaatattgccgttacatttattagcctgtaatttctaaattggagattctctacatttcacttgcagtttcctgttctcctcattgcctgccttccattcatattacacttatttttctattttttgtattacctttttaaaaatatataccagttcaagtccttttaggaagaagaaaatacctaatttatgtaaaatttaaataattacttttttataatatgattcacttatgccacagattcaacattagaatatgttttatctctactgtcagttttattaccttatatacaaatcttcattttcatacatagtacaatgtaaatatataactttgttaacacttttgttagctctttgaccataaaataatgacaataagctgtttctatgtatttgtttatctacaaattacaggtttatccatttgcaaatattttcaaaatggaaatcactgtttatattgattataaacataagacatgctcattgtaaaaaatgtacacaaggcagaaggaagtaaaatttccacagttcagaaataccacaattaatattttcaatgtgtaaatatcttttcatattttttcctacgtatacacaaacattttgaccaaaaatccacactatatgtactgttctgtatttttaattttaaactgaacaataatcatcttttcctgacaataaatatcaatctctatcatc

SEQ ID NO: 637668 - DNA, 132 bp, Homo sapiens
gtatatagaggatcttagaagatataggagagggaggcggaaggaggatgtaggagagggagaggatgaggagagggagaggatgtcggagagggaggggatgtaggagagggaaggatgtcggagagggag

SEQ ID NO: 637669 - DNA, 168 bp, Homo sapiens
aaaaaaaaaaaaaaaaggaaggaaggaaaaggaaattcggggatagaactggggcgcatgaaacccataatagggggggtgggggatattccacaaaattaccatttcttcggggccctcaaaacacacggagtccacccttgtcaatctcaaagccttcaaccccaa

SEQ ID NO: 637670 - DNA, 2845 bp, Homo sapiens
  misc_feature (1)..(1): n is a, c, g, or t
  misc_feature (25)..(25): n is a, c, g, or t
nctagaggaagcgggagttacttancacggttccgggtttctcgcgccccgcctgtcccccctccctatcactgctactggctcttggtccctccgttgggctgtcctgcggagagaaaccccagcccatcggtctgcgctgggaccgcctgccgcgcatctgcccttcttcgctgactccgccccgcatctggccagacccgcctcgcgtcagagctgacccactcactgcgcgtttgccagtcaatctctccggacctgcctcgagcctcaggctgctgaaatcaccgcgcctcactcgcctggccgctgccaatagagccatctggcacatgaatggagtgcggctcaacaaccgccaggtgtatgttggcagattcaaattcccagaagagcgggcggctgaggtcagaaccagggatagagcaactttcaccaatgttttcgttaaaaacattggagacgacatagatgacgaaaaactgaaggaacttttctgtgaatatgggccaactgagagtgttaaagtaataagagatgccagtgggaaatctaaaggctttggatttgtgagatatgagacacacgaggctgcccaaaaggctgtgctagacttgcatggaaagtccatcgatggaaaagtcctctatgtagggcgagcacagaagaaaattgaacgcctggctgagttgaggcggagatttgaacggctgaggttaaaagaaaaaagtcggcccccaggggtgcctatctatattaagaacttggatgagacaatcaatgatgaaaaactgaaggaggaattttcttcctttgggtcaattagtcgggccaaagtgatgatggaagtggggcaaggcaaaggatttggtgtggtctgcttttcctcttttgaagaggctaccaaagcagtggatgagatgaatggccgcatagtgggctccaagcccctgcatgtcaccctgggccaggccaggcgcaggtgctgagaataagaatgctcagtttgtttcagccttagttggtgcctccttagtttgggctcctttgtgataaggggttattttatgctaattcacaagttttttttgaagtgaattcttttgaaaaaaaaatgcaaaactagaaaactttattcattttagaatagaacataatttctaactgtaaaattgtcattttgtactttttttgatgtaatatccttagaaatctgtagaataaagtgtattcctccacttttttttcctgaacagtcaaggtgaggcaattgattgagtatatttcccttcttatttcagtaatactctattttttttcatgaaaatgtcaacatggttcttctgaatctatcacagtgaaaagttctaacttgtttttgagaagtcagtacagcaggggaaaacatatgtgatgcaattaacatctgcataatttcacttaaaattattatgcaaaaatgaatgttttttcaaaaaatgtgaaatgtattttattttctttatttgtattcttgtttcattttttaatatgttgtgaacatgctacagatttgatagtacttttgactaaatgttgggagtggtcgtattaacttcttgcccaaagaagtaagcatattggtgttttctcaattagtcactgagaaaattaacactttaggcagtggctatttaaagtaggaattgcatcttaaaaacctttcctaagagatttggtatgtgaggatactttcagtaccactcctaccattcatttttctaaattccttagtacatatacttggatcatgttaaattaacaagaaagatgaataactgcgctgaattgcctttacctataaataatttaatattttaccttcgggttttatcaactgtcaatataaaaggcagtactccacagaatgatgttgaaaaacttcttcgaagaacaccttctattaaacttgttatctcttgtaaattattgtgtgtgtccttttgataatattcacaggtgtttcaaaggtaaggaataggttgtctcttggattaagtcatatgcctccagccattatatgagaactgtgaaaccaatatggttttctttatgtcttggctgcttgaaaattaaaaaaaaaaaaggtttgttcaatattgccgttacatttattagcctgtaatttctaaattggagattctctacatttcacttgcagtttcctgttctcctcattgcctgccttccattcatattacacttatttttctattttttgtattacctttttaaaaatatataccagttcaagtccttttaggaagaagaaaatacctaatttatgtaaaatttaaataattacttttttataatatgattcacttatgccacagattcaacattagaatatgttttatctctactgtcagttttattaccttatatacaaatcttcattttcatacatagtacaatgtaaatatataactttgttaacacttttgttagctctttgaccataaaataatgacaataagctgtttctatgtatttgtttatctacaaattacaggtttatccatttgcaaatattttcaaaatggaaatcactgtttatattgattataaacataagacatgctcattgtaaaaaatgtacacaaggcagaaggaagtaaaatttccacagttcagaaataccacaattaatattttcaatgtgtaaatatcttttcatattttttcctacgtatacacaaacattttgaccaaaaatccacactatatgtactgttctgtatttttaattttaaactgaacaataatcatcttttcctgacaataaatatcaatctctatcatc

SEQ ID NO: 637671 - DNA, 238 bp, Homo sapiens
ggttccacatttctgtgcatgtgttcagtaatatgggccaaaataatggaattgattatgttcctgtttggccatcacgtacacatgtaatctggaaaatcatacctgtgtcaattttaaacataactgttggcatttcccagatttatactatgaacattggggtaatacagtttattgcttcattgctatatgacagctaaggggcaaatgattcaagtatatgttaagtcagaag

SEQ ID NO: 637672 - DNA, 232 bp, Homo sapiens
tgctggtcgatctctagcaggatcccctacgtgccggttgcctgctactatgggtgttaaattcatttactctctctacaacggtttgttcctagtgtcccaagagctgtcctcttaggactaacagttcaattaacaaggcgatttagagggttctgtgggtcaatctccatgtttaaactacgattctatcttggggtaccgatgcacgtacatcgtgcatccttgtcat

SEQ ID NO: 637673 - DNA, 211 bp, Homo sapiens
  misc_feature (5)..(5): n is a, c, g, or t
ccccngattttttttcaaaggaatttttttccccaggggttgaatttttgggtcttttccgggttttttggcaaattaggggggcccggggctcaagtgggggaagggggggggcccaaggatcccagggctctccccccaggttttgggacagaactgaggggtgaattttggttttcttgaaataaacagaagaaaatgaaccctttta

SEQ ID NO: 637674 - DNA, 293 bp, Homo sapiens
gtcagcgcgatccttctttattgagctctcgggcgaggttcactggtccgcagggggagggccagggaagtctcgctgtgccaaaggtgcagcgcgcttttatggatgctgggtgaggagtggtcagggtaggggcagggtcggttgagtttcacgcttctgagtgtgacacgccctagtgggcatgtgcgttagtcggggtggcaggaacaggaaaggtgaacccggaaatgctgagtcagggtgtccgaggtggcgatcgccatcttggagtcttcaccggagtccaatca

SEQ ID NO: 637675 - DNA, 403 bp, Homo sapiens
acctattaccatcataagaaacaactgcattgactatgccagtgcacactgccatggtggtgaaccctagcaagcatgctttaacctctaagactgtctaacacgcgtgtcattctatgtctccacagactgcgtggcataaaaatcaccttataagttttagtttttaatctaaagatgttagacagatgctgagtgtgcgtatactcaaccgcttagaccttttactattttagtcggatttagtataggaattaagcttatgtatgaacactcagcagaaaagtacttacttcttgccagttatctattaaccaaaacctttgatttgtagttttaaagattaaccctcaaagttctcttcgtaactgccttgacattttgggttgttctgttctgttaa

SEQ ID NO: 637676 - DNA, 170 bp, Homo sapiens
cgaggcccgccaatgtccgagggccccagctggggttatcttgcccccagacctacgggtgagacgcttttcgaccctgtattcctaaactcagacttgactagtgggaccctccatctgggtatagttcatcggggcgggattcgatcaggccttccgcgctacactta

SEQ ID NO: 637677 - DNA, 679 bp, Homo sapiens
  misc_feature (184)..(184): n is a, c, g, or t
  misc_feature (187)..(187): n is a, c, g, or t
  misc_feature (190)..(190): n is a, c, g, or t
  misc_feature (214)..(214): n is a, c, g, or t
  misc_feature (217)..(218): n is a, c, g, or t
  misc_feature (225)..(225): n is a, c, g, or t
  misc_feature (231)..(231): n is a, c, g, or t
  misc_feature (240)..(240): n is a, c, g, or t
  misc_feature (249)..(249): n is a, c, g, or t
  misc_feature (256)..(256): n is a, c, g, or t
  misc_feature (269)..(269): n is a, c, g, or t
  misc_feature (287)..(287): n is a, c, g, or t
  misc_feature (319)..(319): n is a, c, g, or t
  misc_feature (370)..(370): n is a, c, g, or t
  misc_feature (390)..(390): n is a, c, g, or t
  misc_feature (393)..(393): n is a, c, g, or t
  misc_feature (397)..(397): n is a, c, g, or t
  misc_feature (413)..(413): n is a, c, g, or t
  misc_feature (425)..(425): n is a, c, g, or t
  misc_feature (429)..(429): n is a, c, g, or t
  misc_feature (438)..(439): n is a, c, g, or t
  misc_feature (453)..(453): n is a, c, g, or t
  misc_feature (458)..(458): n is a, c, g, or t
  misc_feature (460)..(460): n is a, c, g, or t
  misc_feature (465)..(465): n is a, c, g, or t
  misc_feature (508)..(508): n is a, c, g, or t
  misc_feature (526)..(526): n is a, c, g, or t
  misc_feature (548)..(548): n is a, c, g, or t
  misc_feature (591)..(591): n is a, c, g, or t
  misc_feature (620)..(620): n is a, c, g, or t
  misc_feature (667)..(667): n is a, c, g, or t
ctgcctgcctatcacaaggggcccctgcaaagacaacggtcggcccttacggttggggtacaggaatcccgaaggcagttcataactcctgggcctgccccagctttaatctgggtctccgggagacaataagtggagccccatctcttctccgtggcagaggaagatgaggtctccatcaagnagncanccaagcggtggtgaaggccatggnctnnatggggnaagtcncctttgatncaacaagtnggatggncagtttaagaagncagccagtaacagcaagntgaggacctacctgcccgacttccggttcacncccttaagcaggcggtgaaggagacctgtgcttggttccctgacaactccnagcaggcccggaagtgaagntgnaaancaggatcaggtgccancggaccatcggntggnagagcccannggcccccccccgtnaaccntnccagnagtgagggccccccccagcaacctgggcctgcattccatccgntttgcagccccaagcatntttccagtggggcccccattcncgttggtcctcagggaaaccagggtcccgggcaggcccggcgntttgctcccccccccagccccctgggggngtcccctttgatcctgcatccccctccctgggagccaataaagggcnttttcccaggca

SEQ ID NO: 637678 - DNA, 477 bp, Homo sapiens
  misc_feature (477)..(477): n is a, c, g, or t
ttgttacaaagaaaggtaaactggtgattatagactggcttcgaagacttgaggagaagctttctgaaacgcaacgaggaggcaccattaagttcataggggatgacaactgacccctaacaaaatctcggtcctacgatgttgtcattatgaccccagctgatgaaccacctctttaatagacgacgcaccagtagaatgacctattggggcatcgacctcctcaatacaaaaagacgaccgcatctcttatatatcatgtgtccaataatgcgcgccaaaatacatccgagtgtgcttttaaaaaaaaacatcgccatctgagggttgataagaaccctctccataatgcaagtcccagctgatcggaaagatctataaatacagtctcccccgggcacttcttaaaatttggacctcgttagagcagatcagtgcttttcgttggcccacaatacctgagagaagatcaggtgn

SEQ ID NO: 637679 - DNA, 258 bp, Homo sapiens
gagtcaatgcccaagatgctccctagaacaccagcggaagcctcctccactgggcagacaggtcctcagagtgctctgtaggagctgtagacttggaagagaggccaggcgtggtggctcactcctgtaatcccagcactttgggaagccaaggtgggctgatcacttgatcccaggagtttgagaccagcctgggcaccatggtgagactcgtctttaccaaaaatacaaaattagctgggtgtggtggtgcacagc

SEQ ID NO: 637680 - DNA, 364 bp, Homo sapiens
gatcgaccgacaatctactaaccaggacacattcacctacccatctaccccttcaccctggttaaatgagtcaacttgatgcaaatgttctgaaattttaggtttgttcttatgcttctgcttagatagatagatagatagatagatagatagatagatagatagattgattcattgacatttggctgcgcctacatcatgttgaagttctcaggtcagggatcaaatctgtgacacagcagtgacaatgtgaaatccttccctttgaggcaactcctacctctgctgtgttcttttcctgtttttcttatctttgctttttattacggccacacctggaacatgtggaagtccccaggccagg

SEQ ID NO: 637681 - DNA, 772 bp, Homo sapiens
  misc_feature (39)..(39): n is a, c, g, or t
  misc_feature (62)..(62): n is a, c, g, or t
  misc_feature (80)..(80): n is a, c, g, or t
  misc_feature (121)..(122): n is a, c, g, or t
  misc_feature (130)..(131): n is a, c, g, or t
  misc_feature (139)..(139): n is a, c, g, or t
  misc_feature (171)..(172): n is a, c, g, or t
  misc_feature (200)..(200): n is a, c, g, or t
  misc_feature (209)..(209): n is a, c, g, or t
  misc_feature (216)..(216): n is a, c, g, or t
  misc_feature (227)..(227): n is a, c, g, or t
  misc_feature (248)..(249): n is a, c, g, or t
  misc_feature (269)..(269): n is a, c, g, or t
  misc_feature (276)..(276): n is a, c, g, or t
  misc_feature (285)..(285): n is a, c, g, or t
  misc_feature (299)..(300): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (326)..(326): n is a, c, g, or t
  misc_feature (346)..(347): n is a, c, g, or t
  misc_feature (374)..(374): n is a, c, g, or t
  misc_feature (387)..(387): n is a, c, g, or t
  misc_feature (432)..(432): n is a, c, g, or t
  misc_feature (439)..(440): n is a, c, g, or t
  misc_feature (447)..(447): n is a, c, g, or t
  misc_feature (700)..(700): n is a, c, g, or t
  misc_feature (768)..(768): n is a, c, g, or t
tcgtggctaggtagggaggagaggccttaatatgcaggngggcggcaagggagcctagggtntggggaaagcagggtgtnggcagcgagatggctccgggggtttagacactgctggcttnngccccggnngccacctncctctcactccagctgcgagcagcttcacttnnggccctgggcctccgaatcctcctcgtngtttttttntattttnttctctttttnggtcgtggggtcctggtactnntggtactcggacaccaggtngtttatnttgtttttngtttcggtgaactnnatnttgttnatnttcttgttcgtgtnccagtgcaggaaggccttgnnccggaacatggccgtgaactgctcggngatgcgcttgaanagctcctggatggccgtgctgttcccgatgaaggtggaggacatnttgaggnngcggggngggatgtcacacacggccaccttcacgttgttggggatccactccacgaagtagctgctgttcttgctctggatggccagcatctgctcgtccacctccttcatggacatgcggccccggaacacggtggccaccgtcagtagcggccgtggcgcgggtcgcaggcggccatcatgttcttggcatcgaacatctgctgggtgagctcgggcacggtcagggcccggtactgctggctgccccgggctgttangggggcgaacggtgctatgaagaagtgcaggcgcgggaagggcacatgttgacggccagcttgcgcangtca

SEQ ID NO: 637682 - DNA, 320 bp, Homo sapiens
gcaagttatagctattcgtatttgacaatgactgacaacgataatacaaatatctgcagaagactctagtatgcatgaaacagtgacataataatagagtaacctctagcaacaagacttaacataaagacaacctctcccattccttcaaaccaatattgttgatcacgttatttctttttaatttttttgaatcagccattcctcatttaacctcgtgaacttgcatgttcctattcatttcctcagtcaggaccagtattattccatctagtaacttctccgcagtactaatagccttgcaaatggtcgttcaggag

SEQ ID NO: 637683 - DNA, 162 bp, Homo sapiens
tgccgaaggaagaggccagggaagaaggtgctccgcccagctttgtgaagagcaggaggctaagaagtggtaatccctgtttaagaaaggcctaagaattttggcattggcaggcatcaggcccaaaagagaccttacccgctttgtgaaatggccccctat

SEQ ID NO: 637684 - DNA, 378 bp, Homo sapiens
  misc_feature (182)..(182): n is a, c, g, or t
atcttttcttttttaagaacccaccaaattttattgtgattgcttatttaaaagagtaagctgtgtaaggtcagggactatgtctatctggcctacgtttgtatttcttttttttttttcttttgagacaaagtctccctctgtcacccaagctggagtgcagtggggccatttgggctcantgcaacctccacctcccgggttcaagtgattctcctgcctcagcctcctgagtagctgggactacaggggtgtgcccccacgcctggctaattttttttgtatttttattaaagactgggtttcatcatgttagccaggatggtttccatttcctgacctcgtgatccccccccccccccccaagaacagggttta

SEQ ID NO: 637685 - DNA, 703 bp, Homo sapiens
  misc_feature (544)..(544): n is a, c, g, or t
aagaaatacctttcataaggctatagctgccattgattcctctgatggacctaggtaaagtaaattgaaaaacttctggagaggattcagcattccagatgccattaagaacattcgtgattcatgggaggtcaaaatatcaatattaacaggattttggaagaagtggattctaaccctaatggatgattttgagggattcaagacttcaatggaggaagtaactgtagatgtggtggaaatagcaagagaactagaagtggaacctgaagatgtgactgaattgctgcaatctcataaaatttgaacagatgaggagttgcttcttatagataagcagagagagtggtttcttgagatagaatctactccttgtgaagatgctgtgaacactgttgaaatggcaacaaaggatttgaatattccataaacttagttgataaagcagaggcagggtttgagaaaactggattgactccaattttgaaaggtccactgtgggtaaaatattatcaaccagcatcacacgccatcaagaactctntcatgaaaacaagtcaatcaatatagcaaatgtcattggtgccttattttaaggaattgccacagccaacccaaaccttcagcagccaccatccagatcagtcaacagccattaacaaggagccaagaccttccaactggcaaagaatatgacttgctt

SEQ ID NO: 637686 - DNA, 161 bp, Homo sapiens
ccccgatgctcagccccccccggcaccatgtctggagaaaagcgtggaggcagcggccgagttgagcgccaaggacctgaaggagaagaaggagaaggtggaggagaaggcaagccggaaagagcgaaagaaagaagtggcggcggctcgtggctgggggg

SEQ ID NO: 637687 - DNA, 481 bp, Homo sapiens
agagcaggtcctaactcttttcaattctatgaaggctgaaaggtaaggaagctacagaagaaaaatttgaaactagcagagattgggtgttgaggtttaaggcaggaagtctccataacataaaagtgtgaggtaaggcagcaagttctgatggagaagctacagcacattatccagaagatctagcaaaaataattgatgaaggtggctgcactaaacaacaggttttcaatggagataaaacagccttctagtagaagaaaatgccatctaggactttcatagctagaaaagagaaatcagtacatgactttaaagggcaggctgactctcttgttaggagctaatgtaactggtgccttgaagttgaagccagtactcatttaccattcctaaattctagagctcttgagaattatgcagaatctactctgctgcattaacaaaacaacaaagcctagattacagaacaccgtcgaag

SEQ ID NO: 637688 - DNA, 206 bp, Homo sapiens
acagctcttacagaatctgaaattaccttgtttgtacatttatttacttgtttaaggtttctccttttgatggtaaactccatgtctctcttttgtgggaaggtcaggtcttgggttgcccttaccaaaaactacctttcttccatttcgtccttggctaaggcaaggcctcctttatctggcacttgtttaaaggggattttgtg

SEQ ID NO: 637689 - DNA, 553 bp, Homo sapiens
  misc_feature (4)..(4): n is a, c, g, or t
  misc_feature (65)..(65): n is a, c, g, or t
  misc_feature (69)..(69): n is a, c, g, or t
  misc_feature (73)..(73): n is a, c, g, or t
  misc_feature (75)..(76): n is a, c, g, or t
  misc_feature (78)..(78): n is a, c, g, or t
  misc_feature (80)..(80): n is a, c, g, or t
  misc_feature (82)..(84): n is a, c, g, or t
  misc_feature (94)..(94): n is a, c, g, or t
  misc_feature (100)..(100): n is a, c, g, or t
  misc_feature (118)..(118): n is a, c, g, or t
  misc_feature (129)..(129): n is a, c, g, or t
  misc_feature (137)..(137): n is a, c, g, or t
  misc_feature (149)..(149): n is a, c, g, or t
  misc_feature (176)..(176): n is a, c, g, or t
  misc_feature (270)..(270): n is a, c, g, or t
  misc_feature (289)..(289): n is a, c, g, or t
  misc_feature (296)..(296): n is a, c, g, or t
  misc_feature (311)..(311): n is a, c, g, or t
  misc_feature (331)..(331): n is a, c, g, or t
  misc_feature (342)..(342): n is a, c, g, or t
  misc_feature (347)..(347): n is a, c, g, or t
  misc_feature (384)..(384): n is a, c, g, or t
  misc_feature (386)..(386): n is a, c, g, or t
  misc_feature (389)..(389): n is a, c, g, or t
  misc_feature (391)..(391): n is a, c, g, or t
  misc_feature (553)..(553): n is a, c, g, or t
gggnggggaaagaaaaaacaaaaaacaaaacccagaaaacaaaacaaaaaaccacaaaaagaaangttncatnanntnanannnggtttctgantaaagnttctccttcccccttcantttctccacangtgaggantgaataaagagnggaggaaatcccgccccaaggaagtangaaaacaattccaaacaacaaaattttcaatgcaggaaatgagcgagtttaggttggagcatgggtgttacgtgggaggtgagaatggtaaacntggtttggttgtctagggngggagantcggtgacaggttcnagacactggagagtgttgcngctgcctgaantgcangagctcaaacacacaaactgggtaaggtagtaggatnanatngnttgggaagaggagagataggtggacacagggaaggggctgaagagaagcacaaaaggtttcatattgccattgggtagggggcttcaccttttcagacctttcaaaaaaacaaaacccaaacaccatgtcaaactaaaagagcaataatgtaagcatacggn

SEQ ID NO: 637690 - DNA, 595 bp, Homo sapiens
ggtatgcatataagctgcgtgctcgggctgcgcctccctgcgggggaccggtccggctcctggccgccctgttggggcaatgctccccggggccgctgggaatgagccagcgatcctgaactgtgttcctgcccacagtgactcgtgcctggtccgggcatggagacccatgtggcgggcatcgctgggttcggcggtgcaatgagcgtgcgtgccatttcgctccagtgaggcctacgtgtgaggccatgaatggaggacctggccgagtggctcaatgccttgtactggtcctgggtctccctgggtggtggcgatggcttcctgacagggctggcacgggcacgacctgtgccaacatgccaacgccgtgacctgatggctgcccgtgcattggcatgccgccgcccggcccgaggtgtggccttccaggcgcacagtgtagtgcctggtccttcatggcgcgcgaaacgtggccaccttcatcggctggtgccgcgtggagctgggtgtgcggaggtgctcatgtatgagacctgggacctggtgctgcgcaggaacgagaagagcggtggtgctgtgcctgctgggggtg

SEQ ID NO: 637691 - DNA, 119 bp, Homo sapiens
cgcaaagcaagtggcaccgcaaagcatgtgagcccaagtgtgtggaagggttgcctgagtggaatttcgatggctccagtactttacagtctgagggttccaacagtgacatgtatctc

SEQ ID NO: 637692 - DNA, 819 bp, Homo sapiens
  misc_feature (242)..(242): n is a, c, g, or t
  misc_feature (434)..(434): n is a, c, g, or t
  misc_feature (520)..(520): n is a, c, g, or t
  misc_feature (542)..(542): n is a, c, g, or t
  misc_feature (546)..(546): n is a, c, g, or t
ggaattagtccgagtgtacgagagcgagctgagctcggttgtgtgcgtcgcgttctcgagaaacatcgcgtgtatcctgtcttgctatctactgggcctgtacccacagcatgagcttgcaaggaggcacaattcgtcgagacattctcgataacgcaatgctgttatatcaactagtttgatcggaagcatgcgtgtatggcaatcgttataatcaaacaagatggaggtatgcagatacncgtgtagactgacggaatctatcttgagagcatgaatgttcccagacagcaatgcggacgtttatcgaggatcactgacttacattgaatgctaaatgtgacttgatggtagactgtgcagcaacgttgatctttccgctgaagatttactgcacgagatgcattgggcgaagaagacatacatgcaagagnacacaagcacgagatgtgagagctatagcatacattgaggacgatagcgcgattcactgacttggtgatttattagaatcaacatngggattggccagatagggactnattnattcagattgcctgtccagaaagcttttacgtccaattgctggattggatcatagacccattgtgccctgaacggaagtatataccaagaatgtacagagatgctttgaatcgtacactttgactcagggcgatacgtcaggaatattttgagtgcgctgaatggctcacccgtttaagctacttgacactcacggtttatggtaccagaaattgatttgaccagcagaacactgataagaccctttgttaccacgaacttgtgctatatcag

SEQ ID NO: 637693 - DNA, 791 bp, Homo sapiens
tttttggattctgccagctttatttttcagttgaaaactcaaaggaaaaagttacattcccaaaagaaagtaaaacacttccaatgatgtagcctggaggcctgagttcacaggtgcccctaccaaaacagaggccctccccagggtcccctaaagcattcagtcccagtgtgtctaccccaaagagagaagctgcctacctgggcttctgattaagaggcttggggccatcacttcccttcaaggaaactcctgcctgaaaagacccctggatcaggcagggaaagccagtaccaagcagctgaggacctggcttcgtgtcccccaccacgcagtcagcgttctgaagcagtggcttcccaaatggctgttgaataagtgaataaatctcttgggcatgaacaggggccaggtggagttttctctgcagagctggtacttgctggccgcactgtctcctggtttgcagtggaagtgtggaggaagggggagaattactcagaccagtgggagagtttcatgtcccccggaagtattttgagcccagtggcaatgagccctgcttccgtgcgtttgcagcacgtgcggttctgagtttcccggcattccatgctggttattctgtcccagccatgaatcttgccattgtcagggagctggaattgcagtagaaggtgaaggagtttgaagtctggcagcctagtgctggcatagacaaaatctcaaacacactgtggaggaggggccaggggtacgaatccacgggcacacaggtggatgtaggcggccgc

SEQ ID NO: 637694 - DNA, 877 bp, Homo sapiens
  misc_feature (471)..(471): n is a, c, g, or t
  misc_feature (474)..(474): n is a, c, g, or t
  misc_feature (480)..(481): n is a, c, g, or t
  misc_feature (483)..(483): n is a, c, g, or t
  misc_feature (490)..(490): n is a, c, g, or t
  misc_feature (492)..(492): n is a, c, g, or t
  misc_feature (540)..(540): n is a, c, g, or t
ccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagcngancacacnncngtacaananccacccataccgggccttcccggtatgggtgggtgttgtacagcagtntgctcagctcccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacaccagatcctaaccatggcttctatgtcagcccatctgtcctcagcgcccttgtgcccagcatggtagcagccaagccagtggac

SEQ ID NO: 637695 - DNA, 146 bp, Homo sapiens
ttttgggaggccaaggtgggtggatcacatgaggccaaaagtttgagaccagcctggccaaacatggtgaaatcccatctcaacaaaaatacaaaaaaaaagtatctgagtgtggtggcacacgtatgtaatcccagctactcggg

SEQ ID NO: 637696 - DNA, 446 bp, Homo sapiens
  misc_feature (322)..(322): n is a, c, g, or t
aaattatcatctgcttgataagatcagcctccggaaaagaaaaatttgaccacaccagaaagagttggagaagtttgcacccctctccctccaaagctgtccagaggtgcaggaggcatgccaggaggaatgctggggggatttcctggtggtggagctcctccctttggtggggcttcctcagggccccccatttaaaaggttgattaaaccaaccaagtgtagatgtagcattgttccccccctttaaaacctttgaagggcctaaatttgtagcaaattttggggcagttttaaaaagttaagctgctatagtaagttnctgggccttttccaaacttgaatatggaacatatgcccaggggaaggaaaaaaccttgccctttataaaccctgtattgtaagtggaaaaagcaatgttttaaataaaactattttaaattgga

SEQ ID NO: 637697 - DNA, 506 bp, Homo sapiens
  misc_feature (19)..(19): n is a, c, g, or t
  misc_feature (151)..(151): n is a, c, g, or t
  misc_feature (423)..(423): n is a, c, g, or t
atactacctcgcctgagcntcgtgaacatctagcaccagaaaccagtatttctcccccaaggtgagtgagccatgtcaatctgtcagcaagtccatactgtgcatgattgaggaatggagagttaaatgactttcacggttcttggccttnacaatattttattcatttgttctatcttgctggggatgcttaattcaaggttttatatggctgtcacaacatgagcttaccttggagcatgtgtcaaagcatctgggaggtgagagttgtagagaatcaacaataacctccgtactttggatgggaatgtgtgtcagagtctccatggttcgatggaagaggactcacaggactctgcatatagtcagactgatttagtacagcgagaagatgcaaagcagaatcagcaaagcgaaaaggtnctgtggcaaagctggaggaagccaggctcaagcttcctagaatcctctcccagtggagtcacacaggacactcttaattcttc

SEQ ID NO: 637698 - DNA, 935 bp, Homo sapiens
  misc_feature (34)..(34): n is a, c, g, or t
  misc_feature (113)..(113): n is a, c, g, or t
  misc_feature (116)..(116): n is a, c, g, or t
  misc_feature (124)..(124): n is a, c, g, or t
  misc_feature (233)..(233): n is a, c, g, or t
  misc_feature (235)..(236): n is a, c, g, or t
  misc_feature (260)..(260): n is a, c, g, or t
  misc_feature (272)..(273): n is a, c, g, or t
  misc_feature (281)..(281): n is a, c, g, or t
  misc_feature (301)..(301): n is a, c, g, or t
  misc_feature (331)..(331): n is a, c, g, or t
  misc_feature (376)..(376): n is a, c, g, or t
  misc_feature (397)..(397): n is a, c, g, or t
  misc_feature (422)..(422): n is a, c, g, or t
  misc_feature (425)..(425): n is a, c, g, or t
  misc_feature (430)..(430): n is a, c, g, or t
  misc_feature (435)..(435): n is a, c, g, or t
  misc_feature (439)..(440): n is a, c, g, or t
  misc_feature (445)..(445): n is a, c, g, or t
  misc_feature (451)..(451): n is a, c, g, or t
  misc_feature (456)..(456): n is a, c, g, or t
  misc_feature (468)..(468): n is a, c, g, or t
  misc_feature (477)..(477): n is a, c, g, or t
  misc_feature (481)..(481): n is a, c, g, or t
  misc_feature (491)..(491): n is a, c, g, or t
  misc_feature (501)..(501): n is a, c, g, or t
  misc_feature (507)..(507): n is a, c, g, or t
  misc_feature (523)..(524): n is a, c, g, or t
  misc_feature (542)..(543): n is a, c, g, or t
  misc_feature (550)..(552): n is a, c, g, or t
  misc_feature (570)..(570): n is a, c, g, or t
  misc_feature (573)..(574): n is a, c, g, or t
  misc_feature (578)..(579): n is a, c, g, or t
  misc_feature (582)..(582): n is a, c, g, or t
  misc_feature (584)..(584): n is a, c, g, or t
agccctttttctctcacgccatacgtgaaaactnaattctgcatggaatcagcgtcagcgacagacatccatgggggcctgtgtgcaccatcttaggtggagaaatgagcagnaanaatggatngaatggaccctgggctagatagaatctggcagtctatgtggcagaaatcagcaaaaacacgattgtaaaagcaaacaagtaattagagaaatcacgtgctgtcaggtcntnnaatcaattagaaagagatgactanccagatggaatnncagcccantcatgtgaacacgcaaaccncaaaaaataaataaaattaccaataaatanatgaaaaattataatgttgttagtagttaaaatgcgaattaaaanacatgctgttttccctaccanacaagcaaagagtaaattaaaatantancccangcttncctnncagtngcaggnaggtntggctcccaggnccttagagnttcncatcaggctncccaccccantcactnccacaccctccccccnnagtgtccccccccccacnngaacccnnnccccccccagaggaaccnganncaanngcngnatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttcaaaaaaa

SEQ ID NO: 637699 - DNA, 857 bp, Homo sapiens
  misc_feature (34)..(34): n is a, c, g, or t
  misc_feature (113)..(113): n is a, c, g, or t
  misc_feature (116)..(116): n is a, c, g, or t
  misc_feature (124)..(124): n is a, c, g, or t
  misc_feature (233)..(233): n is a, c, g, or t
  misc_feature (235)..(236): n is a, c, g, or t
  misc_feature (260)..(260): n is a, c, g, or t
  misc_feature (272)..(273): n is a, c, g, or t
  misc_feature (281)..(281): n is a, c, g, or t
  misc_feature (301)..(301): n is a, c, g, or t
  misc_feature (331)..(331): n is a, c, g, or t
  misc_feature (376)..(376): n is a, c, g, or t
  misc_feature (397)..(397): n is a, c, g, or t
  misc_feature (422)..(422): n is a, c, g, or t
  misc_feature (425)..(425): n is a, c, g, or t
  misc_feature (430)..(430): n is a, c, g, or t
  misc_feature (435)..(435): n is a, c, g, or t
  misc_feature (439)..(440): n is a, c, g, or t
  misc_feature (445)..(445): n is a, c, g, or t
  misc_feature (451)..(451): n is a, c, g, or t
  misc_feature (456)..(456): n is a, c, g, or t
  misc_feature (468)..(468): n is a, c, g, or t
  misc_feature (477)..(477): n is a, c, g, or t
  misc_feature (481)..(481): n is a, c, g, or t
  misc_feature (491)..(491): n is a, c, g, or t
  misc_feature (501)..(501): n is a, c, g, or t
  misc_feature (507)..(507): n is a, c, g, or t
  misc_feature (523)..(524): n is a, c, g, or t
  misc_feature (542)..(543): n is a, c, g, or t
  misc_feature (550)..(552): n is a, c, g, or t
  misc_feature (570)..(570): n is a, c, g, or t
  misc_feature (573)..(574): n is a, c, g, or t
  misc_feature (578)..(579): n is a, c, g, or t
  misc_feature (582)..(582): n is a, c, g, or t
  misc_feature (584)..(584): n is a, c, g, or t
  misc_feature (797)..(797): n is a, c, g, or t
  misc_feature (836)..(836): n is a, c, g, or t
agccctttttctctcacgccatacgtgaaaactnaattctgcatggaatcagcgtcagcgacagacatccatgggggcctgtgtgcaccatcttaggtggagaaatgagcagnaanaatggatngaatggaccctgggctagatagaatctggcagtctatgtggcagaaatcagcaaaaacacgattgtaaaagcaaacaagtaattagagaaatcacgtgctgtcaggtcntnnaatcaattagaaagagatgactanccagatggaatnncagcccantcatgtgaacacgcaaaccncaaaaaataaataaaattaccaataaatanatgaaaaattataatgttgttagtagttaaaatgcgaattaaaanacatgctgttttccctaccanacaagcaaagagtaaattaaaatantancccangcttncctnncagtngcaggnaggtntggctcccaggnccttagagnttcncatcaggctncccaccccantcactnccacaccctccccccnnagtgtccccccccccacnngaacccnnnccccccccagaggaaccnganncaanngcngnatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacagggagngggggaagggagggcggggggggggggggggcgcgattnggggcgggggggggggggggg

SEQ ID NO: 637700 - DNA, 450 bp, Homo sapiens
  misc_feature (158)..(158): n is a, c, g, or t
  misc_feature (169)..(169): n is a, c, g, or t
cctcccacctgagtgttcctcccggcactggaagccactggccgtccagaggaacgtgattgaattgctgtatatccatctggtggagcactgctgtgtgtctgttaaaaaagaaaccataggtttttagggatatgtaatgatatttaattttgggngaaatttttantttaaagagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttcaaaaaaa

SEQ ID NO: 637701 - DNA, 141 bp, Homo sapiens
tacaggaaccccaaacatggctttggtctctgaaatatcattatacttttaaaccaggccacataattatcaacttcatgagaacattatcatctgtggttcacgtattttagtctttacttctgaacactgacgagggag

SEQ ID NO: 637702 - DNA, 1609 bp, Homo sapiens
gctacactgcacagcgatcgatctcacgcgccacagcacatggacgggactgtggtacgtgcggcggctagctgtgtggaaactatgctgcgtctctgaacttctcagcgtcagctgccgagccttgagatgctgtctctgagtggtattaagcaattagcagaatcgaccaacgtacagtcatcgactgaccgagcgcagtggctcataagtagatggcgccccttcaagctgagagagacagacgctgtggctttgtgagagcacgatggtgaactgtccaacacttcttccgcatcacactcccatgcatgcgaaaacatagacgaaccttcgcccattgtaagacacctaagaacacatgcatgcccatatccccagagggaaatcacctgacttgcctgaatcacaccctgtaaccactaacattgcagggaccaacccataggtaaacaacgactgaaacaacacgaacaactgaccccaacaggacagaccttgaaagataagagtaccccgcacactctgcaccaccaacgcatgcaaaaacacaaacatagacaccacaacacacaaaccaccaaactacatcctccaccaacacataaaactaaagccactaaaacaaaaccacaacaaaaaataaacataacacacaaaacaaccaaaagaattagacaacctcactcaaccttgtccatacaaccacttcaatatcacactcaacaaaaatgcacccatataacacacacaatacaccacaacataacaaaacaacacacaccaccaagacccacaaaaaacaattagaaaacaccaaagcaagacacacaatctaacaaaaaacaaacaaatacctaatccaccaccaacaatacaaataacaacaaacacacaatcacaaaaaacacaaccaaaccccaaaaaaaccaatatagaaaacactacacatcaacacaccaaaacccaaacaaaacaacacaacccagaaaaatactattacacctacgatctacattcaacacatacaccgcaccacacacacacaacaataaaacaccacaaacacactaacacaaatcaaaacttcaccaccacacaaacacaacacatcaaaaaagaacaacacacacacacaacacaaacacaaccccacacgacatactcagacacaatacaccacaacataatacaaagacacacacacaacccccctatacatcacaaaaaacacaaacaacaaaaaaaaaacacaaaaaaaaataccaaacaacacgcaaaccaccacatacgcacaccacacacaacaaaccacaaaaacatcaacaaccaaacaaaaacacaacacaccctagcacaaatccaatcaaaaaaaaaaaaaaacaaataaaaacacacaaaataactaacaacacacacatcaaaactgaaacatcatcaacaacagcatcacacacaaacaacaaacaaataaaacaaacaaacccaacacacaccacccctcatcaaccactcaatatcacccacaaacataaccaaaaaacatacacatttatcctcaataaatataaaccaagacaaaacacataaaactcaaacaaccacacac

SEQ ID NO: 637703 - DNA, 123 bp, Homo sapiens
cccccagtgtatgagtcgttgttaatgaaacatgttcatcctggcatatcatgcttgcttttttagtggatatcaaagtattgcagagtgcttagaagccatcctgacatgccccactggggt

SEQ ID NO: 637704 - DNA, 308 bp, Homo sapiens
aaaaaaggctttggggggggggaaaaaggggggggttttttttttttaaaaagaaaaaaaaagggggccccccccccccggggggtttgggaaatttagccggggggtaaacttttggggggggccggggggggcccccaaattttccttggggattttcccgaaagggatttttttttgggggccacacaaggaagccccttcgggtttttggaaattcaagggccttaaaagcccctttccctttgggttgggaaaggggttaaagggggggggtggttaaaaaaaggctttttttacccttttta

SEQ ID NO: 637705 - DNA, 336 bp, Homo sapiens
ccccctacaagggtcgctgtgatgttattcgcatccttaagtccaacaacccctgcgataaccactgcctgaatgcctgaatggcgcttgagcaggtgtatgggagcgtttgtgagctctaatggatgcccagatcaaatttctgaacacttatcagaaccctgggagaaaaattgtctgcttatgtcattctgtctggagcctctgctacaagaatggtggtagagaagggtgtgccattgataaagataatgtgaaccagtgcccgcctagagcatgtgtcattgacggggccaaacacatgtgtgccatcctgaatggcatgctgttgtctta

SEQ ID NO: 637706 - DNA, 136 bp, Homo sapiens
gctacctcttcacatggaggatggggcaggtggactgttgagtcaggagtttgataccagccagcccaacacacagggcaggcgggcttggacgtaaccgcaggaaaccactcccagatgagcaggtacggcggtg

SEQ ID NO: 637707 - DNA, 501 bp, Homo sapiens
gataatgggtatgattgtggacacagctatggttaagaggtaccaagaagtagctgaaattttttacgggagattgagtgtgaatctgagaattagggaagccacaattcgatttatggatattgttggtgcgttagttggccttaccttctttgctgtgccgatgttaatcattggtatgtttgttaaaaaagacggtggtgaggttttttttaagcagaatcgtattggtctaaatggcaagcattttgtgatgtggaaaattcggtcgatggtggtcgatgcggaagaaattcgacaagagttaattgcccagagcgatgttgagggtatgtttaagatgaaggatgatccgcgtattacaccaattggcaagtttattcgtaacattcaattgatgaatccacaattttggacgtcttaaaggcgatatgtcactagttggccaagccagcattagagagagtatgacggataacgagagaaaagagcggttaagta

SEQ ID NO: 637708 - DNA, 1144 bp, Homo sapiens
ttttttttttttcagttaatatttaattttaataatactggtatatgttggaacagtcagcaatgcccaaagaaaaaatcttcagtgcatatgttttcccacccaggtgtgtgacacacttgctttaaattagcaggtggaaggaaggaggggtgaattcacgagttaacaaagctaaaaaaaaatatcctgtttttcaatttaccacacaacccttattaaacaactttttcctcttgaaatgtgccattaaatttaaccacttttaacacctccccctacccaccaaacgtggtccagcctttatccccacgtgcaaatcaccgcgagtgacgctcgagcgtggcacccaccagaaggatattttctataagagaaaaaagaaatagcacccagcctatgggcaccacccaatatcctacccaacaccccacccctctctccacccgagaacgaacaaccacgagatcccctctgtgccgtgtggcccccttggtgactccgcattaagagcccccagagagacaacaaatgccccctgtggcgacggctgtcgcgactcgcactctgtgggagagggccccaatttctgtccccccacacacacgacgaggggactcatcccaactgtgcctcctcccccaactcttattaacagatctacacctccagtgggaggtatggggctcttagacaaagacgtgtgacttttcacaaaacgccacaaaggctattaccccccttctacaacaccaccatatagacatatataaacaactacgtcagcaaaattatcacttatctccactcctacataccgccgcaacacaccaaacccccccaaagaaacatcttgacacatactaataaatcctactcacctcctaaactcccccctccgctaaccacccctttctctgcactacaccaacacaaccacgtcctaaaaccagcgagcacccgtatgcaactcacacgcgtgggtctactaccccgtccaaacaacctatcctgacggcctatcacaaaacattacttgcacagacacttttgccgcccgcaactatagcagccgcattttagagaacacaacgccaccccataagggcgcacacaacaacagaggacaccatattaggagcac

SEQ ID NO: 637709 - DNA, 144 bp, Homo sapiens
agcaagcacaccatctcaccagcacattcagccatctggcacagctcaatcctcccaagccaagcaagtgtgttcactatgcccactctcaagtgcaacagcaaatggtgcccaatcattcaccaccagccaagtcttccagct

SEQ ID NO: 637710 - DNA, 1133 bp, Homo sapiens
tcaggacacacctggaggagaagccgcacgtgtgccagttctgcatgcctgtggcttccgagatgaagggctcactggatgcggacacagtgcagactaccacacatgtgcgacgaatgccgttcaagtgctacaagtgcggcctgtggcttcgccgagcacggcacgctgaacctggcacctgctgcaccaaagggcggctgcctgcttgtgagagtgcgcaggcagttgctaggtgtctgaggacagccccgcggcagtcatctacgtcctcacgcgaagacccagccaccacagtgttggtcggagttctcgtccgtggtagctgacacccaggagtatatcatcgaggccactgcgagacgatcgcggcagaccagatgaggcccacggagatcatcgcagggcacccagacagaggtggcaccagccacatcatgaagtgtggtgacagcagatctgtgcaccaggctagacgccggcccaccagtatcatcgttgcaccaacgtcaccatggaccgaggagacggcgctaggagcccccagatggctggcatgccagaccgacacccatcacccatcaggcccaccccgagacagcctgacaagagcagcgtggcacacttgacgcttggcctcggccatcagcgcagggcacatgctgcttggccgcccagggcaggtacaaagtgccaaatgaagcagggccaactgtgaccatgatgtcaatccagagcgcactcgaacatcctgcagcatgccagcgacactggcacatagacgtgccggcagggccgacgatagactgttgtataacggtcatactgcatagacattaaagctacgcgagagaaccttgggcaaggaaaggacaagagcacgataggcgcctctcgaagacgcccagagctattgcctaggcttaggcctggcgatacaagaaacattcaaagaggcatttgcagggcccgcagtaaggaaacggtaactaccgacatcatagcggcgctgaacagaagcaattacaacaaggcaatcaacaacactagatagcagtatgaagcactcgaaagggcaaacgactagaacagagttgcacaagtggcacttacagggatatgcaagaccagta

SEQ ID NO: 637711 - DNA, 451 bp, Homo sapiens
gagttctcgtagggttcttagagctgatcttaaccgctctatcagctaaatggtcaaggggcggtaatgggttccgagagcaaatttaaagtcgaaccaagattagatgtccctcataccagcaatcaccgtggctccgtaggcaagtcgcctctacttataactatctcatctaaggtgctacatagtgagtgtgtgctagattacaagtctcagagtagctcgtagccattgaccggtaaatgagcggcatgtcccgcagaccatgtttaaagttaatgcctcatgcaggtggcatactagtagtcacgtgagacactatgtgcgctcacgatggacaatctcagccaacacgccctatgttgagtgcgacagagtgcctcaatgatggctaatactgtccatggatctatagtgtaacagagattgtaggatagatagatgaattaag

SEQ ID NO: 637712 - DNA, 110 bp, Homo sapiens
atatatgcttgctctgcagatgaaaagtacagatctatatacccaactacttactcaccccgaatatataagtcggtcttacatgaaaatacacagggtagcaagtaaca

SEQ ID NO: 637713 - DNA, 578 bp, Homo sapiens
tgggagacgggggtctcattcaaagagaaatacaaataaagcaacgctgagattctggtttctttccaaccatcagacgggcacagctccaaaaattggataccatattctacgggcaaatttggtggaaaagaaggtgctcttctccagggccagagggcatgtgaactgcaacagcccctctgaagggcaattgggcaagatctgtcaaaatcatagatgccggcaggggggccctagcatggcctcctcgggtaactaaatctcacagatacatctgggggagtgtgaggtgactaggggaaaagtcgattggcgcagcaacacgggggacagcgagggcaggaagaaccaaaaggccctccaatagggacagggtcaaatatgtaagggtccgtccacatgagggagggcggggaagacactctcttatatatctgtatcgcggtgggcagggagagtctaaaaaatactctgaaatgggccaggcgtggcggctcatgcttgttatcccaacattttaggagacaaaggggggaggtctggttgaggacaggagtttgaaaccattctgtgca

SEQ ID NO: 637714 - DNA, 139 bp, Homo sapiens
cttcacgccgttcctctgggctcccgactcagtggcagctcactgagggcttcactgcatggcagtcctgcctagagccctgtggcccctctccatccggtgcttgccgtgatacgggagctcggtgttgtcgcggtag

SEQ ID NO: 637715 - DNA, 115 bp, Homo sapiens
  misc_feature (88)..(88): n is a, c, g, or t
ggtagcatatgcttgtctcaagagttaagccacatgcatgttctatagtacgcacgaccgagatacagttgaaaacttgtcgaatttngctcattaaattcagttatgggttgcc

SEQ ID NO: 637716 - DNA, 184 bp, Homo sapiens
taaacctcatctgtcccagaacatcatctactgacctgtggtgcctactaactcgccgaggccctgcctttcgctcgctgcgtccctgctcaggctaagcttgtacaataactgcatctgcgacgtgggagccgagagcttggctcgtgtgcttccggacatggtgtccctccgggtgatagga

SEQ ID NO: 637717 - DNA, 301 bp, Homo sapiens
tgcccagccatgcttcatccaagagcccagggtacccccatgagggccctggcttccctgcccctcatcactgaccccagggtctctcctctcccaaaccggacaactgagtgcagcaggccaggcctaggagggccttcaagccggccaaggggcacgcggcagtcaggctacacacacccacccacagcctgggtagcagggcgcgcccgtttccctcctcagtggaaagggaccagacccgagggccagccccagcccagtcagcagccccctcggaggcaggcatgcaggcggccgc

SEQ ID NO: 637718 - DNA, 125 bp, Homo sapiens
gtataagagtcagctcccccaagatagagctagcagcccccagagagagctctagcacgtcaccaagtaaccaggcccagcctccaggccccaaactccgcccagccctactccccgctctagga

SEQ ID NO: 637719 - DNA, 418 bp, Homo sapiens
tcgctatcatcggcacctaattagcgaggcgtgctgacgcagtgagaaacacaacttcagagtgtaagggtatggaccatttgggtttttcatctgcgtaatggttcaggaacgcccacagtctaccagggcatcgctcttggattcccactccagcagtccataggagctgcgctcacttctgcctgagaatactttcacagaagatggccgcttctctcccagctcatcgcagatctcagagaagttctcctcggtctcctccagcgcggcgttgaacacgtgccgcccgttgcgcgggtgctggatgcggttcttggctgcctgctctgtggtggcgacccgatcgttccgggattcactgacctctttgttcctgccctacccgtcttccatccctgtatcatcgaccgggcat

SEQ ID NO: 637720 - DNA, 569 bp, Homo sapiens
  misc_feature (17)..(17): n is a, c, g, or t
  misc_feature (195)..(197): n is a, c, g, or t
  misc_feature (249)..(249): n is a, c, g, or t
  misc_feature (295)..(295): n is a, c, g, or t
  misc_feature (329)..(329): n is a, c, g, or t
  misc_feature (382)..(382): n is a, c, g, or t
  misc_feature (411)..(411): n is a, c, g, or t
  misc_feature (532)..(532): n is a, c, g, or t
  misc_feature (540)..(540): n is a, c, g, or t
tgtgggggggggggggntcttctttttcctcttttttaaaaaaaaaaccccctctgcgcggttgtttttttttttccccctggggggggggggcccccccccgggggggggggggggtttttcttttatctacccccccccttcttttcttttttttttcgcgcgcccccgccgacaataaaagggagggtggtnnnttcttgtctcccccccctttctcttttttttttggcgcgccccccaccaaanaatttaatttttttttttttttttggggtgggtgaagaaaacaaanaaaccccgcccccgccgccccccgcgtgcggggncgggtgtgtttttttttttttttctttccccccctcccatttttcttcttttntttttaagggggggggggggcggcggccnccgcccccgctatgaatttacttgttgggcgggggtcgggctgtctgtttttttattttatataattacgtctgtccccccccctccccccccctctttgtttttgttttgtgtttgtttngtgcgtgntttttactcgacccccccccccttccggg

SEQ ID NO: 637721 - DNA, 174 bp, Homo sapiens
tggctggctgcacattttcagacaaatgtcagtcgtgagtaggacaacttgttcagtgaggaaaaaacattcagacaaatgttcagtgaggaaaaaaaaggggaagttggggataggcagatgttgacttgatggagttaagtgtgatctatggggcgagatacattcttatag

SEQ ID NO: 637722 - DNA, 240 bp, Homo sapiens
ggcctttattaaggaaacactttaatcttgagttggggacaaccctggtccggctattgttaaacccatgaactctacgtaaaaaatacagaagattagaccagatgtggtggtgtgcgcctgtagatcccagctactcgtggtggctgaggcactagaatcacttgagcctaggaggcagaggtggcagtgagccgagatcacaccactgcactgcagcctgggacgacaagcactgtc

SEQ ID NO: 637723 - DNA, 369 bp, Homo sapiens
  misc_feature (206)..(206): n is a, c, g, or t
ccctttttttgggggggggggcccccccccaaaaatttttttgggttggcccagggcctttttttaggggccggggcccccccttggggttttgccccccgtttaactttttccggaaatttttgggggggggccccgccctttttaaaacccgggttttttttccccccaaaaaaaccattttttttggggggtttggggccggnagagggggccccttaaaattttttaaaacttttgggggggggggcgccaaaaaggggtgggtttccaaaaaaccccccccttttccccctttttttttgtccctttttttttttcccccccccccccccttttttttttaaaaaaaaagccttgggggtgtta

SEQ ID NO: 637724 - DNA, 976 bp, Homo sapiens
gctccaccccctcgcgtttgtcctgggaagggtttggcggggggccggccctccggccctctgctgcccgagggttcctcgcaggctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcaccccaatcccttgcagcaggcacatgggggggtgagtcagccctggaaaaagctgccacatgaggaggcgtggaggccactccactggcagttcaagggagaggggggggc

SEQ ID NO: 637725 - DNA, 758 bp, Homo sapiens
tggtggtagccatgtgcaccttgcattggcgattaagtacctccctttaacccctgccaccccaggatccaactacccccatgcacttaggtttccctactcagtggctgcagttcccactgtaagttccagcctacagacaagagcacttggacatcttcaaggatgctcgggctccccttaaaaatttgtttctcacatggtgacaggtgtgtcctctggaccctcccagagtagatgaacaggtatcacaagataaatcccctccaacagtacaattctttggataccttcctctgcagagtacccaggcagttctggcatttcaacttcatttagtgtaggccaccttttggtccatgtttagccaaccagccaaccaatactgttagagccctttctaacccctccagcagcaatatcaaattcagaatctctgcttagtgggcccataccaatcaattcagcctgatccaacttttgtgtcttccacgctttatcatacacccttgatatccatatcaatgtatagtctttagattggtctgaataattaaactgaatcgtgcgttctttggtgtacacacatctcatgggtcattctttgtactcacttttgggagctgctttgattaagtcagtatatgtctaaaggaaagaaggggggaggcatagggcttagggaaggcgggccggagggaagtgctccggagccggggggctcgggaagggggtacttccaaggggaagggggccag

SEQ ID NO: 637726 - DNA, 810 bp, Homo sapiens
gccgggcggaggcctgtaccgcgggctgctgacctctccccacagccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcaccccaatcccttgcagcaggcacatgggggggtgagtcagccctggaaaaagctgccacatgaggaggcgtggaggccactccactggcagttcaagggagaggggggggc

SEQ ID NO: 637727 - DNA, 613 bp, Homo sapiens
ctatgtaaccaagacacagatattcagaaaaggacgtctcttcaataagtgtgctgggagaacggatatccatgtgcagaaaaataaaactggaaccctatctctcactacatacgtaaagcaaatcaaaatggattacagacttatatctaagacctcaaattatgaaactactaaaagaaaacattgagaaactctccaggatgtagggctgggcaaatatttcttgagtagtaccccaaaagcacaggcaaccagggcaaaaatggacaaatgtgatcacatcaaattgaaaagctttggcacagggcaggaaacaatcagcagagtgaagagacagcccacagagggggagaaaatattggcaaggtatccagggacaaaggattaataaccagaatatataatatcaatggtcatcagaaaaaatgcacattgaactacagtgggctattaccttaccccagttaaaatggcttttatccaagacaggcaatagcgaatgttggcgaggatgtgcagaaaggggagcccttgaaaactgtaggtgggaattagtacaaccactataaagaacggtttgcaaggtcctcaggaaactataattaagagc

SEQ ID NO: 637728 - DNA, 234 bp, Homo sapiens
gaatatctacatttccacctggtggataccaaggctataatatggcaagacaatgaaaatttatcacatcaccggggcatatgctaaaacaagggataatttacaaacaagtcttttaaatcaagaacattatgtaaaatacacactctggtaaacattctgagttcatccatcctaaaatttagaccttaggaggcaaaaaaagaaaaaaacattctcaaatagtttaaccac

SEQ ID NO: 637729 - DNA, 2210 bp, Homo sapiens
tttctatagagacacttcctgtggcagagaaaagaggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcaccccaatcccttgcagcaggcacatgggggggtgagtcagccctggaaaaagctgccacatgaggaggcgtggaggccactccactggcagttcaagggagaggggggggc

SEQ ID NO: 637730 - DNA, 289 bp, Homo sapiens
tgccacaccaatgtcaagcccatgccataccttgtcaagacttgtcaaagtggttgtggttagtgtcacaattggttatgtttctgatggttaggaagacgcaggtcagccctcagatcacctgtcccgggacagctgaccccctagaagcctggctctgcccatttagtagtggatcctacatactctgcccacatttgggtctgttctctcccattaacacataggttttgtctcgatgcatgcaggagtttctccttaaaaaatactgttgtacgaaaaaatgaag

SEQ ID NO: 637731 - DNA, 2057 bp, Homo sapiens
cagagtggggtcctctgtcagcttcctcatctagccttcctgcagcaccctcttcctcttctcccagctgggaacttttcttccttctccctgtccttgtctctgcctctcattttctctccctgtcttcagatcggtctggctccgtctgtctgtctggccctgtctgtctggcttggtctcttggccctgtctctgtacccaatctttttgatcacatcccccagttcggtctctgtgtctctgagtctctgcctgcctccccctccttcccctcccaggagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcaccccaatcccttgcagcaggcacatgggggggtgagtcagccctggaaaaagctgccacatgaggaggcgtggaggccactccactggcagttcaagggagaggggggggc

SEQ ID NO: 637732 - DNA, 403 bp, Homo sapiens
  misc_feature (9)..(9): n is a, c, g, or t
  misc_feature (47)..(47): n is a, c, g, or t
  misc_feature (52)..(52): n is a, c, g, or t
  misc_feature (395)..(395): n is a, c, g, or t
  misc_feature (397)..(399): n is a, c, g, or t
aactccctnacccccagtatttgaaaggcctgggaaattccatcaanacccnattccagggactgttcaaaacgtcattttcctgagacgctttaccctaataatccttctgtaaaaaatatccttcttgggctgaatgccaggtgcacgccagtaacccctacactttgggaggctgaggcaggaggattccttgaggcccaggaattggagaccagtctgggcaacataatgagaccctgtctctacaaacaataaaaaagttagctggcatggtggtatgcctgtagtcccatttactcgggatgctgaatccagaggattggttgagcctgggaggtcaaggctgcagtgagctatgactgcaactcttgcctgggcaagagagtgagacntnnntctt

SEQ ID NO: 637733 - DNA, 1396 bp, Homo sapiens
tttctatagagacacttcctgtggcagagaaaagaggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacaggtgggaacgtgacctggctccaactctaacctccttcctgatcctgaccccaactccatttctgtctctgctcagtcatggctccaaccccaattcaagttctaaacccaactccaaagcaccctcagcaccaactttcactcactcagacatcc

SEQ ID NO: 637734 - DNA, 2495 bp, Homo sapiens
tttctatagagacacttcctgtggcagagaaaagaggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggtacatggtggatgagctggggatcagaaagactagggcagtggggttggggaccattcagggtggcatcagagagccttgagctaaggcagggggctgggtgccactgggcgtggaacaggaaggatgggggttggggggtcaaaggggctggaacatgggggccgcaggccattggtgctggggccaggtaggcagtggccacagtaaggcagtgggactatcgtgggctggcatataggcaggtctgctggggggacccctcatgctgtggcttgcctccaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcaccccaatcccttgcagcaggcacatgggggggtgagtcagccctggaaaaagctgccacatgaggaggcgtggaggccactccactggcagttcaagggagaggggggggc

SEQ ID NO: 637735 - DNA, 750 bp, Homo sapiens
cccaggtcagcgccttacgaccaacgcttgcagttgctcagccagagacccaaaggacgtgcgacgtgcaggcgagcagctgtttgaccactggcccactcagacgctggagccacaatcgcagcgtgtccagtgagaaaagcagacgagaggccgcttcaggccagcggagtgtcccgatgcttctcccaactatcattctctgtgaggaattcaccccaaaatgggccccatttatcccattagacagttgtcaccacccaacattccgcacaggttgtcgcaccctaatggagcgaagtcatcacccaacgggcagcagaagttgtaacgcttccccaacccgcccttttaacgccaaaaatctccgtgcgccaataggatcctcatattccccgcctgttggcaagagtggggggcacagatcccccagaaagcattgctcccctattggccaacaacgcgaggatcgcattgccactacaaaacagactttcgtactgttccacaacgcggacatacgttccaacacgcacatttacacacacattaggagcccacccacctaaacggcgagcaaccactgttggacccagaacattagaggaggaactagcacaccaaatcccatatatacaaaggagacagcgacacccgcatgagcatagcagggctagagaccatggcgaagagctattcaggcgacgcaccaaaacatatagaggacaggatgactgtctaacacgcacg

SEQ ID NO: 637736 - DNA, 2095 bp, Homo sapiens
tttctatagagacacttcctgtggcagagaaaagaggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcaccccaatcccttgcagcaggcacatgggggggtgagtcagccctggaaaaagctgccacatgaggaggcgtggaggccactccactggcagttcaagggagaggggggggc

SEQ ID NO: 637737 - DNA, 364 bp, Homo sapiens
tagtcatgtaacacaagcggagacaggacagcatgagagaagcatgtgagaggtcgaagccaagatagccatcccagaaatcaagaggccccaatgggttctaacttgtttctcgcagtctgaagaggcagccatgaaaactccaagcgccccttggcataagacggagatgccccagactctccacgtccagaaactaggtagggatctggctcactggggaggggcaagagacgagacataataaggacttcaggtgagcccaaaggggctgagggaacagacccagctaactgaacaccctgcggaatgagactcctatgagaagtggggagcacggggccttcaggactccgatagacta

SEQ ID NO: 637738 - DNA, 1626 bp, Homo sapiens
ggccagccccaaggacccggcctgggtgcaggcagcccagcgcccccaccccagccccggctcacctgttccggggtcgccccgcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcaccccaatcccttgcagcaggcacatgggggggtgagtcagccctggaaaaagctgccacatgaggaggcgtggaggccactccactggcagttcaagggagaggggggggc

SEQ ID NO: 637739 - DNA, 193 bp, Homo sapiens
  misc_feature (128)..(128): n is a, c, g, or t
caagcagttaatacatgactcaattttaaaaaattattactctgtggctgactcttaattcctatttcaatatgtgtttccgttgaagaatccaggatacaacttctgtgtgtatagacagctttccnttcacacactaattttggtggggtgtgtatattatctgattgagggaagaatttgagaaaacaca

SEQ ID NO: 637740 - DNA, 1514 bp, Homo sapiens
ggccagccccaaggacccggcctgggtgcaggcagcccagcgcccccaccccagccccggctcacctgttccggggtcgccccgcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcaccccaatcccttgcagcaggcacatgggggggtgagtcagccctggaaaaagctgccacatgaggaggcgtggaggccactccactggcagttcaagggagaggggggggc

SEQ ID NO: 637741 - DNA, 1580 bp, Homo sapiens
cacgaggagtttggttaaatttggggagtgcccccttcctcctacgtggcccacagtctgtaagtctgtgaaaattgaaacccaggtcccagtgaccaccacactcccctgggtggttcgggtcttgggctagacctcagacgtttggaaatctccaacggtggtgtcgctcccagggatttacacctgggcccctgcaggatggctccaaacaaggcccaccagtggggaacaggcttccgcagaggatgggtgagggcggggggctgttcgcgttcatcgctccctcttcactagagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcaccccaatcccttgcagcaggcacatgggggggtgagtcagccctggaaaaagctgccacatgaggaggcgtggaggccactccactggcagttcaagggagaggggggggc

SEQ ID NO: 637742 - DNA, 137 bp, Homo sapiens
gaaatcactacttaaaggatagcttctcattgcctgtaccacactacacttaaaatttgtatgggttaacaagtatgtgattctatccagtaagacgatacttttctataacagttagatacaagataaagaacaat

SEQ ID NO: 637743 - DNA, 626 bp, Homo sapiens
gaggatcagctgtcaagtgctgtgcgtccgactctcgcaatacagtagatcatggtcagttcatctttcctgatatgaaaccagcgcatcggcggcgatgcgcagcggcgccagcagccgatacagcgcaaccaaggtcagcgcggtgccggccagcgtggccagcaatgccacgatcaccaccgaccacagcgggcgcccgtccagttcgctctgcgatgccaaccaggcgatcaacaacagcaacggcagatggatgcccaggaaggtcaccgccagcagtttggcgctgaaggagcggggaaacacgcgcgagagcccggcgtacaagcgcatccaacactccggcaaaagagcgcttagtgtcgccgagagcgtgtggagccaacgcgacggaagtctcagacctcgctggttgtacccatgtgcggcaccggttcgcctcaacaagcgatcccgtgcacgcggtgggcgagcgccagcgcacgctaagcgcgccgacaccagccggctcaaacgccctgcttagatcttgtagccggagtggatcgccacgatgccgccggtgatgttcttgaaggtggcacgcgcaaacccgggcttgccatcatgtccttgagcgattc

SEQ ID NO: 637744 - DNA, 1261 bp, Homo sapiens
cctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgcaaaaaaaaaa

SEQ ID NO: 637745 - DNA, 832 bp, Homo sapiens
gttgctccttcggtactccccatcagaactgagacatctgtgaacgaactgtggtgatgccaacaacctcatgttcatccccagtgtggggcctggctacatagacaccagcatgcggccctggaacaaccacaatacgcgcaagagggtcaatggcaagtactatgagacgggcctgcaaggcgtgcctgacagtgatggccgcgagatcgtttccattacctccttcaatgagtggcacggagggcacccagattgagaaggttcattcccaagaagagacgcaccgactgtattgggactacctggctcaccgagctccagcgctgtagcctggagctgacactggccgctgggctggggcacttcaatcgagacaggagaacggagcagttggctcatgatgaggggccgtgtaacatgggccgtgaggtgcctgaatgtcctctgaccgtaggcgtggaagatgtacaacatgtggcggctccagcatgaggtattgtacgaccaatcagtcgtccccaggctcagaggtcagcagatgggtgtttctgggtgggccgtcaggcatgggcctgtgcaaacacagagcccgttcctcgaggcgagtggctgctgaggttgctctgctggtgatgggaacggtcagaggcgtggcgaggttgactagaagcgttagccccagggcagctcccagatcctgaggaacactttcatgtaaccccttctagtttggaagtctgacagcaggctggtgcagtgtagtggcctacccagtcagcgaaccttgggaagggtgtccgggtctgggctctgcatgaaccctgttccc

SEQ ID NO: 637746 - DNA, 231 bp, Homo sapiens
gggggggggcccccaaaatttttttttggggggggggttcctaaaacccccaaaaaaaatccctttggggggtttattgggggggtcccccccccccctttccccccaaagggggggggggggtttttcccccccctttcccccccccccaaggaaccccgggggggggggcccctttcccccgggggggggggccttttttaaaaaaaaaaaaaaaaattttttttttta

SEQ ID NO: 637747 - DNA, 166 bp, Homo sapiens
cccggttatgtcttacggcagctaggaatatgcaataggaccgcggttctatatatgttggcttttcggaactgaggccataattacacagggacggccgcgggtgcattcgtacttgcgccgcctagagcctgaacattcttgagaccgggcgcacagactggac

SEQ ID NO: 637748 - DNA, 394 bp, Homo sapiens
aggtaagcactcaacaaaatcgtttttcccagtaaccctaacaagaaagaagaaactttataggaataattggaatagcaggcatagtatttaaaaatggtaagcatttctaggccgggtgcagtggctcacacctgtaatcccagcattttgggaggccgaggcagaccaatcacttgagctcatgagttcaagaccagtttgggcaacatggtgaaaccctgtctctactaaaaatacaaaaatcagccaggcgtggcggcgggtgcctgtaatcccagctacttaggaggctgaggcaggagaatcacttgaaccagggaggcagaggttgcagtgagccaagatcatgccactgcactccagcctgggtgatagagcaagactccgtctc

SEQ ID NO: 637749 - DNA, 618 bp, Homo sapiens
gtgtacacagagaccagttctctaccctatgctgcaattactaatctaacttactgtctctatggacttgcctattctggtcctttcttataaagtggaacgacgcaacatgcagcccatgttttctggctgctttcactgagcataatattttcaagattcacccatgttgtaacacatatcagtgcttcattcctttttatggctgaataatactccattgcatggacagaccatatttgtgttatctgttcatcactgacagacatttgggtttgttccattttttggctgtcatgaataatgctgtcagcatgtatgtatgtacgcggtttccttagtttttatctaatgtcattttcctgttccaggatccccttcaagataccacattatgtttagctgtcatgtttctaggctcccttggctgtgacatttctcaggttttcattgtttttactgaccttgacagttttgagttctggtcaagtatttcatgaaaactccctcaattatggtttatctgatgttttcctcatgattaagctgggttatgtatttctgggaggaagaccagagaggtaaagtgccaccgtcatcacatcatgtcaggagtac

SEQ ID NO: 637750 - DNA, 226 bp, Homo sapiens
cacaatgcgcctgtagctcatcattagctattccaatatggatcgctgctagtccacacattactgctactattagtatagaatgaataattcacttcctctagtcccagttgccagcgctttcaggtgctctattggccacatgtggcccagtggtcttcatattggagaacacagattaaatacattttcatcacagtataaaattctttttttttagagactg

SEQ ID NO: 637751 - DNA, 171 bp, Homo sapiens
ctccgtctgcggtgtgtgggtggaagatggtaggatggagatctgaccacggcttggggtgtctccagtgttcgccattccagatttcactttgcgtcctccgaggggactctggggcagccaccatggtccggcttgtctggcaggcccttggcagatctaggtattggg

SEQ ID NO: 637752 - DNA, 293 bp, Homo sapiens
ctagaggacccgtgatgtatcgccaacaaagaaagcagtcacatgaatgttttggttcccaatgcatataaaagtatgtttacactatactgtagaccagcaagagtgcaatagcattgtctaataaaacaatatacatacctaaatttaaaaatactttattgctaaaaaatgctgattatcaatctgagccttcggcgagtcgtactctttttgctggtggagggtcttgcctcgaggttgatggttgctgactggtcagggtggtggctgctgagtgttggggataacat

SEQ ID NO: 637753 - DNA, 1261 bp, Homo sapiens
  misc_feature (535)..(535): n is a, c, g, or t
gcctgggtctgacagcgagcagcctgtgggcaccgacggccgatatcttggacgcgcggcagagcgggtcgttgtccgcgccgcccgtgcctctcgctccagtgggcctcctgttcggacccggattcgccggcgctcgctctgcccgtcctattgctgcgcctcaaccgcgccgttgatgcgtgcttgagctacgtggcaggtcgatcgcctggttcttggccgctggattttcccggcgcggctgacccagcgtcgcttacatgttcggagaactgccctgggcttccagcatggttggaggagcagtttgcgggcggagaccgtgcccgggcttttgcccgggagcttcgccgcccaccgcaatgaagtcgggggctctgtcagtggcctggcttgaagcggacgactgcggtcagtaggtgctggaggtctacacgtcatgagctctctcccggtagaattgcccttctccagagtgagtatccagcgactgcgcatattactggtgtcgaggacaccaatgtagtacggnctttacctggggagccccgacgttgctgccagcaccgagatcagcgttgtagctcacctgtgccctgttggttcttgagttcttacctaacgagcctaggctgtggcgcgcttgctgctaggtctctggattgcccatttccgtgtgggcatgactctcttgggccgaaagcatagtcgtctccatggtagcagaacattgacgttctgggcgctgattggcttgcgttggagagccgtacacgatcgtcactgtcacttggcattgcgacttgctccacttgaatggccaaacttgtgtgcccttcagggcaggccgtgtggccctcgtgaagacttagaccagtggatttttcgtgcaccaaagcgtctccaatgttggcccctggggaggcgctttcacctgtggcaacttgtgcccacacctgtgtgacccgtggtcaaggtctcgttctcgaaccccttttgcctccacaagggcgggcgtcgttgtgcgccgccttagggcgcagaggttcgccccacaggcacagtagccacactgggtctgtcggcccgcactagcaggccggaacacccaggcgcactgctgtcttgcagcgctccgcctgcccagcagtcagttgagtcctttggtcagctaggggtggcctcccaccgctgttaagactcaggcacagcttgtgtgcgtccgagcgcggcgctgcctaccacccagccgactggc

SEQ ID NO: 637754 - DNA, 494 bp, Homo sapiens
  misc_feature (15)..(15): n is a, c, g, or t
  misc_feature (75)..(75): n is a, c, g, or t
  misc_feature (136)..(136): n is a, c, g, or t
  misc_feature (145)..(145): n is a, c, g, or t
  misc_feature (226)..(226): n is a, c, g, or t
  misc_feature (235)..(235): n is a, c, g, or t
  misc_feature (237)..(239): n is a, c, g, or t
  misc_feature (248)..(248): n is a, c, g, or t
  misc_feature (268)..(268): n is a, c, g, or t
  misc_feature (283)..(283): n is a, c, g, or t
  misc_feature (288)..(288): n is a, c, g, or t
  misc_feature (335)..(335): n is a, c, g, or t
  misc_feature (369)..(369): n is a, c, g, or t
  misc_feature (383)..(383): n is a, c, g, or t
  misc_feature (431)..(431): n is a, c, g, or t
  misc_feature (433)..(433): n is a, c, g, or t
  misc_feature (493)..(493): n is a, c, g, or t
ggggccccccggagnggccggcccaaccccatccagctgggcgaggacacgggcggaagggcaggccaccaaganggggaactgcacatgcacgggagggaaacgggggcccgccgggaggcgaagcaggacggangaggagccngaaaccaggggcaggaatgcacaggccagggcgggtactagaagcatatcggggattaaacagcaggccttgagtcacagnacgggcagngnnntttttctgnggcacactgcaaagggaaanttcgggataccaccnagggnaccaacgggaggccaaggtggggcagagggagacacacgcagagccngcagcaaagcgtcgagggggtgcctcagcagggnggagggcggcgtcncctcaaacgggagggccatcaccaccttcagggacttcggcaggggcncngagggcctgagccagggaccgcagggcccacgaagggccccggcttatcaacaaacttcng

SEQ ID NO: 637755 - DNA, 314 bp, Homo sapiens
gataattagtagcatactgtatatatcaaagtatgatgaaaagcaatagatatatattcttttatatatgtaaataatgatatgcatggtataatcggcaaaatgtggagtgtatgttcttttcacagtaatatatgcctttagtaacttcactaggttattttattgtaaatgagtacaaaattcttaatttaagagattgtatgtcagtatatatttcattaatttctttccctgtttacgtaaattttcaaagtggccgtaggaaccagtttgtgggttaaggattttagtgtagtggcttgtacccaaga

SEQ ID NO: 637756 - DNA, 106 bp, Homo sapiens
atcggactccgtctctgccaccgtgtctccagccccgctttcatgctcagctgggactgcagctcaatctccaggccttggagcgtgcgcctgagctccgtgatct

SEQ ID NO: 637757 - DNA, 204 bp, Homo sapiens
ggggttcccaaaaggggggggggccccccccccggccccttttttggccctgggggccgggggaacccgttttgcccccccccccctggggtttttttcctttcccccgggggggcccccctttccccccccccggccccccgtttttcccccattttcgctcggtgcccccaaccccaacatcattaccgggttttcctctta

SEQ ID NO: 637758 - DNA, 168 bp, Homo sapiens
  misc_feature (26)..(26): n is a, c, g, or t
  misc_feature (51)..(51): n is a, c, g, or t
  misc_feature (100)..(100): n is a, c, g, or t
  misc_feature (117)..(117): n is a, c, g, or t
  misc_feature (123)..(123): n is a, c, g, or t
atcccttcctgatttttttcattttnacttggggcccccttcctaggactntccccccccaaactccaacctgtatcaaatgcagcccccaagcccttanactttaagcccagttancaaggngccgggtccccctgcaggttcccataaaaacgatttgcagccaga

SEQ ID NO: 637759 - DNA, 159 bp, Homo sapiens
gctcttacattagccacgcaagtgaccaagccacacgtactaaaggttgaactcaaagatatgtacacggctatcaaacaaataccacggggaacagctcaactatcaatacacaggtcaaacatcagacaacaagcttctacaactccagatgctgac

SEQ ID NO: 637760 - DNA, 199 bp, Homo sapiens
tcgtgacccaatgagctcagaaccttgttctcccagaccaaggttgctggaggcatgtcccagacctctctcttctatctgggcactgaaaaaaccaaggtgaagatggttggaaagtctccgatggggaggggagcagcatttttttacggggaaagggtgtctccctcttgtcccccgggctacattgcctggggtc

SEQ ID NO: 637761 - DNA, 473 bp, Homo sapiens
cgtggtggtgggtgcctgtagtcccagctactcaggaggctgaggcaggagaacggtgtgaacccgagaggcggagcttgcagtgagcagagatcacaccactgcactccagcctgggcaacagagcgagagtctgtctcaaaaaaaaaaaaaaaaaaaaaaaaaaaaaatttttgtggggcgggctttgggccttaagaaaaggttttataaaacatttggttgggggggggggcccagtgttggtaacggggacacgtgggcaaaaggggggtcccaaagaaaaacccggggaaaggagaaaaggggcggtgggttcccacaccatattaaaagacggccggggggcgaaccgcggggcgttctgtgaaacacatcccagagaggggaggtcgggggggcacaaacgaggggatctcacaaccggggggccaaggggagtccagaactaaaattaccggaacgggggcaac

SEQ ID NO: 637762 - DNA, 240 bp, Homo sapiens
gggggtttctttttttaaaaaaatatttccacgggtttcttggggactcgtctaaacactttcatcgaaactagaagactgaattatgaggaaactattgggattaggggccagaaacgagtgaactcttatagatctttggacagtttctcggtattagggggagcctagacggatatcaagtttcttcatatcaaagctctcgtggggtgacctcattggctttacaagttgaccagc

SEQ ID NO: 637763 - DNA, 983 bp, Homo sapiens
tctgggtgaggctgaggtagctgctgagctagggcccactggctgcctcactggaggcagcagagcagcctggatgagctgcactgggccccagagctaggagtctttgcagactttgtggaaccacacaaaagcatgtacatgctgaagcccagtgccccctcagtgggctacgttctgtgtgtggtgggtctggccccaacctcaactgcagtatgtagatgctcttgtgctatgtacagtctttttccctatgcttgctgcgactagctggaccccacctacatccctgccttagggcccctgctaggtacatatctaagcctgagatgcctgccatctactgtgagccccgtttgtgtttactgctcccttgcttgcctccatgctccttttatgtgctcagctgcacattcagatgccatgatcctctctcctactggctggggtgctgtgtggctcaactgtcaactacctggctttgtgtgagacttccatcactattgggcatctggccggtgtcctcaccagtgctctgtggcttgccagtatctcctacggctgacgctccgttgccttctgttggtatggccatgtattggctgccagtaccatggctacagcgcttctctttgtggccgcagtactcggtgatcctgtcactggcgcgacgccccttgcgcttgccggcgccttttcccccggccctggacccacgccctcgccatcaccctgcccccattgtcctcgcacgactacctggctcgtcccgtcaccgccacgcgcagtccatctccccttccttgccagctcatgggctcttggcagcggacatcacgcgctcctaggcgcatccggctcccatgtccctttggactccgcgctgatttacggcgattcttcgcttcctctacgcgtggctccctgctgtcattccgctactttcccttggcggaccgcgctcccgtcgctacttctcctgg

SEQ ID NO: 637764 - DNA, 1478 bp, Homo sapiens
  misc_feature (132)..(132): n is a, c, g, or t
  misc_feature (846)..(846): n is a, c, g, or t
  misc_feature (866)..(866): n is a, c, g, or t
  misc_feature (870)..(870): n is a, c, g, or t
  misc_feature (885)..(885): n is a, c, g, or t
  misc_feature (888)..(888): n is a, c, g, or t
  misc_feature (915)..(915): n is a, c, g, or t
aagaccagcacaagccatgtttccatatccaagacaacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgcccctacaaccagcacaatccctgcttctacacccagcacaacctctgcccctacaaccagcacaacctctgctcctacaaccagcatatcctctgcccctacaagcagcacaacctcggctcctacaagcagcacaatctctgctcgtacaaccagcataatctctgcccctacaaccagcacaacctctttccctacaaccagcacaacctctgctactacaaccagcacaacctctgcccctacaagcagcacaacctccactccacagaccagcaaaacctcagctgtcctacaaccagcacaacctctggtnctggaactactcccagcccngttnccaccaccagcacanccnctgtttcaaagaccagcacaagccatntttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctccacatctgtgacagctcctagcacccctagtgggagagccaccagcccaactcagagcacctcctcttggcagaaatccaggacaaccactttggtgacaagcagcataacctccactacacagaccagcacaacctctgcccctacaagtagcacaacccagcttcaatacccagcacatccgactggcccg

SEQ ID NO: 637765 - DNA, 149 bp, Homo sapiens
ttttttccccccggatttttttttgggggcttcccaaaattgggggttttggctttttttaaacccccccccgggctttttttaatttttttaaaaaaaaaaaaatttggggggggggttaaaatttaaaagttccttttcccctttta

SEQ ID NO: 637766 - DNA, 9400 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
  misc_feature (5765)..(5765): n is a, c, g, or t
  misc_feature (5785)..(5785): n is a, c, g, or t
  misc_feature (5789)..(5789): n is a, c, g, or t
  misc_feature (5804)..(5804): n is a, c, g, or t
  misc_feature (5807)..(5807): n is a, c, g, or t
  misc_feature (5834)..(5834): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgctcctacaaccagcacaacctctggtnctggaactactcccagcccngttnccaccaccagcacanccnctgtttcaaagaccagcacaagccatntttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgagcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacaaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacaccgcctgctccgtgcctgccatcacccatctgccacctgattctgagcaaggtctttgagccgtgccacactgtgatccccccactgctgttctatgagggctgcgtctttgaccggtgccacatgacggacctggatgtggtgtgctccagcctggagctgtacgcggcactctgcgcgtcccacgacatctgcatcgattggagaggccggaccggccacatgtgcccattcacctgcccagccgacaaggtgtaccagccctgcggcccgagcaacccctcctactgctacgggaatgacagcgccagcctcggggctctccgggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccctggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgctgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcgctgccctgcgccgggcgacacccagcactcggaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctgtccaggcggctgcagctttgaacacactgtccacgcccgctttcttgtggagggtgtgggctatgggtcacctgctgcctggaggaggggcccttacccaccccgcctgcagccacctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacacggccaatctgttgcataaatacacttgagcattttgca

SEQ ID NO: 637767 - DNA, 178 bp, Homo sapiens
gatccttaggtgcttgtgggtacggtgacataggttatcaacaccagtgagacctctgtgggctagactgatgacacaccaagtgagtctttgtggtcgtcgaaattcagagcaaagagcttttgccacggagaggcacccacaggtaaataattggcatcccatcaggcttggtttc

SEQ ID NO: 637768 - DNA, 277 bp, Homo sapiens
tctgcgtgcttccagcgtacttgggttcagccacaatatctgggctcagatggccttgttgataagccagaacagagtcggcacgatactgagagttcgcagggtccttcagtttacctgtgactgtgctttcgggacctgagtgggattgaagtccatggcgtacaggtccgactccaccacctcccatgctttcttcttcagagccgctggagtgagcctcttcgaccgtacccttccaggcaggattcttagtgaccaaaagaggtgcaggatg

SEQ ID NO: 637769 - DNA, 9690 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
  misc_feature (6055)..(6055): n is a, c, g, or t
  misc_feature (6075)..(6075): n is a, c, g, or t
  misc_feature (6079)..(6079): n is a, c, g, or t
  misc_feature (6094)..(6094): n is a, c, g, or t
  misc_feature (6097)..(6097): n is a, c, g, or t
  misc_feature (6124)..(6124): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgcccctacaaccagcacaatccctgcttctacacccagcacaacctctgcccctacaaccagcacaacctctgctcctacaaccagcatatcctctgcccctacaagcagcacaacctcggctcctacaagcagcacaatctctgctcgtacaaccagcataatctctgcccctacaaccagcacaacctctttccctacaaccagcacaacctctgctactacaaccagcacaacctctgcccctacaagcagcacaacctccactccacagaccagcaaaacctcagctgtcctacaaccagcacaacctctggtnctggaactactcccagcccngttnccaccaccagcacanccnctgtttcaaagaccagcacaagccatntttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgagcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacaaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacaccgcctgctccgtgcctgccatcacccatctgccacctgattctgagcaaggtctttgagccgtgccacactgtgatccccccactgctgttctatgagggctgcgtctttgaccggtgccacatgacggacctggatgtggtgtgctccagcctggagctgtacgcggcactctgcgcgtcccacgacatctgcatcgattggagaggccggaccggccacatgtgcccattcacctgcccagccgacaaggtgtaccagccctgcggcccgagcaacccctcctactgctacgggaatgacagcgccagcctcggggctctccgggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccctggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgctgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcgctgccctgcgccgggcgacacccagcactcggaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctgtccaggcggctgcagctttgaacacactgtccacgcccgctttcttgtggagggtgtgggctatgggtcacctgctgcctggaggaggggcccttacccaccccgcctgcagccacctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacacggccaatctgttgcataaatacacttgagcattttgca

SEQ ID NO: 637770 - DNA, 9730 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
  misc_feature (6055)..(6055): n is a, c, g, or t
  misc_feature (6075)..(6075): n is a, c, g, or t
  misc_feature (6079)..(6079): n is a, c, g, or t
  misc_feature (6094)..(6094): n is a, c, g, or t
  misc_feature (6097)..(6097): n is a, c, g, or t
  misc_feature (6124)..(6124): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgcccctacaaccagcacaatccctgcttctacacccagcacaacctctgcccctacaaccagcacaacctctgctcctacaaccagcatatcctctgcccctacaagcagcacaacctcggctcctacaagcagcacaatctctgctcgtacaaccagcataatctctgcccctacaaccagcacaacctctttccctacaaccagcacaacctctgctactacaaccagcacaacctctgcccctacaagcagcacaacctccactccacagaccagcaaaacctcagctgtcctacaaccagcacaacctctggtnctggaactactcccagcccngttnccaccaccagcacanccnctgtttcaaagaccagcacaagccatntttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgagcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacaaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacaccgcctgctccgtgcctgccatcacccatctgccacctgattctgagcaaggtctttgagccgtgccacactgtgatccccccactgctgttctatgagggctgcgtctttgaccggtgccacatgacggacctggatgtggtgtgctccagcctggagctgtacgcggcactctgcgcgtcccacgacatctgcatcgattggagaggccggaccggccacatgtgcccattcacctgcccagccgacaaggtgtaccagccctgcggcccgagcaacccctcctactgctacgggaatgacagcgccagcctcggggctctccgggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccctggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgctgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcgctgccctgcgccgggcgacacccagcactcggaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctgtccaggcggctgcagctttgaacacactgtccacgcccgctttcttgtggagggtgtgggctatgggtcacctgctgcctggaggaggggcccttacccaccccgcctgcagccacctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacacggccaatctgttgcataaatacacttgagcattttgcaaaagcaaaatacaaacaaaaaaaaataaagaaaagagaag

SEQ ID NO: 637771 - DNA, 495 bp, Homo sapiens
ctacggttccgtgctagtacgtagactgagaataaaggtagtatgcgtgatgccaaggaaacaactcctccttaggcagcgggcaatctcacaacctcgatgatacctgagctaggccaaattatatctcaagagcttctaagtagtggctaagaactgtgcgcagaggaaaaagagaggtgactttggaaccaagcagatcagcaacttgcttcctagctgtgtgaccctgggcaaataacagagccatcagagccttggtttccacattcttaagtgggggtaatacccacatcccaaaataatggtagggagtcaaaaattatatatatatgaatcagtaggacagcaccgccccccaggtgaaaaaaaattaatgatttcttatcatgtattattcgtctaaatagctaggccaggatacatctttgcctcactctgatggtgatgaagaaaagagccacagccagcatggcatctgaactgaaggtagag

SEQ ID NO: 637772 - DNA, 133 bp, Homo sapiens
ccgggattgaggagatctgaagtgtactggatcagatgatctgcctgataaactttagttcacgctgacagacagtcttctcagatatttcatgactgtgaaggtgtgaaaatggaacgcatccttagaatag

SEQ ID NO: 637773 - DNA, 9571 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
  misc_feature (6055)..(6055): n is a, c, g, or t
  misc_feature (6075)..(6075): n is a, c, g, or t
  misc_feature (6079)..(6079): n is a, c, g, or t
  misc_feature (6094)..(6094): n is a, c, g, or t
  misc_feature (6097)..(6097): n is a, c, g, or t
  misc_feature (6124)..(6124): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgcccctacaaccagcacaatccctgcttctacacccagcacaacctctgcccctacaaccagcacaacctctgctcctacaaccagcatatcctctgcccctacaagcagcacaacctcggctcctacaagcagcacaatctctgctcgtacaaccagcataatctctgcccctacaaccagcacaacctctttccctacaaccagcacaacctctgctactacaaccagcacaacctctgcccctacaagcagcacaacctccactccacagaccagcaaaacctcagctgtcctacaaccagcacaacctctggtnctggaactactcccagcccngttnccaccaccagcacanccnctgtttcaaagaccagcacaagccatntttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgagcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacaaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacaccgcctgctccgtgcctgccatcacccatctgccacctgattctgagcaaggtctttgagccgtgccacactgtgatccccccactgctgttctatgagggctgcgtctttgaccggtgccacatgacggacctggatgtggtgtgctccagcctggagctgtacgcggcactctgcgcgtcccacgacatctgcatcgattggagaggccggaccggccacatgtgcccattcacctgcccagccgacaaggtgtaccagccctgcggcccgagcaacccctcctactgctacgggaatgacagcgccagcctcggggctctccgggaggccggccccatcaccgaaggctgcttctgtccggagggcatgaccctcttcagcaccagtgcccaagtctgcgtgcccacgggctgccccaggtgtctggggccccacggagagccggtgaaggtgggccacaccgtcggcatggactgccaggagtgcacgtgtgaggcggccacgtggacgctgacctgccgacccaagctctgcccgctgccccctgcctgccccctgcccggcttcgtgcctgtgcctgcagccccacaggccggccagtgctgcccccagtacagctgcgcctgcaacaccagccgctgccccgcgcccgtgggctgtcctgagggcgcccgcgcgatcccgacctaccaggagggggcctgctgcccagtccaaaactgcagctggacagtgtgcagcatcaacgggaccctgtaccagcccggcgccgtggtctcctcgagcctgtgcgaaacctgcaggtgtgagctgccgggtggccccccatcggacgcgtttgtggtcagctgtgagacccagatctgcaacacacactgccctgtgggcttcgagtaccaggagcagagcgggcagtgctgtggcacctgtgtgcaggtcgcctgtgtcaccaacaccagcaagagccccgcccacctcttctaccctggcgagacctggtcagacgcagggaaccactgtgtgacccaccagtgtgagaagcaccaggatgggctcgtggtggtcaccacgaagaaggcgtgccccccgctcagctgttctctggacgaggcccgcatgagcaaggacggctgctgccgcttctgcccgctgcccccgcccccgtaccagaaccagtcgacctgtgctgtgtaccataggagcctgatcatccagcagcagggctgcagctcctcggagcccgtgcgcctggcttactgccgggggaactgtggggacagctcttccatgtactcgctcgagggcaacacggtggagcacaggtgccagtgctgccaggagctgcggacctcgctgaggaatgtgaccctgcactgcaccgacggctccagccgggccttcagctacaccgaggtggaagagtgcggctgcatgggccggcgctgccctgcgccgggcgacacccagcactcggaggaggcggaacccgagcccagccaggaggcagagagtgggagctgggagagaggcgtcccagtgtcccccatgcactgaccagcactgccgccctcctgacctccaaggagaacctcccatatgtcctctgagctcggcttccaaggccagtggaacttgtgcccctctcaggaccagccccggggctggccgagctcctctggccatgcatccagcctgctgttctggggacgtgagcatcacctgagggtctcaggaatgacgcttggacatggtgatcagctgcctggtggctgcaggaggaagaacctcactcctacctcagccctcagcctgcgctcccctcctcagtacacggccaatctgttgcataaatacacttgagcattttgca

SEQ ID NO: 637774 - DNA, 7760 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
  misc_feature (6055)..(6055): n is a, c, g, or t
  misc_feature (6075)..(6075): n is a, c, g, or t
  misc_feature (6079)..(6079): n is a, c, g, or t
  misc_feature (6094)..(6094): n is a, c, g, or t
  misc_feature (6097)..(6097): n is a, c, g, or t
  misc_feature (6124)..(6124): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgcccctacaaccagcacaatccctgcttctacacccagcacaacctctgcccctacaaccagcacaacctctgctcctacaaccagcatatcctctgcccctacaagcagcacaacctcggctcctacaagcagcacaatctctgctcgtacaaccagcataatctctgcccctacaaccagcacaacctctttccctacaaccagcacaacctctgctactacaaccagcacaacctctgcccctacaagcagcacaacctccactccacagaccagcaaaacctcagctgtcctacaaccagcacaacctctggtnctggaactactcccagcccngttnccaccaccagcacanccnctgtttcaaagaccagcacaagccatntttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctctgtgaccccatatgggacttctcctaccaatgctctgtatccttccctgtctacttccatggtatccgcctccgtggcatccacctctgtggcatccagctctgtggcatccagctctgtggcttactccacccaaacctgcttctgcaacgtggctgaccggctctaccctgcaggatccaccatataccgccacagagacctcgctggccattgctattatgccctgtgtagccaggactgccaagtggtcagaggggttgacagtgactgtccgtccaccacgctgcctcctgccccagccacgtccccttcaatatccacctccgagcccgtcactgagctgggatgcccaaatgcggttccccccagaaagaaaggtgagacctgggccacacccaactgctccgaggccacctgtgagggcaacaacgtcatctccctgagcccgcgcacgtgcccgagggtggagaagcccacttgtgccaacggctacccggctgtgaaggtggctgaccaagatggctgctgccatcactaccagtgccagtgtgtgtgcagcggctggggtgacccccactacatcaccttcgacggcacctactacaccttcctggacaactgcacgtacgtgctggtgcagcagattgtgcccgtgtatggccacttccgcgtgctcgtcgacaactacttctgcggtgcggaggacgggctctcctgcccgaggtccatcatcctggagtaccaccaggaccgcgtggtgctgacccgcaagccagtccacggggtgatgacaaacgagatcatcttcaacaacaaggtggtcagccccggcttccggaaaaacggcatcgtggtctcgcgcatcggcgtcaagatgtacgcgaccatcccggagctgggagtccaggtcatgttctccggcctcatcttctccgtggaggtgcccttcagcaagtttgccaacaacaccgagggccagtgcggcacttgcaccaacgacaggaaggatgagtgccgcacgcctagggggacggtggtcgcttcctgctccgagatgtccggcctctggaacgtgagcatccctgaccagccagcctgccaccggcctcacccgacgcccaccacggtcgggcccaccacagttgggtctaccacggtcgggcccaccacagttgggtctaccaccgtcgggcccaccacagttggctctaccaccgtcgggcccaccacaccgcctgctccgtgcctgccagctgctcagca

SEQ ID NO: 637775 - DNA, 386 bp, Homo sapiens
taagtttgaaggaaattaaaaatgctactccagatgaacacatcaatgataagaaagtgaaacagccttactgctaatgtggagacagtctgagtggtctggatagaagagcacaccagctagaacattccctaagccacagcctaattcagagcaagagcgcaactcttttcaattctgttcacggctgagcagcaggtgcatgaatccgcagaagcaaacagttggtatagctagcaggagttggttcatgcaggtttaaggcaaagaagctgtctccataacacatacaagtgcaaggtgaaacagcaaggactgatcagagagctgcagcaagttatcccacaaaatctaagcagcaaaagatggggtgtgctttcacggga

SEQ ID NO: 637776 - DNA, 6687 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
  misc_feature (6055)..(6055): n is a, c, g, or t
  misc_feature (6075)..(6075): n is a, c, g, or t
  misc_feature (6079)..(6079): n is a, c, g, or t
  misc_feature (6094)..(6094): n is a, c, g, or t
  misc_feature (6097)..(6097): n is a, c, g, or t
  misc_feature (6124)..(6124): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgcccctacaaccagcacaatccctgcttctacacccagcacaacctctgcccctacaaccagcacaacctctgctcctacaaccagcatatcctctgcccctacaagcagcacaacctcggctcctacaagcagcacaatctctgctcgtacaaccagcataatctctgcccctacaaccagcacaacctctttccctacaaccagcacaacctctgctactacaaccagcacaacctctgcccctacaagcagcacaacctccactccacagaccagcaaaacctcagctgtcctacaaccagcacaacctctggtnctggaactactcccagcccngttnccaccaccagcacanccnctgtttcaaagaccagcacaagccatntttctgtatccaagacaacccactcccaaccagtcaccagtgactgtcatcctctgtgcgcctggacaaagtggttcgacgtggacttcccatcccctggaccccacggcggggacaaggaaacctacaacaacatcatcaggagtggggaaaaaatctgccgccgacctgaggagatcaccaggctccagtgccgagccgagagccacccggaggtgaacattgaacacctgggtcaggtggtgcagtgcagccgtgaagagggcctggtgtgccggaaccaggaccagcagggacccttcaagatgtgcctcaactacgaggtgcgcgtgctctgctgcgagacccccagaggctgcccggtgacctccacatctgtgacagctcctagcacccctagtgggagagccaccagcccaactcagagcacctcctcttggcagaaatccaggacaaccactttggtgacaagcagcataacctccactacacagaccagcacaacctctgcccctacaagtagcacaacccagcttcaatacccagcacatccgactggcccg

SEQ ID NO: 637777 - DNA, 175 bp, Homo sapiens
  misc_feature (114)..(115): n is a, c, g, or t
gcggccgcctactactactactgctcgaattcaagcttctaacgatgtacggggacatgttaaacctcaaataaatgcttccttatgtgattgcttttcgtgcgtcaggtactnnacatagctcttgtaaaaaatgtaatttaaaataagcaataattaaggcacaaaaaaaaaa

SEQ ID NO: 637778 - DNA, 6178 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgcccctacaaccagcacaatccctgcttctacacccagcacacgcgactggtgtgctacaagagggattattagtctctgcagctggtcatcccgtcatctactctgccctgtaagtccactgaatatcctctgtcatcctctcttctaccctgtgctgagtctggggattttataaacctcacaggcgagaaatgtgcctgcggactgttccatagacagccatgggtgggtccagaagaggcagaacaagtccccagctattgatatcagagcaggcaccaggagctgagaggaggccaggaagtgaaaagcagacaacccctatgcctgcagtaattacgggtgaggttcctttctggggccccaaaggttgcagtctacaggttgaagaaactgccctaggtccttcacctggaaggatggctgcaaccaaacctgg

SEQ ID NO: 637779 - DNA, 178 bp, Homo sapiens
ctaagaacagcatcgtgtaatgtgagacttgtttatgtgcggagatttgtggtgaacatgttatctgtaattttgtagcctgactaacgtgcttcatcggatgcatgacatgtgctacatgagcaactactgtgcttcttgtgctttggcggcttgactagtgctctatctacagttg

SEQ ID NO: 637780 - DNA, 5828 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgcagctgctacaagcagcacaacctccagttctggactacgcctgcctgttaccaccaccagcacagcctctgtttcaagaccagtacgcg

SEQ ID NO: 637781 - DNA, 5858 bp, Homo sapiens
  misc_feature (195)..(195): n is a, c, g, or t
  misc_feature (586)..(586): n is a, c, g, or t
  misc_feature (816)..(816): n is a, c, g, or t
  misc_feature (1099)..(1099): n is a, c, g, or t
  misc_feature (1327)..(1327): n is a, c, g, or t
  misc_feature (2495)..(2495): n is a, c, g, or t
  misc_feature (2499)..(2499): n is a, c, g, or t
  misc_feature (2560)..(2560): n is a, c, g, or t
  misc_feature (2651)..(2651): n is a, c, g, or t
  misc_feature (2828)..(2828): n is a, c, g, or t
  misc_feature (2844)..(2844): n is a, c, g, or t
  misc_feature (2955)..(2955): n is a, c, g, or t
  misc_feature (2978)..(2978): n is a, c, g, or t
  misc_feature (5341)..(5341): n is a, c, g, or t
ctcagaggctgctgagggacagggcactcttccccgccgtccacacaatgagtgttggccggaggaagctggccctgctctgggccctggctctcgctctggcctgcacccggcatacagccatgcccaggatggctcctccgaatccagctacaagcaccaccctgccctctctcctatcgcccgggggcccancggggtcccgctccgtggggcgactgtcttcccatctctgaggaccatccctgtggtacgagcctccaacccggcgcacaacgggcgggtgtgcagcacctggggcagcttccactacaagaccttcgacggcgacgtcttccgcttccccggcctctgcaactacgtgttctccgagcactgcggtgccgcctacgaggattttaacatccagctacgccgcagccaggagtcagcggcccccacgctgagcagggtcctcatgaaggtggatggcgtggtcatccagctgaccaagggctccgtcctggtcaacggccacccggtcctgctgcccttcagccagtctggggtcctcattcagcagagcagcagctacaccaaggtggangccaggctgggccttgtcctcatgtggaaccacgatgacagcctgctgctggagctggacaccaaatacgccaacaagacctgtgggctctgtggggacttcaacgggatgcccgtggtcagcgagctcctctcccacaacaccaagctgacacccatggaattcgggaacctgcagaagatggacgaccccacggagcagtgtcaggaccctgtccctgaacccccgangaactgctccactggctttggcatctgtgaggagctcctgcacggccagctgttctctggctgcgtggccctggtggacgtcggcagctacctggaggcttgcaggcaagacctctgcttctgtgaagacaccgacctgctcagctgcgtctgccacacccttgccgagtactcccggcagtgcacccatgcaggggggttgccccaggactggcggggccctgacttctgcccccagaagtgccccaacaacatgcagtaccacgagtgccgctccccctgngcagacacctgctccaaccaggagcactcccgggcctgtgaggaccactgtgtggccggctgcttctgccctgaggggacggtgcttgacgacatcggccagaccggctgtgtccctgtgtcaaagtgtgcctgcgtctacaacggggctgcctatgccccaggggccacctactccacagactgcaccaactgcacctgctccggaggccggtggagctgccaggangttccatgcccgggtacctgctctgtgcttggaggtgcccacttctcaacgtttgacgggaagcaatacacggtgcacggcgactgcagctatgtgctgaccaagccctgtgacagcagtgccttcactgtactggctgagctgcgcaggtgcgggctgacggacagcgagacctgcctgaagagcgtgacactgagcctggatggggcgcagacggtggtggtgatcaaggccagtggggaagtgttcctgaaccagatctacacccagctgcccatctctgcagccaacgtcaccatcttcagaccctcaaccttcttcatcatcgcccagaccagcctgggcctgcagctgaacctgcagctggtgcccaccatgcagctgttcatgcagctggcgcccaagctccgtgggcagacctgcggtctctgtgggaacttcaacagcatccaggccgatgacttccggaccctcagtggggtggtggaggccaccgctgcggccttcttcaacaccttcaagacccaggccgcctgccccaacatcaggaacagcttcgaggacccctgctctctgagcgtggagaatgagaagtatgctcagcactggtgctcgcagctgaccgatgccgacggccccttcggccggtgccatgctgccgtgaagccgggaacctactactcgaactgcatgtttgacacctgcaactgtgagcggagcgaggactgcctgtgcgccgcgctgtcctcctacgtgcacgcctgtgccgccaagggcgtgcagctcggcggctggagggacggcgtctgcacgaagcctatgaccacttgccccaagtcaatgacgtaccactaccatgtcagcacctgccagcccacctgccgctccctgagcgagggggacatcacctgcagtgttggcttcatccccgtggatggctgcatctgtcccaagggcaccttcctggacgacacgggcaagtgtgtgcaggccagcaactgtccctgctaccacagaggctccatgatccccaatggggagtcggtgcacgacagcggggctatctgcacctgcacacatgggaagctgagctgcatcggaggccaagcccccgccccagtgtgtgctgcgcccatggtgttctttgactgccgaaatgccacgcccngggncacaggggctggctgtcagaagagctgccacacactggacatgacctgttacagcccccantgtgtgcctggctgcgtgtgccccgacgggctggtggcggacggcgagggcggctgcatcactgcggaggactgcccctgcgtgcacaatnaggccagctaccgggccggccagaccatccgggtgggctgcaacacctgcacctgtgacagcaggatgtggcggtgcacagatgacccctgcctggccacctgcgccgtgtacggggacggccactacctcaccttcgacggacagagctacagcttcaacggagactgcgagtacncgctggtgcagaaccnctgtggcgggaaagacagcacccaggactcctttcgtgttgtcaccgagaacgtcccctgcggcaccacagggaccacctgctccaaggccatcaagattttcctgggggncttcgagctgaagctaagccatnggaaggtggaggtgatcgggacggacgagagccaggaggtgccatacaccatccggcagatgggcatctacctggtggtggacaccgacattggcctggtgctgctgtgggacaagaagaccagcatcttcatcaacctcagccccgagttcaagggcagggtctgcggcctgtgtgggaacttcgacgacatcgccgttaatgactttgccacgcggagccggtctgtggtgggggacgtgctggagtttgggaacagctggaagctctccccctcctgcccagatgccctggcgcccaaggacccctgcacggccaaccccttccgcaagtcctgggcccagaagcagtgcagcatcctccacggccccaccttcgccgcctgccacgcacacgtggagccggccaggtactacgaggcctgcgtgaacgacgcgtgcgcctgcgactccgggggtgactgcgagtgcttctgcacggctgtggcccgctacgcccaggcctgccatgaagtaggcacctgtgtgtgtctgcggaccccaagcatctgccctctgttctgcgactactacaaccccgaaggccagtgcgagtggcactaccagccctgcggggtgccctgcctgcgcacctgccggaacccccgtggagactgcctgcgggacgtccggggcctggaaggctgctaccccaagtgcccaccagaggctcccatctttgatgaggacaagatgcagtgtgtggccacctgcccaaccccgcctctgccaccacggtgccacgtccatgggaagtcctaccggccaggtgcagtggtgccctcggacaagaactgccagtcctgcctttgtacggagcgcggcgtggagtgcacctacaaagctgaggcctgtgtctgcacctacaatggacagcgcttccacccaggggacgtcatctaccacacgacggatggcacgggtggctgcatctccgcccgctgcggggccaacggcaccattgagaggagggtctacccctgcagccccaccacccctgtccccccaaccaccttctccttctccacacccccgcttgtcgtgagctccacgcacacccccagcaatggcccaagcagcgcgcacacaggccctccgagcagcgcctggcccaccacagcaggcacttctcccaggacgaggctgcccacagcctctgcctcgctgccgccggtctgtggggaaaagtgcctgtggtcgccatggatggatgtcagccgccctggacggggcacggacagcggtgacttcgacacactggagaacctccgcgcccatgggtaccgggtgtgcgaatcacccaggtcggtggagtgccgagccgaggacgcccccggagtgccgctccgagccctggggcagcgtgtgcagtgcagcccggatgtggggctgacctgtcgtaacagggagcaggcatcggggctctgctacaactaccagatcagggtccagtgctgcacgcccctagcctgctccacctctagcagtccagcccagaccactcctccaactacctccaagaccactgaaacccgggcctcaggctcctcagctcccagcagcacacctggcaccgtgtctctctctacagccaggacgacacctgccccaggtaccgctacctctgtcaaaaaaactttctcaactcccagccctccgccagtgccggcaacatcaacatcatccatgtcgaccacggccccggggacctctgtggtctccagcaagcccacccccacggagcccagcacatcctcctgcctgcaggagctttgcacctggaccgagtggatcgatggcagctaccctgctcctggaataaatggtggagattttgacacatttcaaaatttgagagacgaaggatacacattctgtgaaagtcctcgaagcgtgcagtgccgggcagagagcttccccaacacgccgctggcagacctggggcaggacgtcatctgcagccacacagaggggctgatttgcctgaacaagaaccagctcccacccatctgctacaactatgagatccgcatccagtgttgcgagacggtgaacgtgtgcagagacatcaccagactgccaaagaccgtcgcaacgacacggccgactccacatccaaccggagctcagacccagaccaccttcaccacacacatgccctcggcctccacagagcaacccacggcaacctccaggggtgggcccacagcaaccagcgtcacacagggcacccacaccacaccagtcaccagaaactgtcatccccggtgcacctggacaaagtggttcgacgtggacttcccgtcccccggaccccatggtggngacaaggaaacctacaacaacatcatcaggagtggggaaaaaatctgccgccgtactgaggagatcaccaggctccagtgccgagccgagagccacccggaggtgagcatcgaacacctgggccaggtggtgcagtgcagccgggaagagggcctggtgtgccggaaccaggaccagcagggacccttcaagatgtgcctcaactacgaggtgcgtgtgctctgctgcgagacccccaaaggctgccccgtgacctccacacctgtgacagctcctagcacccctagtgggagagccaccagcccaactcagagcacctcctcttggcagaaatccaggacaaccactttggtgacaaccagcacaacctccactccacagaccagcacaacctctgcatgaccatacaaccagcacaacctctgctcctacagccagaacaacctctgctcctacaaccagaacaacttctgcctctccagccagcacaacctctggtcctggaaatactcccacc

SEQ ID NO: 637782 - DNA, 104 bp, Homo sapiens
cggcacactgtttctatatttaaggacaccttcagttgttcataaataaaggagacacaatcactctcatttgcttatgtaaatgaaagtgattgttccccgct

SEQ ID NO: 637783 - DNA, 943 bp, Homo sapiens
  misc_feature (697)..(697): n is a, c, g, or t
gagatctggtgagcccgagcgctgactgggccgcggagaaagccagtgggaacccagaaccataggagagccgtgtccttccgctcggcctgggcgggccccgcgctatggagttcctctgggcccctctgttgggtgtgtgctgtggtctggccgatgttgatcgacacaccgtcttgctggaacagttcaaatcccaagtatccgggaagtgacggactatcatcaatacaatgtgcatgtctgtaatgatcataccgatggagcatcgatcggtccggacatactcgaaagatcagcatctgtggatggacagctggcccatgggagcaaggtaccattatctgtaacccctgtgtggaagcatgaaggacgtatccatgatggtgccagacctcaggtccagaggaccacatgtgtccgctggtcagtgcaaccggcctcagtggcaacgccattgggccggagaatgcttgtctgatgaatgttcctaggcggcttcacaccctgtcgaccgcatgggcaaggagttcgactgaaggtggacaagagtattacttacgatcattccgagagctcatccgatcacgacattgggagaggcgctgctttgagggttggacaggttgcacctgctcatgggggcaagtatcacttcgacagtgccctccaggtcccatggccaaggccagcaggnaagaatgagacttcgcagcagggatggagacctacgaggttgcgggtttcgtactagttagcactcggttccacaggtgctggcgccattgccatcttggacaaatttgtccgtggaacttgtgctggatccctttaccactttcttgcgtgcttggaagccccgtggaggtggggtgccacaacctgggcttaaagaggggacggggccggaaaagagcggagggctggcaagaaccgatggggc

SEQ ID NO: 637784 - DNA, 561 bp, Homo sapiens
agtcaacttcgggccgtaatagtacatctacgagatgtcaccccgaaatcaaagaatatacattttattgcagcaccacaccacacctattccaaacttgaccacatactggggaagtaaagctctcctcagcaaatgtaaaagaacagaaattatagcaaactatctctcagaccacagtgcaatcaaactagaactcaggattaagaatctcactcaaaaccgctcaactacatggaaactgaacaacctgctcctgaatgactactgggtatataacaaaatgaaggcaaaaataaagatgttctttgaaaccaccgagaacaaagacacaacataccagaatctctgggacacattcaaagcagtgtgtagagggaaatctatggccctaaatgcccacaagagaacgcaggacatatcgaacctggacacactaacatcacaattagaagaactcgaaaagcaagagcaaactcattcaaaagctagcagaaggcacgacataactaaaatcagagcagaccggaaggtgcagtacagtacggggtaccgagctcg

SEQ ID NO: 637785 - DNA, 218 bp, Homo sapiens
actatgtactattgtaacttctagttccctaagaggtaccggtcttcagtacaagggggtcctgagttcggtgcaggtggaagagctaccagagaactaccagagttcggtgcaggtcgagtcccattgcgtatgggaccggtgtgcacctgagaactcttacttgagacatcaaaaagaagcagcaggagctcctgggacagagacagcgagcggta

SEQ ID NO: 637786 - DNA, 178 bp, Homo sapiens
gaatacacagcgattacttgaggatccccgtgtatacgagatagccgttaagtaccagcattctgtatcaggccactatctgaacggccgaagatgcccattccagatctgcccatttgatcgaagagcagaagcctggaacagattcaaggcaagaaagtcctccgcacattcgtta

SEQ ID NO: 637787 - DNA, 321 bp, Homo sapiens
tcgagctcggtaccttactcgggagtctagccgcacgagctctcattctaacctgaatcggaggagaaccagtagactaccctgtgagcatcctggacaagtcgcatccgtagtatacgtcacaacaagcctaatcctgaatagcaagtatctccctaatggaaaacaaaatactcgaatgggcctaaggacaaagaagcatatggaggacgacaaaaaaaaggagccaacgaaaacgcgtacgtcgcgaaacgaggacatgtacagagctcgagaagtactagtggccacgtgggccgtgcacccttaagcttggcactg

SEQ ID NO: 637788 - DNA, 225 bp, Homo sapiens
ggacttccaggcgctgtaggaggtcggcgggtaccatatgtctcctttggacctcatgccgggaaattggtcgcgattgtagattttatgatcagaacagggctttggtcgatggacctagacactgaagtgaggagagaggccatgcctttcaagtgcatgcagctcactgatttcatcctcaagtatccggacagtgcccaccagaagtatgtccgacacgcc

SEQ ID NO: 637789 - DNA, 702 bp, Homo sapiens
  misc_feature (241)..(241): n is a, c, g, or t
  misc_feature (246)..(246): n is a, c, g, or t
  misc_feature (260)..(260): n is a, c, g, or t
  misc_feature (262)..(263): n is a, c, g, or t
  misc_feature (266)..(266): n is a, c, g, or t
  misc_feature (270)..(270): n is a, c, g, or t
  misc_feature (274)..(274): n is a, c, g, or t
  misc_feature (295)..(295): n is a, c, g, or t
  misc_feature (297)..(297): n is a, c, g, or t
  misc_feature (301)..(301): n is a, c, g, or t
  misc_feature (389)..(389): n is a, c, g, or t
  misc_feature (408)..(409): n is a, c, g, or t
gcctcgtgccgaattcggcacgaggattgaggcagaatttacatgaaataggtgagcggtgtgttgaagaactcaagcatttcattgcagagtatgatacttccactcaagattttggagagcctttttagatttttctgctcaggctaaaaaaaaaaaaaaacagtttctaaaaattttttttccgggatggtgtaaatccttaatatatggaattttggtgatgcagagaaatactttntgatngtggacacatttcngnnttnaatnaacntctaaaatagtcggtttaacntngttnggattcaaattttggtatttttggtagagatggggttcaccatgtgggccaggctagtctctaactccgggcctcaagtgatctgccnggcctcagcctctcaaagnngttgagattacagggcgtgagccaccgttccctgcccaacacatattaccatctgaaaattgttagaattctgagtgggtgatttatggactgtgtggctggcttatactaaggcttggtaactggtcactatgttaacaaggggtactatcctaataaacggaatacttgggtatctacagagaatattgggcttggagagtaattctcattcaaggatacaacatagagcacttaaatctctgagagatacctcagaaaaaaatccgtattccaaaaaaacaaaacacaag

SEQ ID NO: 637790 - DNA, 149 bp, Homo sapiens
aatagaagagacgagatgaagaagtagagatgctggtggcagggcatacagcaatggttgtatcaactatgaagagctcgtccgcgattatgctgatattggtgaggacgcttcctctgtctccccatcagttccgtgtcgcttgccct

SEQ ID NO: 637791 - DNA, 152 bp, Homo sapiens
gaaagatgggccttggggcccccccttcccccttttttgtccccccactttaaaggtatgaaggcttttggtttccctgggggggggggggggcacccaggggtttcctgtcccctgattttggacccgttgaataaaagggccccccttta

SEQ ID NO: 637792 - DNA, 174 bp, Homo sapiens
gcggtcccagtctcgtccatcaggtgatatgttgtgatcgatatgaaaaatttatgctaatatgcctgaacaaatagaatcacagaagacaaaactatacaatcaaaaattaggacaattttcaagaaaatgtatcttagcttgtttgcaaatttcacattgatttacaaaatg

SEQ ID NO: 637793 - DNA, 741 bp, Homo sapiens
ggagagagagaatgagagagagactgtgtgtgtgtgtgtgtgtgtgtgtactctgtgtgtgtatgagagagagagagaaatgctaaccttgtagcatgtgaagaatgtcgtgtaccttgatacgatagttacataatcagtatattgggtttctagatcacgtgtgcttattggtttcaatctctgactaaaaatacttaaatgtgggtggttaattcttattttagaaattataatttgagtttatattaattgcgggttatagcttacgtgaagaaatctttccagttagaagggaggttctaatattcacatgttctaatactgttgtgttagtgtaaaagcagctaaatggggagatacgtaaagccgtgttttctgcctgtgtggtacagctactttccatgtggtattacacagtcaaatttacatttatctattaaaagtcgccattttattaaacattttcatgcacagtagattcaagtggtgtctgaaaatatctcgttgtgcttttggattgggctgactttaaaaggatttaatcctggggcagacattatgttaacagaacaggctgtgttcaactatatttttggaacctgtgtggggacaaaacatagcgtggttaaacttgaaggtgactgttgtccagggtgtggtgcacatgttcaaaatcctatgggaggagaatttctaagtggggaaattcaaggagggggggggggcccaaattccggc

SEQ ID NO: 637794 - DNA, 141 bp, Homo sapiens
gttccttgcattttgggacagaatggaatctcagacctttgtgaaggtgactctgacttctgaggaagaggccccttttaagaagagtccagatacactttggggggatccaaaagggcgctgcaattttaaaggtcttct

SEQ ID NO: 637795 - DNA, 346 bp, Homo sapiens
  misc_feature (75)..(75): n is a, c, g, or t
ccgtggcaggaatttagtggggcccctggtccggggtctcaggatgggtctggggggcttggtgttcatcaaganacccctttgcccagctcaccacattttcatcacaagcaaaggccgggattgggttcccccatcctcagaattcacaagccattgttccccagttggggaacccaccctcccccctgcctgggttggtgacagagggggtgggacagggggggggggttccccctgtacataccctgccataccaaccccaggtattaattctcgcgggtttggtttttattttaatttttttgttttgatttttttaataagaattttcattttaagccca

SEQ ID NO: 637796 - DNA, 246 bp, Homo sapiens
gagctctccgatataaaatattaggtgcatgtattcatgattagcttgacacttccagcaagagcgaagatggcgataacaacaggaacttcttacaagataagagaaagacccacgtccctccagagtttctgttggaacaggactcttctgtttggcttatatacagttaagttcgtttagtgtctgatccagtgtctgatgtaggcccacgttctcttctttggcctgggcaagtttctcttc

SEQ ID NO: 637797 - DNA, 427 bp, Homo sapiens
gcgtcgacggcaggtgtgagtgcatctgcatgcaaagtcaggtgaagacttttgcaggatggcctggtgtcaagaagggcagcaaagaagccacttctgtccaggaaaaacatcagggacagactggtattctgcaaaaggtacagggattggactgctgaggactgaggtaaagtcattttctctgatgaatcccctttccgattgtttggggcatctggaaaaaacttgtccggagaagataaggtgagcgctaccatcagtcctgtgtcatgccaacagtaaagcatcatgagaccattcatgtgtgaaaaaaacttctcaaccaagagagtgggctgactcacaattttgcctaagaacacagccatgaataaagaatggtaccaacacattctccgaggtcgacgcggccgcgaatttagta

SEQ ID NO: 637798 - DNA, 716 bp, Homo sapiens
  misc_feature (148)..(148): n is a, c, g, or t
  misc_feature (152)..(152): n is a, c, g, or t
  misc_feature (169)..(169): n is a, c, g, or t
  misc_feature (173)..(173): n is a, c, g, or t
  misc_feature (179)..(179): n is a, c, g, or t
  misc_feature (475)..(475): n is a, c, g, or t
  misc_feature (490)..(490): n is a, c, g, or t
  misc_feature (556)..(557): n is a, c, g, or t
  misc_feature (563)..(563): n is a, c, g, or t
  misc_feature (567)..(568): n is a, c, g, or t
  misc_feature (571)..(571): n is a, c, g, or t
  misc_feature (594)..(594): n is a, c, g, or t
  misc_feature (639)..(639): n is a, c, g, or t
gaattgctttcttaatttcttgtttcagctagtttactatcaatatatagaaatgctactgatttttgtatgttgatttatatcctgcaactttattaatttcatgtatcaccctaagaagcttttggtagagtcttatttttttccntgtntaagacaattgtcttanacanggacantttgactgtctcctttccaattcagatgtcctttatttctttctctcacctaattgtcctggctaagactttcactatgtgaaatatgattggtgagaataggcatccttttcttgttccagtaaaatctttttcttgttcacagtaaaatctttcaccttttccacactcagtatgatcttagctgtagatttgtcctttatgtccttctgtgttaaggcatatattttctatactaaattgttgagaggttttttgtcatgtaagaatatttaattttgccaaacgcttttatngtgtttattaatttnatcatatggttttcagtatatatccaaaggaaagaaaatcagtatatcaaagagttacctgcaccnncatgtntatnncancactattcacaatagccaagatntggaatcaacaaaagtgtccatcaacagatgaatggataaagaantgtgacatacatatataatggaatattatttagtcataataaagaacaaaatcctgttattcgtggcaacaagaatg

SEQ ID NO: 637799 - DNA, 930 bp, Homo sapiens
gggcctacaaggctctcatcgctgctcagtacagcggggctcaggtccgcgtgctctccgacaccaccccacttccatattaggccaaaccaaccgcaccccgtgaatttctccgctaaatttcctgcccggcaaggtcccagcatttgagggtgatgatggattctgtgtgttcgcagcagcacacgcccattgcctcactcatgtgcagcccatgcaggcagctgcgagggcaagtcactcccagcaggccagcagcccaaggtggtgccagtggggtgcagcttaggctgattccgcatatcagtgcccccagaccagtaccatgggtgttccccaccttgggcatcatgcaccacaacaaacaggccactgcagaatgcaccggcggaagtgaggcgcaattctggggctgctggatgctatacttgcacgcacgaggactatttctggtgggctgaacgcagtgcaattggctgacatcacagttgtctgcaccctgatagtggctctataagccggttctagagccttctttccgacaggcctttcccaataccaaccgctggttcctcacctgcattaccagccccagttccgggctgtcttgggggacagtgaccctggtgtgagaagcatggccagtttgatcgttccaaagtttgcacgagacccaagctacccaggacacaccacggacagcgaagggcacacggcgccgacgagcagcagccccgagctgaacaaacggacggcgacccaaggcagcatgcccagtggttccgacgacagcacatgggcatgaaatgacaacgagcgatggaaaggtgaagccaagggcacaggacccctacggaacccggcccagaatccattcggcgaccaacataaggccagacaccacagcggcccacaccgagagacaaccaa

SEQ ID NO: 637800 - DNA, 975 bp, Homo sapiens
tggacatgcagaacctaccatttccttcccctgtttgcaattttgtggggaggggaggatgttagtatttacaaaagatgattttaagaacttccaagagatgagtttaagaattccatagagtattagttgttcactgtgtaattaatccttccggagagtctttttatttttttctttttaaagaaactttggggtgggttctggttttttattagttaccctaggggttttgttacccgtggggctatgaagggaggtgaagataacggaggggggagaaacaaaaaaagaagaaaaagaggagcctaaaagggggaatatttgaattggaccagggggtgtgaggctggtccctcagttccccattccaaacggaggatagaagactgtgtatttatgtgacctggcagatctctggggccataacactgaaagttgaaagaccctggtgggcagctatcttgggctacgtgataaccagcagaaatgtcggtaatccggatttcctcaattggaaagggatcagctacccggttaaactttgggaaagccattacctagttccatcaagtacactaggttccgaaataggggttcaacgcacctccctttttcaaattgtccaaatagcattctcataaggtcctaaagtaagatttggccacatatgatcctggggtagaatggcgcacttaagaaactagccaacagttgcgcactttcattgtaacaccatttttcagaacttgggtccaggacaatgggcttttcacctggaatatttcaagaagtgtttattgtgaacccctggattttaaatggagaagtcccatgttacggtctctgacaggccttttgggcgggttcctaataactctgacgatgtgtgttgtcaccaattagggccttgggaatcttaagaccttattgttaaagtgttccccttctctttaaacccggttcaaaatccct

SEQ ID NO: 637801 - DNA, 261 bp, Homo sapiens
acgactcgacatgcatagatgagtagataaatgggcattgggtgcgtgggaaaaaaagcccaccttacttaaagactacatgtgcatgaagacttggcatatatttttttatttctacatttcctctttttcgccacatcttatgcaccatggtagcacacagcctgcgaactaaagcaaaatacacgcggtcagaagtccccctgatggaatccagggcagaaatttcacaaagacatggagcgatacaggacaaactcc

SEQ ID NO: 637802 - DNA, 1077 bp, Homo sapiens
agcagagacagcaggaagaggggagtggaggcagcccattcacctggggcaaatgacctgggttgtcgatggacggtggcggagactcccaagggggacgtgtgacccgttctacttatgactatgagaccgttcgcaatgggggcctgatcttcgctggtactggccttcactcagtgtgcgtgctccatctatccttcttctcagtcagaagagttccgacgtgatgagcgtggcacattacagaagcgcagtgctaaatctacatgacagatgtaggccgctaacatgcctaggccatcgagcgtgtgccaccacactgcactggcggccaggctgggaagccacagtcatggccctgccatctggcgtccgtccccttcttccctgggcgtttagacctttgatccccgtcagtgccagcgcttgggctgactggaagctccaggactcaattgtgatccccctagggtggcattcgcgcaactgcctggctcgtgccacccttcagtgcttatacataaacgcctggcgtcaggagcaccgtcgtgctgtccctcaaacagaaagggatacacggagacccttggacaggatacaccgtgggggagctctcaaagttaagagtcccctgggggggctctgatgttggctgttccaggcgagttcattttcgagccagggctgggttgccctcttgtgtgcgtgtgctcctattggagacgtgtcgagtcgagcgccggctcggctttatacctacctggggtccttgtgcgcgtggacactacaggcgcccttctggcgtgccctctcttggctcgagcgatggcagctgctggctgcggtgggtgagccccatttggtttcgtgggtagggcccaactctcttgacggggactttcaggccggctacgggcgggtcccctgattgtgcctgtgtgcccccagtcgccagatgctctgagcggagagcccccctccgtttctttggtggatctcctggtccgttgagacccggatttgggcttgctcgcgggctttctggttttctgctggaacgtccttttattgcacggc

SEQ ID NO: 637803 - DNA, 258 bp, Homo sapiens
tgctctagagatcccccgaagccactgaacatggggaaaccccacggctaatttttgtattttttaggagagactggatttcaccatgttggccaggctggtctcgaacccctgacctaaaatgatctgcccgccttagactccggaagtgctgggattacaggcgggagccaccgcgcccagcccagttcatattcttaacaagcaaatgagaaagagctgtcaagtgacagaattactgaaaaaaatgaagctctg

SEQ ID NO: 637804 - DNA, 461 bp, Homo sapiens
  misc_feature (24)..(24): n is a, c, g, or t
  misc_feature (140)..(140): n is a, c, g, or t
  misc_feature (145)..(145): n is a, c, g, or t
  misc_feature (282)..(282): n is a, c, g, or t
  misc_feature (314)..(314): n is a, c, g, or t
  misc_feature (321)..(321): n is a, c, g, or t
  misc_feature (328)..(328): n is a, c, g, or t
  misc_feature (410)..(410): n is a, c, g, or t
taccagccaggtgtttacccgtgnctattgataaaaacaaattctgatatcagaggcacatgaaagtgcaactttcccacctggccattttgtaaaactgcaagtatcttggaccttttaaacacaaaatttaaactcanacaanctgtataagtggaatggttactgtttatactgtggtatgtttttgattacagcagataatgctttcttttccagtcgtctttgagaataaaggaaaaaatcttcagatgcaatggttttgtgtagcattcttgtctnatcatgttttgtaaatgactggagaagctttngaccaantttgacnttagagaatggaaatgtaactgttgcttaccagaaaatgtgctattaaacgtgcctgcttaaggtgggttctaatgtttctnggtgaagcacagctaaaaagcgaaaagagtaaagtgtgaatgaaaagtgta

SEQ ID NO: 637805 - DNA, 945 bp, Homo sapiens
cgcccgccatctcctcctccccgacctggcgggcgaaggtatggtgcgctcggccctgcttagaccggaagccggcgcgggctgtgcgcgcctctcggccagggaaggtccgcaccgctgcgaggggtcacggtccgcgagctgcgcgcgtccgggcccatgggtctccatggcgacggcgggagcccggcagccggagcggggccgtggcgctccggggccctccgcggcagcgtggccgtgttcgcctccgtggctgccgtgttcaccctcacgctgccccgctcgctgctgggggagactcgggtaaagtactcgcaggccgcctcctccccgcgccctgctccgggtgcctgcgctcggtgtcccggccccgcgtccctcgctggactcccgtgccggttctgattccaaacagttctctttccggttctggatctggtctctgtgtatctcgagctgctcagccgatgaaatttaagcactgtccactttgcccggatcgtgttacctgtatcacctgtcgtgcccttacagtgtcacagacaaaaaaatagattgacagtagtaaacaaatagcatggagcgttctacatgtgtgtagagacgacacaacgggttattaactaaacaaccttttacagctaggtggtgagttacgagggccactagcggagcaacgtggttgccactggtaaatgccagtaaattcctccgaaaggtcgggaaagccaaccctgaaggtgtaatagcaacaccccggagtgtaagaggacccgcacggcccaaattcaacgggaacccccaccggaagacccgtgtgatcacccccccgcatgtaaaagataacccgttccatatgactaggtcatgtccatgggacatcaaaacacacgaagagggtgcacacacacaggagagagaatacccacacaggtaacagcg

SEQ ID NO: 637806 - DNA, 101 bp, Homo sapiens
gcgcgtgttgtttacgaagcgacacaagccttatcaagagcagccacaaagccagcgtcattgttgaatgcagacattaccagggcattgtattatttaga

SEQ ID NO: 637807 - DNA, 254 bp, Homo sapiens
tgagcgccggaccggaaaggtagctgtactggccatatagactcgtgcaatgagccaggcaagtggccttgagtcttggagataaaatcaacttgtcacagaagaaaactagtatataaaataaacaagaaagtccttgaagctttacagttcatttaggtatgggcttactggactccaacatcttttgtactctttcatgcttatatagaatctgagttcagtgctgcaatacttttcagccaagtaaattt

SEQ ID NO: 637808 - DNA, 831 bp, Homo sapiens
ggactcccattacgcccactgtgcctacgcccggggttgtgcttccttgcgcgcaaccacacaaggctgtgttggttggcctcccaccataggacggctggtcatctttttatgtcgtcttacacttcgtcgtggttaatttatggacgctcgttccatcgcagagagagtgacctttctctcttgccgggagtagagctatctagggtctgccccgctgtggcgtctacgtgcgcaggctacacacctcgcagcactctcgctggattcgcgggagtagtctatccccctcttcaacacgcccctaccactcatcgtgtggagccaggggcacgtcaccaaccctcactgtgtgcaggcacccattgtgtggtgtggggcgatgcggcgattttctcccccccgtgtgagcgcacacgctttgcacactgtcttgccaggaaattctccaccctcacactccttctgcttccgagaaacttgttgtgtcatctactatatcgcccccctcgcgcgcgctcgctttgtgcttagaggtcagagagataggtcctcccacagaagctactgggtgttatctcaccacacacaggaggggttctcccacagagaggtactacatctatctctccgacgggaacggccacaaggaggcacacttgtggagtccgcccggcatacaatgagaggggatctccaccgcaccccaggccgctttgccagcgaaccaaccacccaaggatcccaaggatcggaacccccgggagtaacaccggcccaatcgccccggctgccactcaggagcccagcgcaccccccgaaaacataaca

SEQ ID NO: 637809 - DNA, 420 bp, Homo sapiens
atattttctcatagaatatttttagcacctctctcaaaaatcactatggacatatctagtatcatctagtattttgccatatatctactctatattcattgatctgtgtatgtccccccaggtggtaaatatattgtcttgattactataactatattaataagctttgaaatcaggtacactgatagaagaggccccttaattttctttttccaaattgtttctagggaaaactaagttcctatagtcttttcagataaattttaggcttacctttttctgtatctagaaaaaaattcttggtggtgatatttgataggaattggctcaaatcttcggaagaattgaccttccttaactgtggtatgagtctatcccatctatagaacctgggtatgtttccccctttttgtttaccac

SEQ ID NO: 637810 - DNA, 791 bp, Homo sapiens
tgaagcagtgtgtcttcatggagaatccaaataaaaaccaggcacaggtcttataaatgtaagtggtgacgcagtggttttggttcgtgaatctgacttagaagtggtgtcatctcagcaatcctacattacgcaatgccgagtcatcatgtactgaaggcgaagttacagaccgtgaggaaaattaggaaaaaagagctcaagtaagtgaaattcatcaatctcgtgtattagtcatgaatttatcttcttagacttaaaattctggaacttgtatctgtaatacatcttaattcttgtaaacagaagacataatttatcgatagctggtgtcctttcagtcgaaagttgtaatactgtcgtctaaggagggaggaaaagattatgatataagttttataagctggcaaccatttgagtagtattgatttgtctaaaagaggcttgacttcaagtgggatgaaaatgtcagggaagtgagttaaagtagtacaaaatgctgttgacttagtaggaaccatacaattatgtcctaataagataatatttgattcctacaaataaggaggatttagtaatatctgagggaatggttgatggtgaagtaagactgtattgggcatagaattgtgtaaattgtactgtgaatggtacatatggctgcgaaaatgtcgattgtatacatagaaacggactttttctgttggagccaaagtggccgttgtaaacgtgaacttaaaatattaacattgcctgcgttggaacaaaatatttctttatcacatttatgg

SEQ ID NO: 637811 - DNA, 733 bp, Homo sapiens
cccacgcgtccggaaaagggaacacttctgcactactggtgggaatgtaaactagtacagccactatgaaaaacagtgtggacactccttaaagagctaaaagtagaactatcatttgatccagcaatcccactgctgggtatctacccggaggaaaagaagtcattgtacgaaaaagatacttgcacagacatgcttatggaagcacaattcgcaattgcaaaatcggggaactaacccaaatgtccatcaatcaatgagtagataaacgaaattgtggtatggaatactattcagccataacattgaaacaatggcatttgcagtaacctgggtggaattggagaccattattctaagtggagtaactcagtaatggaaaaccaaacattgtatgttctcactcataattgggagctaagctatgagaatgcaaaggtatatgaacgatgcaatggattttggggacttgggggaaagggtgggaagtgagtgaggaataaaagactacaaattgagtacagtacagtgtacactgcttaggtgatgggtgcaccaaaatctcacaaattaccactaaaaaacatactcatgtaaccaaacaccaccattccccaaaaacctatggaacatcagaaataacgtgaacttaatcagttttcaaaaactcaattcaagatggattacagacttaaacgttagacctaaaaccataaaaaccctagaagacaac

SEQ ID NO: 637812 - DNA, 275 bp, Homo sapiens
gaccttaaacttacccttatgaaggagcagggactcagcacagaattcactttaaacggggctgaaggagtgtccctcctctatgtgaaaagaaaatagttttattcttcattctgactttctaactgtatggctcacttgcagttcgcttgaatgaaagtactagatatgtactctgggatgaagaggtgaggaatgcgcagctcttatcatcgggacatgtaacatgcatggcctccgaatggacatcattgacattaactaccttctgagat

SEQ ID NO: 637813 - DNA, 884 bp, Homo sapiens
tctcaaagggaacaaaggcagctgccttaatggggggccaggggttgggctgattccagttaaagggccacacttttgtattcttggaatgtccccgtcagtgtgccatgtatttaatggcctcccaggttgagggggtggggaaatcttgattttctgttatccctattctgggcagttttgacggtccagtgttggcgcctgggtccgaagggtggatggcaccctcttctagcaacatcttcccgggtctgggaaggggaaaaacagcctcccgctggctcgtgccccccaggccccgcctgcctcttcgctggttggccccacagatgggttgtgggctgtaccccgtgggcgctgttagaaccgcagatggtgttgagaatgtgcgcagcgcagcaggtgtttgtgtcgtgctgtgttctattgcgcccagtgttccaggcaacaaatgtcttcttaagatgtacaggaagccaactcttctgctctacgcaatctgcagaagggccctcctcccagggtttggatcatccagtggttggctgggcaaccaagaaccaacaagccatgtattgattcccaggagtgattgtccccggggacagtgcgcccacagtgtgtcaaaaagacgggggaaatttacccccccaaaaattttgagcagattgaaggggaaaccacgggttcgtttttcgggaagattgggaaaaatgtggcttaactcctgaggatagaacgggggtcttatccctttgttggggggggtcaaaaaacactacatgggggggtaattattaatcgttacgaaggcgtgcccccaaaatacgcgcgtgttcgtgtagtttgcctcaacgtgctaattgggaccgcagttgtttggt

SEQ ID NO: 637814 - DNA, 339 bp, Homo sapiens
gtcgacattacaggtgtaagcccctgtgcctagccagcaatttcttctagaaagtcccagcagaggctggtgatggtgaatcacacctgtaatcctagcattttgggaggccgaggtgggtggatcccttgagcccagcagtttgagaacagcctggaacagcctgggcaacatagggagggacctcatctctatttaaaaagaaaaaaaagaggccgagtgcggtggctcacacctgtaatcctagcactttgggaggctgaggcgggtggatcacctgcgatcaggagtttgagcagcctggccaacatggtgaaaccctgtctctactaaaaatac

SEQ ID NO: 637815 - DNA, 528 bp, Homo sapiens
gcggcgctcagagatcccgggttgcacaaaggatgcattctgagggtagctgcccaggaccacctccaatgaaatattcatctgaaagtatgattgttgtttcagcagcaccttttgcagggccttggtacacttttccagaaccacttttcaggtcaatagctgggagaaataggaagaaaccaatgtgtatctttttctctccaacaaaatgagggtaaaataaaccaagtaaaatgcagacatttctatagtttccatgttaatgtggcacttattctacacatattctatctatcaattatacattatctgtcatttagaaaaaaagcaaaatatagaaatacaagaatacagaaatttgaggtaaagaagtggaacttccagttctgtagtggctcaggtcatggtctgcaaccaccaccatcaccttgagtttatagacacctatcagatcacagctaatcttatttcagaagtgaagaaagagattgtattcattttctcttagtggcagaattcattacc

SEQ ID NO: 637816 - DNA, 1120 bp, Homo sapiens
gccgtgtgcagcggggggtgcccggggtgccctggtggccctgggatggggaaccgcggtggcttccgctggaggtttcggcatgtggcatcctggtggcctgtgggtctgctggcctgtggacggggccggggccgaggccgcggacgcctcgcggagcgcaaggccgacggcactacaggagctggcatgccctgtcaccacagttgggccgccttgcgtcaaggcacatgaacgctcaatgttcccttgcgacgcgacgcactcctactcctcttctcctcccttgcccctactcacagcgacactcacgcacgccactccactcgcactctcccatctcctgggggtggccatcatcgtcagaggactgacggctttctgaacagaattagtggccagggtgtcaggaaggcaggaccccgctgcccgcgccccacgtccgcctccctcacgcgcttctcacccgcggccacctccccgctccggccctcctaccgcgcgcgcatcctacccccctgcgcccccccgctccgcgcctccctgcccgctgcctccccccgctgccctcccaccaccgcccgcgcctggcccccatctcggccccactccccgcctgcgcgcggccccactcccacttcccctgtgcccccacacgcctctcctcccccactcgcgctcccccccctgctttcgcccgtctcctcacctgcgcgctactccttcgcccgcgcgcacccccacaccgcacttccgcccccacccgtctccctccactcacccttgctactcccccttctgctcacccgcgctcgcacccccgcggccccggcctgcggcgcgcgtcctccctcccctgtgctcttcccccccccttcccgctcccccctggccctccccccaccgccggccccccggccccccttccgcctccttccctgcccccccggcctcctccctctcgccccccgcccctgccctccacctgccctgccgctcccgcgcctcctcccgccctccacctgcgccctccccctcttcccgcccccccgccccccctcaacccctgcccccccccccatgtccccctccccctcccccccaccgcccctcccccctc

SEQ ID NO: 637817 - DNA, 830 bp, Homo sapiens
gggtgcttcttttggcaaagtactatgaacgtctcgaagcagtattctaggtgatgaagaattcttaacatagccggaagcgcccgcacgtgtgttgcccatgttaggtgcccctttgctgtgtgaaaaatctgttctggtagctccacaagagatgatgatactggagcttttttaaatgttcttctacaatgagtctgtgattctcatgaatatggctctactataatggtccgtcaaatagaattctgccatctgaagccatggagcataagcagatattatattgtgaggtaaattataatagttaaagtgttaaaaatagttgggtgatttagaccaaaagattcaaagtctcctcgttggggaaatcctcgatctgcattttgattgtgtggattattgtggatggtgtccccgccgttagatgggtggtaaggtgtagtttgacatcgtttgatacgaggtaaatgctgatttgcaaaaatcatgaagagtttttaaggagtatcgactaagattttgtccgccctggcaactcgaggctgtgtgtccgtcatcccatcccccggttgtggagcctgctcgtttgagaatccgctgcgcaacatcaaggaggtatatggtcttcgttctgtggagtcagaccgggagtgactgggagtcccgatccaaggcggtgcggggcacacaaccggtgtgttgtgggaatgggccccaccatttccttgccaccccacaggaaaaggaagctgtgtctttacaactggggattgttttcaaacgccgggacgcattgggaaaacagtcagttttggcctacaaaaaat

SEQ ID NO: 637818 - DNA, 472 bp, Homo sapiens
gaccgtactcgctcgcaaacactctcctcaggaaaatgagcattgtaaacttaaaagtttcttaaaaaaatgcataccttgatttacacatattttggtaaaaaacctgtacaaatggaacttccaggacaaacaccaacactatcagatttctttctttttttttttggggaaacttagtctcatttggtcaccaggcgggagtgcagtggtgcgatctcggctcactggcaacctcggcctcccaggtggaagtgattctctggcctcagcctcccaagcaagggggcatacggggcaccaccaggcccagttaattttggctatttttaagtaaagagagggggtccaccatggtgggccagggagggtctggatcactggacctcgggatccggccggcagggcctcccaaaggggcggggataacagggcgtgaaccacggggccgggccagggatcataaacctcg

SEQ ID NO: 637819 - DNA, 854 bp, Homo sapiens
agcgggctcctcctccgctccgccagtgtccgtgccgcgggccggccttagtgactggtggcggcgtggccccggtggccgcgtggtgggtgcgggcagtgcggactgccggccgagggctgctgttcgtacggcgtcaccaagcttctcccgggatgctgagcagaccgcccgcgaagcctgccgatgagagcactccatcgcccgcgctccccggccgggcggcacgcacagactgaattgtgcagaaagcgtgcatggcctgaccgatcgaggcgacagacagaaagggcgcccccctgggaagagacggtgggagcgcccatcggttcccgggactcagccttatcacaggacacaggactgccagacttcagcatttttggacaccgagtagtgactgggtcatcacaagtggctcaagaacagacacaggcggacgcggcctctgctgtggcataaccaactggaggacgagaacctacagagaagaaccgcatgaggctttacaccacatgggcgacaggtaacaccggaagattctggatcattgcaagagaagatatcgctgtgcaggacgaacgagcgtgcaacacgtgcaggttaccagcaggaagttcgggaaggcaatttagataaaaggagactacagtggttatagccagttggaaaccagggttcactttgacaagggcgaaacgaccagaaattgggcgtgaaccttggacaacagcaagcaaagggaaataacacacgcgaagggcgtggttggtgagcagcattttgggaaatggccattgtactcccagggcatggagacggtctatctcaggatgaactgtggtgaggagaca

SEQ ID NO: 637820 - DNA, 793 bp, Homo sapiens
actagttctagatcgcgagcggcgcccttttttgtttttttggaaatggagtctcacccttgccacccaggcagtagtagcacgatctcgactcaccgcaacctccgcctccggggttcaggcagttctccgtgcttacagcctcccaagcagttgaaaccacaggcgcccaccatcacgcccggccaatttgggtattttatagtagagacggggtttcaccagttgcttggccaggagttcaagaaaagttttttaaaaataataaacctctaaaggtgttaccctaacggggtaccttacagctgatatggtgacttctctagtcactccacattatccagtggatggcacctagataataagtgcaccaaaagaaaagtaaagaatggcagacttctagaagcaatggatgaaatataatctctcagtggcacgaacatgatgatcggggtcattatgcaaagttgctttcctgccggtttttcttccaagttctgggcatggagcccaacacatccgatagcatggaagtggaagttaacactcccgatgaataattttgatacaaagttataaagcaaacccaatctattaacctttgttgtgcaaatgccactttaaacttctagacggtggatagtaccgcattagcgactataatccccttggcggtgctgcttgctcggaacttacgcaatgaccacgggtatcaccggtgattgcactattcccttacaccgcttttgccaacagaagcttccaaattttccagctcaggcttaccccaacg

SEQ ID NO: 637821 - DNA, 655 bp, Homo sapiens
tattgtataaattagtattttaaattttttaaagattcctccctttgtctgggaggcttaggagggcagatcacaaggtcaggagaccgagaccatcctggctaaacacggtgaacacccgcctctactaaaaaaaaccaaaaacatttgcaaataggtaaaggatgtaaaataagcaaagggcttgaatagatatttctccatatacaaatggccaaaaagcacatgaaaagaagttcaacatcactaatcatcagagaaatgcaaatcaaaactattatgagataccaccttatacccattaggataactactatcaaaacacagaaaatatgctctctacaggtgctgatttacccagtaaactcaaacaaatttttcgaaaagaaagatattgtcaattctaaatttttccttttgaaatgtataaatgtttcaggcaaatatttttataagtcttgtcctctttgtatcattcaggataattttcttcaaaaaatatttttacaagccaaaactcatctaataagatcctaattatgattacgttgaacattttaccagatgtagatgttacaattataggctttctcaatttaatttgaatagtgcgcaaataataatttggtggattaaaataaaggtctagatgttg

SEQ ID NO: 637822 - DNA, 797 bp, Homo sapiens
tactctctctacaaggttttttcctagtgtgcaaagagctgttcctcttcggactaacagttaagtattacaatggggatttagagggtctctgtgggccatcatgtctagagcttgaaactgaagcattcgtatctctggcaccaagccgagcgtatctacccactgctggtgtcgctagcaggtctgcgcgccgttatcaccaaggaatgcacatcgaagacaaacagatcgttgagaccttatctcctacttccacagtcaactcaggacgtcgatcaacttagcttgacaatcgggctagtctagacaccataccgaaccacctgtagcattccatgcgacatcgttgtcaccccacggccggttcttctcaaacagcgcaatacgtattatatcgtagctccgcggtccaatcaatccaacaaacattgaacaagtgaactaattataattcgacatgggatcatgggaggtacatacatcaaaagaacataagcatcttcacatttacaggcgttccacatacaactcattcgggcaagttcgcataaggcaatttaagtcaaggaagatatcctttttccatcgacaaggtttttctacatgcccaaaaggagtcatcattcattcgaaaactcggcaagacaattattcagtactacgagtaactgccatggaaggccgttaagttctattgaacgtgtaccattcggcttggcattacctggaggaaaggcggcccgtataggcacatccgagattcattccttgctccagacacttattgcacatta

SEQ ID NO: 637823 - DNA, 311 bp, Homo sapiens
gtgtttttactacagataacctcttacacttttgacgggcgacgccgcatctaccattagcagtgaggccagcgtttgctactatagtcagtatccttacttagtgtatgccactggttgtgaggttgtcccacgagtctgagtaaggaccccaagagctattcctgccctctctgtgacgtgtaaagagaagttttgtcctatgggaaggcttagggctggagcttgagtttgttccttccagtgcccagacttcagggttgattccctcctcaagcaggggacaacaaatgggtaacttgtttcccata

SEQ ID NO: 637824 - DNA, 109 bp, Homo sapiens
cgttactccgtgactcaacacgtccagaccacggctttgggggggggctcacggtctgggacgtgacgacacgggcacgggcccatcccatcaccccacgtactggaca

SEQ ID NO: 637825 - DNA, 304 bp, Homo sapiens
ttctacatgggtgcatatatattacaactgtatgccctctggtgaactgacccctttctcattatttaatgaccttctttatctctttttacagtttttgatttaaagacgattttgattgatataaatatagatactcctggtctctgttggtgtctatttgcaatgagtatctttttccataccttcagtttcagtctgtatgtgtcctcactagtagagtgagtctcttgtaggcagcatatggttctttaaaaagaaaatttattcagctgtcctgagtctcttggatgtagaaccgact

SEQ ID NO: 637826 - DNA, 333 bp, Homo sapiens
gaagaaaagaaggggaagaagatcaaaacccaccatgccccaggctcaacggcgcgctgatggaagtggaagagcgcgaagtcttacaggactcactggatagacgttattcgactccgtaaatgtactttgaactacctgacttattccagcactacagaagtgtgttttacttacccgaggcacagcacataaggttcgacctttacgtgaacaataggttttagattttgacggtgacaggtctccacctggtgttgaaaatgggagccatgttcccgtgataggtatcctttaacattaccagagatgtgattaatgtaactaggcctt

SEQ ID NO: 637827 - DNA, 409 bp, Homo sapiens
aactcactgaaggggagaagtagaaaaatgctacgacttatttatgcagaagacggtgatgatagaatttggttctgtatagatgatgggagagttaatagaagagactctatggccacatatacatttaatttagatcattcccactgtgccataaagagtagatttaagacgggacaaaactatatccacagagtaagctactacagttgtccatgtgaaaaataatgcagcatctgaaagcaggggaggaaaacagcaagagttcaaaaatatttaagaggtcaaagtaggcagaactagtaatgcattagatgcaaggtacagcagggaaatggagtgtttgaatttcacagggtcccagagagcaaacataggtgtttcctttcatcgatcggggtccgagctc

SEQ ID NO: 637828 - DNA, 235 bp, Homo sapiens
ttgaggatccgccctggtatcccacctggtcctcttccttcaagggaccatgaggactctattcttctccgtactgaggttctctcaacagaaagaagtcgcaagtgggactcctcatgccaccctcatccccaataggcaacaattaggccaggccttcgactgtcacctgagcgagcgggaccacagcacgccctcgtgaggaacagctaggacaaacaccctagcgcaggct

SEQ ID NO: 637829 - DNA, 839 bp, Homo sapiens
  misc_feature (839)..(839): n is a, c, g, or t
tctgctgccaacagtctctcctggcctcggagcttaacttctgtctttggaagttactactacacccctgaccttcagccagaatggaaggcaagatggggacacagaacgggtttatcatgacgacaaatacatatttaaacaagggaggagggcctggtttatacctctccttatccattcaactaaaaataaagtagttaattctgtctttgtgtcacattctttagaactttctatataaaatgaccccttatggttttattttcattcatttatcccttttgttgtctctttaataatcttctagattcttaaataataatattatgacagaccctggtctcctgcctctatttacacacctaccgcaatcaatcaacgcacactagatacacacaaccgcatactctccgtcttcccctcaccaactcccccaacttcaccctcctccaacccaacccacccactcacattatacccccataatccccactccccccaataaattacttccaatccaatttataacacttactctctccaccctttccaaccaagcctctcccccaccccacgtttttactttctaccaaccgcccccatctccgtcctccccgacctctacctcccatatatataactacttctcacctaatcctctctcattgatacttctcctcgcatcccgattctaccaaatcttttccaccctatactcccacttctataactcataattttaactaccccaacatcgacctaaagatcatattcatacattgcatatattataactacctattacctaatatatcttacctccacactccctcatn

SEQ ID NO: 637830 - DNA, 214 bp, Homo sapiens
attagtgcatactctaggcctggttctgctgctggttgctggtccatcagcgccgcttcactcttgacgtccaggactgttctgacctggtggagcacttgccagaggttgctcttccccaggagggatgggccctgtgtctcaggagtggggttgggggacagccttcagcagcagctcacacgctaccttccccagacttgcactggggtgg

SEQ ID NO: 637831 - DNA, 545 bp, Homo sapiens
  misc_feature (545)..(545): n is a, c, g, or t
ggtacgccgagtgacagagacgctcaggcggtgttctcaggatgagcgagtgggagacagcagcaccagcggtggtagagaccccagacgatcaacgctacttgggaagtggagcaccgatgatgtgcatcatcaatgacatttccctgcaggattgacatggcgagtgaaggagaagtatgccagagtacctgcctcacagggcagggcggtatgccggcaaacgcgttccgcgagaagctcagtgtcccgatcgtggagcgcctcactaatctccatgatgagtgcacggtccagcacacaatcggcatagaagctcatgactgtgcgctatcgtcaatgcatgcgcttcgaggatcagtacaccatgcatcactaggcggagaacgcctcatgcaaggtcctgagtgaagcgccagtcatcaagcatgtggtgccccgcggaggtactccatgacggcatttggcgctgcgcacggagactgtcgagaacgaacagagactcgtggattgtggtcacgcaccctggcagccagtgatgaacn

SEQ ID NO: 637832 - DNA, 242 bp, Homo sapiens
aaaaaaacaaaaaacaaaaaacaaaccacattttttttagagacaagggttttgctatgttacccaggctgaactttttaagtagaggtatactcaacataacaatgaaaaggtataatatagtaaacagtaaaccacagtaacatagtaattttttgtcattataagtagagtattatgtagtgtacataattgttctatatttggatatgactgtcacatactaggttgtttataccagc

SEQ ID NO: 637833 - DNA, 117 bp, Homo sapiens
tgcgcgttccaaaactgatggaagcaatctgtttaacaatctcagacaggactgtgcaagtcacatgagtcgcttgtggggggctcatcttggaaaggatccccacgtctttagaac

SEQ ID NO: 637834 - DNA, 441 bp, Homo sapiens
gggtgttcacggccggctagacattctgtgctcgtgcaggaggagggctgctaccatcagggacgtgcacgatttcccgcgaggcgataaccgaaggattggcgaggaagtactataatagcaagagttgagatggatacgtgctgggtactgaaaggagagaaagggagcggcggcacaccacggctagcgcgctcgcagacgcaacaaacaggaccaggtgcacgtctaagggccggacaggaaagaagggcaaggtgagaaggagcggtcgggactgacgaccaggaggcgatcccacgaatcatgaaagcaaagagagcgaaccggaactgaacagaggcccgtgctgagaggagatcgaagctaggtcccgagcgaggcaggagcacttgcgccgtactacaactgtagagacagaagagacagagagctggccac

SEQ ID NO: 637835 - DNA, 220 bp, Homo sapiens
atttaagggggggtcctcctcaggacagtctggaaagtccatggcctgatgcaggttctctgtagcttttccccttggtttataaattggaaagcaacttgaggaggaaataagggacaataaaaaggagccatcaaaagagggtagtaattttctcgaacggggaaggaaaacacgggagtaataggagaaattatagcttgctttggtcaaggatttt

SEQ ID NO: 637836 - DNA, 108 bp, Homo sapiens
aggggagcgtaacaacccacccggcgggcctaatgcgccccttcaggggcggtctgtagcgggttttttccttccccactgggcgggttttacacgccaaatcgataa

SEQ ID NO: 637837 - DNA, 204 bp, Homo sapiens
ctactacagaagtacatgctgttgtcttcgtgtatgatatgaccaacatggctagttttcatagcctaccatcttggatagaagaatgcaaacaacatttgctagccaatgatataccacggattcttgttggaaataaatgtgacttgagaagtgccatacaggtacccacagacttggcacaaaaatttgctgagtccacta

SEQ ID NO: 637838 - DNA, 577 bp, Homo sapiens
cctctacggctccgactacagcgtctacactcacagctacctgtgctttggacgggaccagatgctgagcaggctcctcgtggggctggtgcagagccgcccggctgccctgctccgtcacccgtgctacctcagcggctaccagaccacactggccctgggcccgctgtatgagtcaccctgtgtccacgccacgcccccgctgagcctcccccagaacctcacagttgaagggacaggcaaccctggagcctgcgtctcagccatccgggaacttttcaacttctccagctgccagggccaggaggactgcgcctttgacggggtctaccagcccccgctgcggggccagttctatgccttctccaacttctactacaccttccacttcctgaacctcacctccaggcagcccctgagcacggtcaacgccaccatctgggagttttgccagaggccctggaaactggtggaggccagctaccctgggcaggaccgctggctgcgggactactgtgcctcaggcctgtacatcctcaccctcctgcacgagggctacgggttcagcgaggagacc

SEQ ID NO: 637839 - DNA, 166 bp, Homo sapiens
cccccagacctgagatcaagaagacccgtgtgaagctgccctccggcaccaaggaaggttatctccctcaggccaacagagctgttgttcgtgttctggcttgtaaatagccttgtggacaaacccatcttgaaggctggccgggcgtaccacaaatataaggcag

SEQ ID NO: 637840 - DNA, 359 bp, Homo sapiens
gccatttttgtgttgctataaatacccgagactgggtcatttataaaggaggtttaattggctcttggttctgcaggctgtacaagcatggcaccagcatcttggctgggcttctcaggggcctcagggagctttgcaagcacatcacatggcgagagggggagcaaggtgcggggaggtgccctacaattttaaataaccagatctcgtaagaacttactcattatcacaaagtcgacaccaagacatgatggatctgcccccatgacctgagcacctcccagccggccccacctccaaccttggtgattacatttcaacatgagatttggggaggacatatcctcatatctggtggt

SEQ ID NO: 637841 - DNA, 117 bp, Homo sapiens
tcaaaacctgatcgctattaacctgtctggtttgtgtctgtagtgatgaatgatctcgagctgtggtgagggaggtgcacttggtgtatcagtgcttttgaaggtgaatttccttgt

SEQ ID NO: 637842 - DNA, 1114 bp, Homo sapiens
  misc_feature (241)..(241): n is a, c, g, or t
  misc_feature (472)..(472): n is a, c, g, or t
  misc_feature (705)..(705): n is a, c, g, or t
  misc_feature (997)..(997): n is a, c, g, or t
ccatactgtctccttgttttcggaagagcgtagataggaaggtggagctctcccaagttgtctagtgcgtagctgagtggggtactaggtagtacttgtgcatacatagtgcagtacggcacactaacacagctagaggaccctcgtgctcggtgcataccgtcacatacggacacgtgtgatgatgaggcgctccaagtaaagggcatcttgtctatgcgaaatagattgctcccatganaatattcctaagcgtgcagaagtagctacttcgatgctttcttggtcttcagcaggcgttgaggattactaagacgcatcgagacaacgaggactaagacgtttcagtatctcagtagatagagacactagacactactacatagcgggaagagcgcgcgagctcatctcgtaatcgggattaaatccccgtccgagtgcgtgtggcccctcatcgctctatcacgggttntatctcaccgcggtgtcctctatgtgttcgcatatggtgtgtgtggagctcccactatattgctgtacaggatcccgagctaccctcctgtgaccgattatctataattgggtaccctccgtcgggccgcagatagcgatctattctgctcacagacaaaaaggccatgctgtcatggtaaagcatccgctgcgggaaacagcttataccctaagggaccacatctgacacantgtgcaggagagaaccagccgctacttaagcaagcagaaaagaagtgggttgaacaaccccgtgtttacgctataccacgtgatgtgtggtgttagcataagctaagatgtcaatatgggtgggagtaactataagaaatacttatgactcgcgttaatctggcgagtggacactctattgaaaagtcgcgcataacgcgtcaggacggtggatatttcgaaactattgtataggcgcatatgtcgatttaaaatgcgggttaggatgaaaatagggtggaaaccgattaanggcggacttataactaagcaggatggcaactctgactattggcaactgttgcacgagggattgttatgggaagaaaacgcctttatttgggccaatacagtcgttagtggacaaata

SEQ ID NO: 637843 - DNA, 437 bp, Homo sapiens
gtttccactagcatattaagtgaatgcttagcaaggtttgactgtatgctggtttatgtcagaaggtgatattgaataatgcttgatgcagaaccgaaacttctcatttatctgtatattatgttaacttctaacggatatatgcacaaatgggcacatttttcgtttaaagtgaactacagctgtactgtgaagagagttctatataaagcctgtaggtccttttaactttggtttaaaatgtaagataggaacatgttggatatttcaggccacgcttcatatatttctattgcagtatccttttagatgcagataaaaaaaatgcatagctataacagttttcctcatataaagtccttactaatatgataacgagcacggtgtaaggtgcttgaacacaacagcgggaggcttataggggtaccgagcgcgaa

SEQ ID NO: 637844 - DNA, 884 bp, Homo sapiens
ttcattgccccacaaacctagagcctacccgccggaggtagctgatcattctatttccccctctattgatccccacctccaaatatctcatcgacaaccgactaagtcacccaaccaagcaagtgactaatcaaactaacctcaaaataaatgataaccatatcatcagacgatctaataggaccgaacctgagtctcttatactagtatccttaactcattcttattgctcaccaagcttaagcctcctcggagtcctgcctcactcatttatcgaagccaagccactccaactatctattaacctagtccatggcatccccttatgagcgggcgcagagattataggcgtttcgctctaagagttaacaaatgccctagcccacttcgttaccacaaggcaacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaagcttccctctacacttatcatcttcaccgattctaattctactgactatcccttaaaaatcgctgctcgccttaattcccaaggccctacggtttttcacccactttctagttaagccctctaactgtcacgaacaacccataaatgaacccaacccattcacattgcctaatcaaatatttaaaaaaccaaacccattgaaccccttaacaaggggcccttctcagacctccctaatgaactccgcctaacaatgtgattcacttcacatccacaaagcctcaaatagccactaacaacctacattcccacaatgcgcgta

SEQ ID NO: 637845 - DNA, 325 bp, Homo sapiens
ttttataaattacccagtctcgggtagttctttatagaagtgcaaggatggactaatacaaaccactatctttcatgaacataaatgcaaaaattcttaacaaaatattcacaaattctaacaatgtataaaaaggattttaaattgtaattgcaaccaagtgggatttattccagatatgcaagtctggttccacactcaaaaatcaatttatacaatatattgcatcaaaaggctaaagaagaaaaattatattattatgtcagtagatgcggcaacgtacctgcataattcaatactcattcatgataaaaaaaaaaagtcg

SEQ ID NO: 637846 - DNA, 630 bp, Homo sapiens
aaccgcattcttatgggcaaaaaacccgtgtccaaagaatcaagggagttaaaaggccagcttctcaatgggtcccaattgttgcatgtgagggaaaggcaacctcctctcctctattttttttacgatggcacacactcagggggtgggcctgtttcgtggcccaaactgtggcatttcctttgtcactctggattccagtgtggagacttctcccttatagggtgcacgctccacaggggtaggtgtgcaagtccgatctcgcggctttatacgtttgtaaatatattcagcagatggttttcgaggaataagcttcacatctcctgcagtgacactgaacactccgtcttcatataccactttgcctcttgaaatagtcacaaggggcaccccgtgcaaaaccatgccctcgaaaatgttgaagtcaacagcttgatgatgagtttttgccagcatagaccttgcgctattagggtcgcacataccggtgctagcatgggctggcacagatattctacctaagagcgcatatcaatgaaacatgttgcaatgcgtttgtgtatgtacactccacagaaaacagatctcattcatgttggctacatgcaaaaataattcccagttgtc

SEQ ID NO: 637847 - DNA, 977 bp, Homo sapiens
gctcagataccccaagcaatacctgcaatggaggattcttcccggggtagaccgctagccccatcggtcatggctcacgagttgtgaactgcaaaatccagcctgtagaaacggtggttgtgtacatcaagcccacctgcccgtactgcaggaggtgcccgagatgatcctcagtcaattgcccatcagacaagggcttctggaattgtcgatatcacagaccaccaaccaaactaacgagattcatgattatttgcaacagctcacggtagcaagaacggtgcctcgagtctttatcggtagagattgtataggcgggatgcctgtgatctagtctcttttgtcaatcagacggggggcgaacctgactggagcgctggactagaaagccaggattgtgagctctgacgagataatccaccaggatctctatgagtgaagatgttcaccaattctgtgaaaggtctgaggacccacattggagaacatctatttgaaaagcctaagtgggttctctggtgtcatatggatctagaggcaacaagtgcctgaaggctgtgtgtcatgcggaaatactctgttatgttagagatggctatccaggatcatcctgatcactgtggatcaatgtcatttaagactaccagcaatgattagtgcctgcattgtactccgtctgatttaatcgttacaggcccctacactaggaggtgtctctgttgacgagagtccttagcttgtgaacacttcaagaatcctttatcatggaagttggcgggtctagaattggggattgttatcttcagccctaggacaagactaagggtttccattaaaaaccataacggtcgtgttggcatcttccggtccagaataggagttgcgaacacaaggggttgcgccacaaaaacgcggggccgcggcaaaagaaaagggcccgaaaatggcggaagattcttggacaccactggatccgc

SEQ ID NO: 637848 - DNA, 689 bp, Homo sapiens
aaacacaaaaaactaagttgctttctttttttcaacactgttactacatttcaactctgcagaattgctgcagagcacgatattgaaagtttcaatgtcgtttagagggagggatgtgaattatgaactcgtatgtgacaataaatgaccaccaagtactacctgacggggggcacttttcactttgatgtctgagaatcagctcaaggcatatgcacagttggcagagaaactgagagaaaagggatggagaagagaatactcatttatgtccagcgtttttctttttaagatgaacttttaaagaaccttgcgagttgcgcataatgacgttataacctgtgtgatattcctgcaccgtttatccaataacattgtgggcaaggtttgggggactgaacgagcctaaataaatgtagcaaaatttctttttaaacttgctaaactctatggcatttataagcgtatgttcccttcgaaattaaatttgggctttctaccacatgtgtcaccggcccgtcattgccggctcttagagaccctcagaaatttctttagagttcatgccagagagtgccctaaagacacttatatatgtgagcgagagtttttttaaacaataccttattaatcgccccattaaagggattttacaaaggccttttttttctatttcaccaccgacttgg

SEQ ID NO: 637849 - DNA, 860 bp, Homo sapiens
actcctgtggtccgcggcattgtgcgcccgtggttcgcctggggcctggatctatgttcccccgcgcccatgtccgtctcccctttgcagggattccccggggtctttagagcgacccaatttccccgagcggggccaaatcggggtatcccgtacctggtgtagccgccctgggtgcgggtaacccccgcgctggttgccctcccggggacccctggggcatctatgtattggacagttcccggcattccggggcagcccactttctctgggcgccgctacccccccgttgtgcgattgtcagagagtcggagggcccccatctccccgaatctcgggcatggcccttcttgctgtgacacctatccggcaaccagtcctattgggggccctccacctataaagcgttccatctgggggctccccccccagccctcttggcatacagggcgtgatctccgagcttgttccttcccctggtaaggacagcatcaccctgttggaaactgtcacttcgacacactccacgcccttgttccccatacctccatcacgttgactgcggcggctgtgtcccacccgagggtcggcccctcttggtctcccaccgctttgaggaagagaggtgtgtacatctgagcaccagagtgcggtcaattttatgattggcctcctccccaacacaggtcgaaacaactcgcctctgacaaaacaccctggggggccgaagatcatgtgaaccagggaaccattatacggtaaatgccagtattgcacacatccatcgtcgtagttttccacgagcccccccgcctttttggaaaaccccccttgaaaacgtttttcccaccacaaaaaca

SEQ ID NO: 637850 - DNA, 952 bp, Homo sapiens
gaatcgatgtatatagtattgaaggacgaacaagggcaggatgctggcgggctcctgcgggagtggtatatgatcatctctcgagagatgtaaccctatgtatgccttgtccgtacctcactggtgatcgagtcacctaaaccatcaatccatcttcccactgcaaacccaaccacctcagctacttcaagttgtcggaccgcatgtggccaaagctgtatatgacaaccgtcttctggagtgctacctttactcgatccttttacaaacacatcttgggccacgtcacgtcagatctaccagactctgcgagaggtgacgcattaccacttactaccaaggttcttggtttatctgctgccaccaatgatggtcctccaaactttcgggcttatgaccctcaacctattcaacgcacggtccaggtccacacgaggatggacgctacggcgaagtacggagaccctcaaaacccaagggggcccaacaatccttggccaaccagagggagaacataagcaccggaggtaatgcacgccccgggatactgcccgaatgacgacctgcccgcacgccataccggaaggcgaggagagcgggctcttacaccgcgccctatgcactcaatccgaacagacactaaacgcaatcacaacatgacacacgagatagaggtgccaaaaataggcaggccaccaaagacggaaggcaggcagtcgcacagggaaacccaaagcacgacacaacaaacaggacaaggggggaagactggccaacgcctgagcagacggcacacaccaagacggcaacaacgaacggaaggaagagcagaagaggagacacagaatagagcaaaacaacaaacggaaaaaacaacacaacaacgaaaaaagaacaaattcatacacgatcagtgaccaggagacagcaagagggagacaagaacagacag

SEQ ID NO: 637851 - DNA, 769 bp, Homo sapiens
  misc_feature (485)..(485): n is a, c, g, or t
cgccccttccccaggcccaccatcaccaccgccgtctggccaaacaccccatcttccacctgtgccctcaccaccacactacacagcacaccagccgctgcagggctcccatgggctgagtggggagcagttttcgccctggcctcagttcccgagctccaccccgcgcagccagcgtcgatagcgacaaatggcgctactctggacaaggctaaaatggcacttagccgctccctgcaccgtgtctgtgtacccaactgcctcttgtctggtggggacagtcgctctctgggcttgaggtctgtggtgggctgcccttctcgtgctctcttcgactggtatgcccctctgtgattccctatagtggggcctggcgaggtggttcgccctggccttgtacaggtgggcccagagcctcgtagtctcatctcgtgggcacgcgcgcataggtctactgtcgctggcagcagagggtgtggccaacnggagggtggggtgactggcctcccaggattccccccagcacaaaactgtctttgtacaccacgtggggctcacttattcatccattccccaagttccctagatccccgtactaggttggacagcccccttcggtacaggaaggcaggaggggtgagtccctactcacctcttcatgtggcaaagccccttggcctcgactgggatctgagtacttattgtggtgaggagatgagcattaatggccagggagccgaagagcctggtggcggcactgaagggggtg

SEQ ID NO: 637852 - DNA, 219 bp, Homo sapiens
actatacgacggctgggaatggggaaaggaaggagaaggagagactatgttaaaggatataaaattccagctagagaggaggaataagttttacagtctacagcactgtgggatgactataggtatttaataacattcatatggctgggcatggtggctctttctcaatacagtataaaggcttccctgagtctctcagacaggcctgttgaagcatct

SEQ ID NO: 637853 - DNA, 102 bp, Homo sapiens
gtgtgtctctagaggatccgtagcgtcagccaggacatgcacacttcccaggtttcatgaacttgcccatttctggcatgcaaccaccctgggcctacatgc

SEQ ID NO: 637854 - DNA, 533 bp, Homo sapiens
ctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttggacccgggaggcggaggttgcagtgagcctggatcgtgccactgcactccaacctgggcagcagagcaagactctgtctcaaaaggggaaaaaaaaaaatggctgatgtgacccatgaaggggaactcattttcctcgtaattttggactggccacacattggtgtacctttaggttctctgacaggcccacggtttttatcatttaagacctattggtacagctagtagaagctatcaggtacgaggtccatgaaaccttcggtaaccacagggactacaagtcgtactttctctatggaactcataggtccagaatagaagatgtcatggtacactttattcccctacacacgtggtattgccctggatggtgca

SEQ ID NO: 637855 - DNA, 363 bp, Homo sapiens
ttaataggcagtaaaaaaggttatggtttattaatggctggacacccgtgggaaaacaaataagcaattggcaccaccaaattcttattacattcaagataaaagatttattcacaccacaaaaggataatcacaacaaaatatacgctaacttaaaaaacaaatgattattgtgacataaaagggtatattctctttttaagtgggtaaaaggattctgcttgcttatacataaatctttattcatgagagaataacggatattaaaatacggtgatagtttgcatttgttctatagaatgaacatagacataaccctgaagctttaagattacagggagtttccatgaggccacaaactaa

SEQ ID NO: 637856 - DNA, 192 bp, Homo sapiens
tcgagctcgttacctgtgcagacggggtctcatggagagggtttgtggcgtaaggagagactggcagtcatcacctagagtggtactctgaagcctcaagaggagacaagatcacatggaacgccacggacagaaccatgtggagcaccattctcatctaggtaggagtccgcaaagaaggttaaaaagaaa

SEQ ID NO: 637857 - DNA, 1825 bp, Homo sapiens
taaccccgccgtccacctgggaacacccgcgctcggtgccttgtcggtgacgctgcagcgccgagcaccagggccgaaaggggtccacagagcagccgcggacccccgaaaccccattgcgcccggccccagagacccaccaccaggtcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccatctccgcgcgctgcgagagcgccaacggtcgcgcggggggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccaggtgggcggtcgccccgccccgggagcgcggcttaatagctgagagcccgggggccaggccgcggctgcggcccaggcaacgccctgagggtggccacgctgccaggtgttccactcccccgggactatgggcaagggcccggggcggggagggcggcaggtgctgacactggagctgcgccggaggtcggggaactcggcctcctaagactgaggacactcgcctgctgggccggtcgagctgtgcggtgccctccgggacgcagggggcgctgcagccacgctgggtcaggctccgcagggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctgggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccaaaaaaaaaaaccacaacaccaacaccccgggggcctctacccggggccgcgcaccacaccg

SEQ ID NO: 637858 - DNA, 2167 bp, Homo sapiens
  misc_feature (1975)..(1976): n is a, c, g, or t
taaccccgccgtccacctgggaacacccgcgctcggtgccttgtcggtgacgctgcagcgccgagcaccagggccgaaaggggtccacagagcagccgcggacccccgaaaccccattgcgcccggccccagagacccaccaccaggtcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccatctccgcgcgctgcgagagcgccaacggtcgcgcggggggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccaggtgggcggtcgccccgccccgggagcgcggcttaatagctgagagcccgggggccaggccgcggctgcggcccaggcaacgccctgagggtggccacgctgccaggtgttccactcccccgggactatgggcaagggcccggggcggggagggcggcaggtgctgacactggagctgcgccggaggtcggggaactcggcctcctaagactgaggacactcgcctgctgggccggtcgagctgtgcggtgccctccgggacgcagggggcgctgcagccacgctgggtcaggctccgcagggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctgggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccattttgtatcaggtgtgttgctggccaggagctgatggctcactgggctcttggaggggaatgtgaagaaaccaaggagtcactttttcatctagattacttaggattccttgacttttcagaagtcgggaagcagtatgtttgcctgttgtagacctacttgctcacatgcagatttgagaggacctcaacggcttttctcacaaaaaaanngattgtttctcttctcccgcgatggagtctcgctgtcgcccgggctgcagtgccctgccggtgatcttggcccactacaaactccacctcctggattcaagcgattctcgcgcatcagcccggccaaggggtcccgagcccgaatccgtactctgtctagcccctctcccacgccccccccccgccccccc

SEQ ID NO: 637859 - DNA, 584 bp, Homo sapiens
agatgctgcagagtacccagaggatgcagagaacccacagctaatttttggtatttttagtagagacgggctctactaaatgttagctaggctgggacttctgacttcaggtgatccacctgcctcagcctctcaaagtgctgggattacaggggtgagctgccgtgcctggctccaacttttcttctgcatcttcctcacctctctcagccttcatagaatggaagaaaactggggccgggttctcgattaggcttcagtttaagggaatgtggtggctggttggatctaatcagaccactcatactttccacatatcaccaataaggatgtttcactttctttccctccctccctcttttttggagactatggcccaggtgggagtgcaggggtatgatcatggctcacggcaacctcggcctccggggtgcaagcaattctctggcctcaacctcccgagtagcggggataacaggtgtgcagcatgtgtccagctaattttggtattattagtagaggtaaggtttcaccatgttgaccaggctggtctcgaactcctggactcaagtgatccggccgcc

SEQ ID NO: 637860 - DNA, 259 bp, Homo sapiens
agagttcccaggcgcagatcgtcacgccattctctacctctagcctcccgagcagccgggacacaggtaccgcaacacgcctggctaattttttgtatttttatgtagagacaggtttgcaccatgttaaccaggctgatctcgctcctcctgccctcatgatccgcccgcctcggcttcccaaagtgctggcattacaggcgtgagccacagcgctcagccagaaagtctatttctttcctgatggttctccaaggac

SEQ ID NO: 637861 - DNA, 972 bp, Homo sapiens
ggcggccatggcagcatcttccctgacggtgcaccttaggagtcgggtggcgtccgcgtgcagccacagacatcctgactaccttcggggccctggatacagacctccctttggtctgcttctcgaaagttcacattcggcaatgcagccacattcttatatctaccaggatatgttacctaagacatccctgagttcaccatcctttgtaccaagtaagtagtactgcccagacccagttgaggagacccaggacaccatgccaagaaggtcgtgaagaaggtgaatgtagatgatcgtcaccggggcagtatgggccaggtctcttttgtccgttgggtgcaacttagccgagaccgactagtggataggttgacctcttgtaagacctgatcttaccacttggaaatgaacgtagaccttgcgtgtggcgagagaattcgactggagaacggtcctgctgatagggtgcacgacaatttcatgctgccttggaaagacactcctcgggaggatggatcttgtcgagtagaagccacagtcattgaaaagaccgaatcatggcaagaatcattatgagatccaccgacaaggacccctgccgaagaaaagaatcgtccgaacccgcagactgtcctcggataacgaccattgagatggctccgggtcgcggattaccgagttatgacttacacagggttaggataacttctgcttcccaggacggacaacgggacacacaaaaaacttgggcgggcctcggccaaggaactctacaaaccactgtgtgggcggcgggccccgtgaaagcgacactggcacttgtgccgacctcgtgtcagattgtgggtgccccaaaaaagctcgggacagtgttgacacccacggtgggctggtcacaagacgcgctagcccccgccgagggcaggtcatgggaacacgcttatccctcccaccgcgtgcgcttccgcc

SEQ ID NO: 637862 - DNA, 2051 bp, Homo sapiens
taaccccgccgtccacctgggaacacccgcgctcggtgccttgtcggtgacgctgcagcgccgagcaccagggccgaaaggggtccacagagcagccgcggacccccgaaaccccattgcgcccggccccagagacccaccaccaggtcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccatctccgcgcgctgcgagagcgccaacggtcgcgcggggggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccaggtgggcggtcgccccgccccgggagcgcggcttaatagctgagagcccgggggccaggccgcggctgcggcccaggcaacgccctgagggtggccacgctgccaggtgttccactcccccgggactatgggcaagggcccggggcggggagggcggcaggtgctgacactggagctgcgccggaggtcggggaactcggcctcctaagactgaggacactcgcctgctgggccggtcgagctgtgcggtgccctccgggacgcagggggcgctgcagccacgctgggtcaggctccgcagggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctgggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccaaaaacacacatacaccccacagcacacacacacaacaaacgggtgccccgcccccaagaacatatactcccctacaggggggtcgcgcccccaaatcacattaacccacattaaccgcacggaaattcatcgtagcacaccaacattgttgccccctataacacagtgggtagagtataataaaacacaagtcattactctagacacgacgtgtctaaaccaatgttgtgtcctggggaaaacatagtcgtaaacatcagagaaaccatctatcacaagaacgaccc

SEQ ID NO: 637863 - DNA, 110 bp, Homo sapiens
gtgagaagctgcagcggtgacctggaggctgcgatgtggaggtggaggacacaccctcaaccgttgctcctgtagcttccgagtcctggtggtgtcggccaagttcagta

SEQ ID NO: 637864 - DNA, 1388 bp, Homo sapiens
taaccccgccgtccacctgggaacacccgcgctcggtgccttgtcggtgacgctgcagcgccgagcaccagggccgaaaggggtccacagagcagccgcggacccccgaaaccccattgcgcccggccccagagacccaccaccaggtcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccatctccgcgcgctgcgagagcgccaacggtcgcgcggggggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccagggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccaaaaaaaaaaaccacaacaccaacaccccgggggcctctacccggggccgcgcaccacaccg

SEQ ID NO: 637865 - DNA, 116 bp, Homo sapiens
gatgagccggccactaatgaactattagtagctggtccctccgaagttcctcaggatgtgtgcgtcgcgcacacatctcagtagaggtataactagtctgactaaggacggtctgt

SEQ ID NO: 637866 - DNA, 1949 bp, Homo sapiens
taaccccgccgtccacctgggaacacccgcgctcggtgccttgtcggtgacgctgcagcgccgagcaccagggccgaaaggggtccacagagcagccgcggacccccgaaaccccattgcgcccggccccagagacccaccaccaggtcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccatctccgcgcgctgcgagagcgccaacggtcgcgcggggggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccaggtgggcggtcgccccgccccgggagcgcggcttaatagctgagagcccgggggccaggccgcggctgcggcccaggcaacgccctgagggtggccacgctgccaggtgttccactcccccgggactatgggcaagggcccggggcggggagggcggcaggtgctgacactggagctgcgccggaggtcggggaactcggcctcctaagactgaggacactcgcctgctgggccggtcgagctgtgcggtgccctccgggacgcagggggcgctgcagccacgctgggtcaggctccgcagggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctggtgagcttggaccccgcgccctcgaccatccagccccctagggccggcgactgccagcccagcaccttccggcctctcgggctgcccggcccggccccgcgcccctgaccctttccctccgcagggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccaaaaaaaaaaaccacaacaccaacaccccgggggcctctacccggggccgcgcaccacaccg

SEQ ID NO: 637867 - DNA, 320 bp, Homo sapiens
  misc_feature (267)..(267): n is a, c, g, or t
ggcctcttgttgggacagcgtcccctcggagcaagagcccggggcgtgtggccgcctcactgtgacctccggccgtgcaggcctctggggagggtggagatgttttccccttctcagagcacgcaggtgttacctgcccacagagtaggaagtggggtgctgtcacctgcaccgcacaggtgaggaagctgaaaacccaagacccaagccatttggtctcactctggctgaatcacctggaggctttgggaaacagattttcttccnccttccagccttaccgccaccctcctctgttctagaagaggcaagaagaagcg

SEQ ID NO: 637868 - DNA, 909 bp, Homo sapiens
gggtggcccggaccgctatgctccaagagagctcgtactggtaccattgctgacaggttggctttactgtgactcgtcggacttgccagatgctcctgcagaagatgtcagtaatacaagggcgcgcctggccatccggtacataatgttattgccaagtaatcaactgccagcggcaagtgccgagccttgtggacactggctcgcttcatgcgaatatgcgagtactgtgctcaccattgtggccctgtgcaccaatgagccccacctggtacaaagccaaaaacaatggtgggccgtgcagggcatcatcccagtccaactacgtccacgaaagcgtggatggcgcgatgataggcgggctaccaaactcagccgtcatgccttgcgattccatcggcaatcgatcacacggggagcaggctgagcgggttctgtacccgccggaagactaggcctagttcctggtgcgggagagctaccaactaccccggaaactactatctgctgtgtcggtgagactgcgatcggcatatggtggagcatctaccgcagtcatgtaccattgccatgaatctcagacactcgacgatggaggtgtactttgagaacctcatgcacgctgttggagcagtagatctcagacgcagatgtgactctgtacgcgcctcattatgacccagagggtcatggagggcacagttggcagagcccaggcactgatgttgctaccgaagacggtttgggcccctgacacatgctagggagctgaagctgctgcagaccatcggggaacgggggagttcggaaaacgtgatgctggggcataaccgaagggaaacaaagtcgcggaagtgtttaaaaagaggcatgcccaagctactggtgaacctcttatgccaattgggc

SEQ ID NO: 637869 - DNA, 159 bp, Homo sapiens
gcccacgcttataaactgggaatgacacgtcacaaaatcagttatagagtgctgctgatacagtcatcattcattctaaccacgtatttaaaccgagaagattgcatgtatgttctgcctgtcaaggaaaccatggcataaattgtgtaaaatttgaaa

SEQ ID NO: 637870 - DNA, 1008 bp, Homo sapiens
taaccccgccgtccacctgggaacacccgcgctcggtgccttgtcggtgacgctgcagcgccgagcaccagggccgaaaggggtccacagagcagccgcggacccccgaaaccccattgcgcccggccccagagacccaccaccaggtcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaagggggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccaaaaaaaaaaaccacaacaccaacaccccgggggcctctacccggggccgcgcaccacaccg

SEQ ID NO: 637871 - DNA, 172 bp, Homo sapiens
  misc_feature (119)..(119): n is a, c, g, or t
  misc_feature (137)..(137): n is a, c, g, or t
  misc_feature (154)..(154): n is a, c, g, or t
gcggcggtactaccagagaaccttatcaaaccatttacccatattaagtattggcgatagaaattgaaatctggcgcaatttatattgttccgcaagggaaagatgcaaaaattcattncctagcattatattgtcnagggactaacccctatnccttctgcattatgaatt

SEQ ID NO: 637872 - DNA, 418 bp, Homo sapiens
agagagagagagagagagagagagagagagattgagatagagcgagagattatcctgcctgaggattgctcccccggaggctgtgatctcccgtaccctgtcgcagctgtgtgtctgactgttaaggctccgcactgtgtgcgttagacgccttagtatggcaccgtttccagacagtctggtgggatccatcattaggtgctgacgcccaggtgttatctctggctctagtcccatgtttgacggacttacgaatagtgtgaatgccatggaggaagcctccattgttccctgtacggccttttgctgtatcccatcttgtccttgtcttgctcctgttacttctctcgcgtcctcacttgcttatcctttttcggtttcctctgttgcgttctctctgctccgctctccgtcgcct

SEQ ID NO: 637873 - DNA, 420 bp, Homo sapiens
cggagcatggagagacagagagagtgacgtgggagggctgcaaggcttttaaacaagcagatcccacaagcgctcactcaatatcacgagaacagcaagggggaagtcgtgccccatgagccaatcacctcccaccaggtccctcccacaacactgggaattacaatttgacatgagatttgggtgtggatccagagctgaaccatgtcaagggtagttcaaccgctgagattgattgattgattgattgactgagatggagtcccgctctgttacctaggctggagtgcagtggcacaatctcgggtcaccacaaccagtgacaccattggtacttatttgcttctacctagtgactaaaggaatgaatgagtttctccagagactagagctccaccgtcaggaagagaccgcagggtc

SEQ ID NO: 637874 - DNA, 1754 bp, Homo sapiens
taaccccgccgtccacctgggaacacccgcgctcggtgccttgtcggtgacgctgcagcgccgagcaccagggccgaaaggggtccacagagcagccgcggacccccgaaaccccattgcgcccggccccagagacccaccaccaggtcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccatctccgcgcgctgcgagagcgccaacggtcgcgcggggggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccaggtgggcggtcgccccgccccgggagcgcggcttaatagctgagagcccgggggccaggccgcggctgcggcccaggcaacgccctgagggtggccacgctgccaggtgttccactcccccgggactatgggcaagggcccggggcggggagggcggcaggtgctgacactggagctgcgccggaggtcggggaactcggcctcctaagactgaggacactcgcctgctgggccggtcgagctgtgcggtgccctccgggacgcagggggcgctgcagccacgctgggtcaggctccgcagggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctgggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttgccttatcgagggtacgagctcgattcgtatatgta

SEQ ID NO: 637875 - DNA, 479 bp, Homo sapiens
ccttttattacttttaggatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactggggggtttaaagttttgatgccaatggtctttttatgttttcaagtcatttgttactgtgtgtttcatttatgttagtttcaacttctattccttctagttcaataatcttctcttctgcaatgtttaatccactgccttcttccatttcagactgtaaatcatactttttatctacagaatttgatatttaaaaaatcttcaacctccccatttaattaaaatacaattatactaaaaaaaaaa

SEQ ID NO: 637876 - DNA, 177 bp, Homo sapiens
gtgctccagctaaacgatattatggaggtcagcactggtgctcacgtgtcgacggaacttgtacatgggaggcatgcacctgcagtggtgaatacacgtacgaccatggctccatgctaaaactgatattatggatggtcagcactggtgctcactgtatctgaacggaactatgta

SEQ ID NO: 637877 - DNA, 2245 bp, Homo sapiens
  misc_feature (2053)..(2054): n is a, c, g, or t
taaccccgccgtccacctgggaacacccgcgctcggtgccttgtcggtgacgctgcagcgccgagcaccagggccgaaaggggtccacagagcagccgcggacccccgaaaccccattgcgcccggccccagagacccaccaccaggtcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccatctccgcgcgctgcgagagcgccaacggtcgcgcggggggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccaggtgggcggtcgccccgccccgggagcgcggcttaatagctgagagcccgggggccaggccgcggctgcggcccaggcaacgccctgagggtggccacgctgccaggtgttccactcccccgggactatgggcaagggcccggggcggggagggcggcaggtgctgacactggagctgcgccggaggtcggggaactcggcctcctaagactgaggacactcgcctgctgggccggtcgagctgtgcggtgccctccgggacgcagggggcgctgcagccacgctgggtcaggctccgcagggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctgggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacggtgagtcccgggactggggcatgctgcggggagcacaggcctggcgctagacaggctgatgctgccttttctttgcagcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccattttgtatcaggtgtgttgctggccaggagctgatggctcactgggctcttggaggggaatgtgaagaaaccaaggagtcactttttcatctagattacttaggattccttgacttttcagaagtcgggaagcagtatgtttgcctgttgtagacctacttgctcacatgcagatttgagaggacctcaacggcttttctcacaaaaaaanngattgtttctcttctcccgcgatggagtctcgctgtcgcccgggctgcagtgccctgccggtgatcttggcccactacaaactccacctcctggattcaagcgattctcgcgcatcagcccggccaaggggtcccgagcccgaatccgtactctgtctagcccctctcccacgccccccccccgccccccc

SEQ ID NO: 637878 - DNA, 127 bp, Homo sapiens
  misc_feature (11)..(11): n is a, c, g, or t
cccagcgtagnttcacagccttggaccccagccccaacggcaagcaacttgctactgtttcttgggatacctttctcatgctatggaatttcaagccacatgctagagcttacagatatgtgggtca

SEQ ID NO: 637879 - DNA, 637 bp, Homo sapiens
  misc_feature (445)..(446): n is a, c, g, or t
tgctcgaattcaagcttctaacgatgtacggggacatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccattttgtatcaggtgtgttgctggccaggagctgatggctcactgggctcttggaggggaatgtgaagaaaccaaggagtcactttttcatctagattacttaggattccttgacttttcagaagtcgggaagcagtatgtttgcctgttgtagacctacttgctcacatgcagatttgagaggacctcaacggcttttctcacaaaaaaanngattgtttctcttctcccgcgatggagtctcgctgtcgcccgggctgcagtgccctgccggtgatcttggcccactacaaactccacctcctggattcaagcgattctcgcgcatcagcccggccaaggggtcccgagcccgaatccgtactctgtctagcccctctcccacgccccccccccgccccccc

SEQ ID NO: 637880 - DNA, 205 bp, Homo sapiens
acgcctgtgcgcccgatcgggtagcgcattgctaccggccgtgacagctgggtaagcgctggatgcacgcgtgtagcacgagtggctgcccggcagtgggaacatgtacttcagcaatcgtggccgggtatccggtgaggctctcgaccatcacctggaagcgcgcgccaatccggcatgacccagcacggcggcaatcaccgca

SEQ ID NO: 637881 - DNA, 244 bp, Homo sapiens
cgtacctgcagctctctctgatgacattgaggtaataaaagatttaacccaagaatcgctaactataaagaatatataggctgggatagtagtgcacgcctgtaatcccagcactctgagagaccgaggcgggcagatcatctgacggtcgggagttcgagaccagcctggacaatatagtgagactccgtctctacgaaaaatacaaaaattagctgaatgtggtggcacatgcctgtagtcc

SEQ ID NO: 637882 - DNA, 179 bp, Homo sapiens
ttgagatacagcgtgtgcacacgctcagccctgagtaagttctagtatttttttctgaacttcactctaaggatagcgttggaaaaagaatgcacgtgtgagttactaaaaagttagaattatgtggctgggaaccgtggcgcaacatgctaaaaaatcctcaatggcatccagcaaaa

SEQ ID NO: 637883 - DNA, 432 bp, Homo sapiens
tctattagcctctgtcctactttctacttataatgatgacagcagcatttgttagtttccacatgtgagtgagaacatgtggctttttaacttttagaatgtggtattcaggcacttcatggtacagttggtaaaagtgaaaatgtgtccaaaagtttgtgattatctatataaacaaaaatggtataaatacaaatatcaattttgcattgaagaacttaccttagaggtatattctcacaagtgcacagagcatttaagcatttgttcactgcagcattgttatcagtattttaaaactatggtacatccatgtacttccacatacagctcttaaaaataaggaggatatgaatgaactagtatgaaaagaagtccaaatacatttgaaagtgagaatagcatggttctggattgaaagggggatctggg

SEQ ID NO: 637884 - DNA, 200 bp, Homo sapiens
ggccctgggggttggggggccttttttttttttgtggttttttggtaacccggtagcccttttgggcccgcccaccccggtcctttttttggttggggcaaaatcttgaaaattcccccccccccccccccccagggcccttaaaattaaaattttttcccccccccgggggcccaaatggggggaaatttggttggtta

SEQ ID NO: 637885 - DNA, 1064 bp, Homo sapiens
ggagaagctgctgaggattcagagatgcggcatatggaatacagtccactgcttctcaatatgaatgctattcttggaaagttaagagcacagaggactatatcgaacctgtgttgtcaaggcaggaaatgtgtgctaaagtgaagcaggtggactatggttattcggtcacttgattcaagaaaagaagagaggtagagacaagaatatttgcgtgacatgttttgaggtgagcttaacagatagtggagccgcgaaattaggcgcgcctggactccgaaacaccttaataggctttggcttaggatgccacaggacctttccttattctcgggtatgaagcatctcgttacaacaagcttgatttctagcatcatgcactttcctctggaactgagaaatatggtcgacaaagctaggactctataggaaggaagagcaagcgttgattatttcttgtgagccgaacatcatcgaaggcaagcccgctgttgtaagtatggcgtgctagaagaacacagagacaagttcccagcagttacatagtgctttagatgaattcgttgatataatggacagccgctgtactgtgttaaggaacacgaagacagtggcgaagcaccgtttagttctaccaaggtgaaaaacaaaggcaagaacaagaaagcaaaggattcaaaggctatgtcagtaggggtctggaacaacttcagtaactccaaataactgagaatctcacttcaagtgaagaaccttggccatccaaaattcgaatactggaaggcccatttggcacgggccttgagcaatcttcgggaagaaggtaacaaaaaacttgtagacgcccctctcatagacaacacaccccgcaacggcaccaacgttggcccggcaaagcaaaacaagccacatggtggagactaactcagacaccaaacaaaaacagggcttcgcccatataagaagtaggaccctaaacagaggaggagagtagcacagacagcaccactactatgaacaagtagacagcagaagaatcatcgccgtcaacagtaagagtcaca

SEQ ID NO: 637886 - DNA, 849 bp, Homo sapiens
  misc_feature (101)..(101): n is a, c, g, or t
  misc_feature (644)..(644): n is a, c, g, or t
  misc_feature (648)..(648): n is a, c, g, or t
  misc_feature (672)..(672): n is a, c, g, or t
  misc_feature (697)..(697): n is a, c, g, or t
  misc_feature (743)..(743): n is a, c, g, or t
  misc_feature (766)..(766): n is a, c, g, or t
  misc_feature (768)..(768): n is a, c, g, or t
  misc_feature (840)..(840): n is a, c, g, or t
tctctctgtaaatagcctttgtgtaatggtctttagattaatatcctttgactttattaataagtacctgtgtgcccaggtggatctcagctaagtcatcnttaaattctgttcaaatagaaataaaccataaaatgagcctaactataacccacactcacttatcaagcattcccccaaaagttcagtgcgattcaggtaaccttgacctaaacttgtacactccggtgtacatctttgaccataaactctgggagatttccctctggatttgggatcaggagcccagtagggccccattgctgaatgtttatcacacttctggctagggcttatggatgagcagaccacgtaggagctaggatttactcagttccacctcactgacaggctttcctaggtggccaaggcaactggacttttcctggtggtaagggaaggcccaaggtacttggaccaggtggatattatatgggccatgggcaaaaggtataaaatgggatgggatggtagaccatatctcaacggcaggaatcacatttttaggatcgggtatctgggcattggtaatcatttttgtcttcttggaattaaacatggccctggcttggtctttttctggaatgggaaggggtagggaaagngggnagggtactaaaaaagggaaaatgntagtttttagttttctttttctaangctaaaaggaactgggcttttactaactggctcatatttttactanccacataagtaagtgtaggatgntngtatcaacttggcttaagggaatggcttttcaaaaaagggttacctcccatcagtcaaaaaaaagggggggnttatacagc

SEQ ID NO: 637887 - DNA, 188 bp, Homo sapiens
cccccccccccccccccgggaaaaagtttcccttttttcccccccccccccaaggggggggcccccccccaaatttgcctttttttgggggaaaaattcaaacccccccctttattttttttttttcccgggtttaaaggcttttttggggttaaacctttttttttaaatttaaacccaggggccga

SEQ ID NO: 637888 - DNA, 182 bp, Homo sapiens
tggtgatctagaggtccctgtggctactgctggagaacactgcctacagctttgggagacacagcattgccaacttgaaatcagtgaacaaccttgctatgtggtgcacacctccttcgccttccatgtatctagctgctcacctgtctacagcatgacgtagacagtgtacctgagctcga

SEQ ID NO: 637889 - DNA, 434 bp, Homo sapiens
ggtacatcacatatccaaaaacatcacaaaaaggctggatgtggtgactcatgcccataatcccagcactttacctcaggatggaaggggaaaagagaggagaacaaagccagtgggatgattaataaacgttttgagttgcacagatctgggtttgaatctacctacgtgacctaaagccagttatatgacctctctcagtgcagtttctacatctgtacgatagaagtttgagaataaataataaatgtaaaatgtctggcatggtgccctgatacatcttatggtaatataattatctatatttctgtcagtgtcctccactaaactgtaatcttggaaaactgggtctgtgacctgttcatctgtatgtctcagcctttcatacagtgcataagctcatccccattcctgaagtttcattccatgtgaag

SEQ ID NO: 637890 - DNA, 179 bp, Homo sapiens
cgcttagtctgaggggtaatcaatacaaaatagatacttaattgaatcctagaatccataaattacacttattatttacaactagcacaaaattcacagtggtgctgactgtagtaataacccactattgggcaaacatcccgtaaaacctagcctgtaagccatagccaataggagta

SEQ ID NO: 637891 - DNA, 922 bp, Homo sapiens
gtgtccttctgataaataaggcccttgctatgggaaaggcaacctaaatcaccttatggatgtcgcaactaatagcaagccagagtacctctgagcttctcatcaagagagctggggtgctttgaacgtagtaagtccctacccctctcccccataatgcagctgaagcgagtgtgtacagcggtgttgcctatggaggggatatcgagttcagataattgttttccgtactaaggagtcacgaaacttgaaagacgtttcttaaatctccagaatatctttccgacaagatttaatgggcctcgtaattcttatatttttgctttactaaatcactcgggatctggttgcttgtgagttattggcccggtattatccttatgtctggaagaattatctgctctgagtgggataattaacagttactttagtgcgatggaaatgcatttcctcatttgaggttaaggttccggcgttgcactcatgtggttcctgatgcattttggacttgtctgttggaactgctatctgctttttctctaacagatttctttccatatactgtttgggtaccacccgtatttcggtaggacctgttagggattggaaagccactggcaggcatgaccagtcttgctgtgtggtattacatgcatgcttggcaggtgcccttaggtctacgctgagggggacggacgtttttgtactgcggcgcaggctgtggacctaggctctgtgcccgatactcaagtgtgcaatctttccccaggcaaaggcggcccctttttcttctggcgacacgcccgatgagatgcccctgttggcgcgggcgtttccccttttgggaaaaggtcccgctcgcgcgtccccagtacatcatgggcgtaataggggcgcgcctcgttttttccccggtactaca

SEQ ID NO: 637892 - DNA, 193 bp, Homo sapiens
tctctagagcatacacacacgtcacgccttctgcaggcaggacgaaaactcgggcctgtgggtgcccgcccgcctcaagcagagcctggatggcgaatgcggggtcccagaggtgtgagccgctggtgccctgcattttcatgccgtcaaggcccatccagagatagtccgccattctggagacatgctcctg

SEQ ID NO: 637893 - DNA, 1076 bp, Homo sapiens
agcgggtctctcgctctctcccgggcaggcaggctgccggcgtgcaccgcgggaaggcggggctggggctcggcggtgaggccacccccagagaccgcccgggaggagcgcgcccagaagctgctggacgcggtgggaagcaagccggcaggcgtcctgctccttggacccccaagtcgcatagtctgcgccaggaagatgttactggcagtgcttggggccagtctgctgtcccgggaagcccgggctgagtgggtcgggcaaccgtcttctaggcccaatatcctttggaagtcctgcgcccgccccagtcgctgtgcctgttcgtccggccaagaaggctgggttttacccaaggagggattgcttggggcgtaattgagtagcctagccgaggagcacctggaacgcatacgccgcgacgtcgaaaaattagcctctggaactttacttctgtcactaaccacatgtggaccgagtgcgctgagaagtcttgagacaaacctccgcgttcagttactacgtgcgggccaagtcttgcactgaggccaattggggctggcggtgaccttgggggcctctccaagaccgtgtcaagattgtgccgcgttgtctgacataaccaggtcgtggagttacacgtccctcaaactattaaatcccgtaggcgcgtgaaatacgccgagtttgcctttgtgaccgtttgagagtgggtggacgtcgcaaccttgaaataaccccaggttgtggaattgtagcccccaggaattttggtgggccacgtatcacacgccaggtgcctcaggccgaagaagagttggtcagtggcccgtgtcctacatgtgtcggcgactcccataatgcttgacgttgtttaacaattggtttcgcaaattttccaattgctttggacgcaggagggcatttgttaaaggccccccaaaatatgagaaacagcgctttcaagagataatacaagccccctttggagttttagaacggcgaacaccctgtcagagaaaatgcatagtgtaaacaaggacgccctccagcggagcgacggggagtctaccagc

SEQ ID NO: 637894 - DNA, 245 bp, Homo sapiens
tagatatagttttaaagtcacagccgtaggatacacctgctgccatcacggtcctactgcattcgacttggaatgggcactggaagtttgtctattgacagcgctgcatttatttctttaacaatggatacaacccaaaggaccatcagagctgtacaccaggtctgcaataattagtcttctctatttgtgagactacagcgtatcacgtactttgccacacttgaaactgaatcactgtgtga

SEQ ID NO: 637895 - DNA, 153 bp, Homo sapiens
gatatcctgggcaacccccctccccccctcctccttttttccttcaagacccaaatgggcccccgctttgattccccccagcctttttccctgccccccctcccttagtttttcccaggcttactttccccataaatggggtagagctttgca

SEQ ID NO: 637896 - DNA, 366 bp, Homo sapiens
gctaccctcgatatgggggcaagttagcatcttgtgtaagtgagaaagatctgtgtgggcgcaataaggagtccctcatctggttgactcatgatgcccgcaccatgcgctaccccgatcccctcatcatggtgaatgatagcattcagattgattttcagactggcccgatcactgatttcattctacgttcgactctcgttacccttgttttagtttttgtccctgaaaacctaggaagaattggtgtgatcaccaacagagagaggcaccctggatcttttgacgtggttcacgtgaaagatgccaatggcaacagctttgccactcgactttccaacatttttgttattggcccttatcgag

SEQ ID NO: 637897 - DNA, 154 bp, Homo sapiens
cttttcccctctacaagaaagactccagtacaagatacctaggtcccaggtagtctaaattgtaacagcaacccctgtggactattgtagggtatgagtttatgattgaaatatcaaagcttactttatctgtaagttataagtttatccactc

SEQ ID NO: 637898 - DNA, 103 bp, Homo sapiens
gtggagaggttaatgatctgcttaggttacacaggtctctgtcagtggagcctggtctagcacataggtagctgactcagtccagtgcttttcccattacata

SEQ ID NO: 637899 - DNA, 668 bp, Homo sapiens
  misc_feature (629)..(629): n is a, c, g, or t
tctagaggatcccggtgtttcctttgtctctaacactctcagtgctttatttttgtcaaaatccaaagagaagaacagagaaaatgtgctttctccaaatcattcacaattgaaatcaacagcaagatcaagtctgaataccaaaacaactatgcactcagagtaaatctcatatatcatggcccactaatcaggagtcgggcattggggataaaacttcaaagcagaccaggcgcggtggctcacgcctgtaatgcccgcactttgggaggccaagacaggtagatcacctgaggtcaggagttcgagaccaacctggccaacatcatgaaaccctgtctctactaaaaatacaaaaattagccaggcgtggtggctcacacctgtgatctcagctactcggaaagctgaggcaggagaatcacttgaacctgggaggcggcggttgcagtgagctgagatcacaccagtgcactccagcctgcgtgacaaagtgaaactctgtctcacaaaaaaaaccaaaaggccggacgcggtggctcacccctgtaatcccagcactttggaaggctgaggcgggtggatcacgaggtcaggaaattgagaccatcctggctaacagggtgaancccgtttttactacaagtacgaaaaattagccgggcatg

SEQ ID NO: 637900 - DNA, 1245 bp, Homo sapiens
ctttcctgttaagtgggcacactgctacctccttcacagggctgctgagaagaaaggagacaggcgcatccgcacacagaaagcactcagtaaatgctgtttccccccttccccctatacaaagagactgaaagcaaccgcggctgcccggagggccgaactggagggtggccgcagccgtgacttccttgggaaccgcgctgcctcgactcggctacctctctgcgaagcactcgctaagccgggcagccccggggtcgcttagcggcccaggaggcgccagcgatcctgttcccctgcagagctatggggaccggaaggcgaaacagagctgtcgacgcgggagcatacgctgcccaccagtggagcgcaggtcatcaaagccgaatccgaatttgaattctgtgcggctgattgcagagctgtcttgaggccctgaggactgggatctgcgacccccagtggacaaaagtcgactctaccccagaggctaattttctcaaggcaggcacctgttgagaggctgcaagtaaaatacaggggaacgctagtttccgagctcatgtaagaatctgagaaataacgggggtaaactttgacaaaggggtgtgtgattgagacctgaggtcatgagattaatgggttcttattacctcttgcggggggaggtagtaaaggggaggggcaggtggcctgtggcgtcctgaagatttttcatgcattctttttccgagaactaaacattgtcaactctaatatatctatagcgcaacttgcttcaaggacagtaataattttcatttaataattttccatttaatccctttactacatggtcatttctgtctcttatattcctaggtttccctttataaggattagtcagatcaacattatatctctaacaatgttccttagctttttcactctcattatacctagagaatttaatggaataaaccagattttatatatatatatatatatatatatatatatatatatatatatataaatgtgtgtgtgtgtgcgtgtgtgtgtataaaattactcaacattcaagtagtcttgaaaaaagatgggtgggagtcaccttctttcccttcatcagttaccagtgttctcttaacataatggaagaggcaggaggtattcccacctacaactcaggattcctatgtcctatgggttcagttgtgtccccccccccaaaaaaaaacaccaaatacatctattggactcctg

SEQ ID NO: 637901 - DNA, 593 bp, Homo sapiens
  misc_feature (2)..(2): n is a, c, g, or t
tnttgattgactccagttgaaggtgagaaatctgtaccaatcattcaaaaagggaatctattgttttgaaagaaactctctcatatttcctttaaattgttaatagttgttatgcaactaaagaatgttatgaagaaaaatagcattgcaaaaagtaccattggccaggcttacaagtcagccacaatgagtcggtataactactgtgttattctttttctagacaaattttgactcttctacttttatgtgtaataattccagtattctatttatttcagcattatgtgaaaaatgataagaatgttaaaaagaaaataatagtgtggtttaattggtatgagatacctgcttcctcctcctcaaaggtttgactgggtgtatctctcctatgtgtgacattatgtctcctggtgttaacacaggaaatgagtgctcctttttaaaatttctttcttccaagtttttttttccaggaagagaaatatgcagttatgcaggaaaagctctcttaaataatgtgtacataaatctcaagagaatcaaattcacagagtgaataaagtaataatattaaactacaaaaaaaaaaa

SEQ ID NO: 637902 - DNA, 118 bp, Homo sapiens
ggcacttctgagcacaagcacagctacatccccttatccccatactagttattatcgaaaccatcagccgactcattcaatcgatagcccttggtcgtacgcacttgaccgcaaacat

SEQ ID NO: 637903 - DNA, 932 bp, Homo sapiens
agcggaacggttgaatcttgtggagctccagtcctgaaggtctagaggctggagattcaagatctgggtgccatcattttctggttctgttgatgaccctcgtatccacacaaacatacgagcaaaagggagaaagaaaagagaaggaaaagagaggagagaaaaaaaaaaggaaagagaagagggaaagagaagaaagaagaacaaagaagaaagaagaaagaaaaaagaaaaagaaaagaaaaaagaaagacggacggcagagagaagaaagagacgaaggaagggagagagggaggagaaggagagggagaagggagggcagacagcgaggaaaagaggagagagaaagagagggacgcgcgagaggcaggcgagaaggagcgggcaggagggggcagagcagaacgagagaaagaaaagaagaagaagaaaacaacagagaagaaagaaaaagaacgagaagaggaggagagagaagaacagaaaagaaagaaaagaagaaagaaagaaacaaaagaagaaaagagaaaaaagaaagaaaaaggaggaaacaaaaaaaagagcagagggagagaaaggagggaagaggaagaaggagagaagagagggaaagagaaaagcaagaagggagagcggagagaaagaaggaaagaaggaaggggaggaagggagaaggcagacgagaggaaggaagaggaggaaagacgaagaaaaagaaacgagaaaagagaaagcgagaagaagagaggaaacgagagaagagaaggaaaaagaggaggacaagaaaagaagagaagcgagaaagacgaagaagaaaaaaaagaagagaaaagaaaagggagagaaaagaaagagagagagagcaaagaagaagaagaagaaacaagagaaagaaaaaaaagaaagacaagaaaaccggaaaggaagaa

SEQ ID NO: 637904 - DNA, 136 bp, Homo sapiens
ccgtgtgtagggacgggcgcgagcgcttcccttccccctgcacgcgccggatcatgtctgagcaatgtcatttctgggacgcttcgcagctattatgtcgactcgatcataagtcacgagagtggaggacgcgcct

SEQ ID NO: 637905 - DNA, 341 bp, Homo sapiens
ggtcgacgatgaaacttaaaagatgaagtcctggtccgggcacggtggctcacttctgtaattccaacactttgggaggccgaggcaggaagatggcttcagccagcgacaaaaaaaaaaaaaaaaacacaagaaattagcagggcgtggtgacatgtgcctctagtctcagttactcgggaggctgaggttgggagatcagttgagcctgggaggtcaaggctgcagtgagcagagattgcaccactgcactccagcctcgacaacaggcttttggacatagcctgcctcaacaaaagaagagaaaaaaagttttgccctatggtgagtcggtcgacgcg

SEQ ID NO: 637906 - DNA, 890 bp, Homo sapiens
  misc_feature (1)..(1): n is a, c, g, or t
  misc_feature (115)..(115): n is a, c, g, or t
  misc_feature (173)..(173): n is a, c, g, or t
  misc_feature (239)..(239): n is a, c, g, or t
  misc_feature (295)..(295): n is a, c, g, or t
  misc_feature (312)..(312): n is a, c, g, or t
  misc_feature (382)..(382): n is a, c, g, or t
  misc_feature (487)..(487): n is a, c, g, or t
  misc_feature (509)..(509): n is a, c, g, or t
  misc_feature (554)..(554): n is a, c, g, or t
  misc_feature (764)..(764): n is a, c, g, or t
  misc_feature (767)..(767): n is a, c, g, or t
  misc_feature (803)..(803): n is a, c, g, or t
  misc_feature (821)..(821): n is a, c, g, or t
  misc_feature (843)..(843): n is a, c, g, or t
  misc_feature (867)..(867): n is a, c, g, or t
  misc_feature (869)..(869): n is a, c, g, or t
ncaatttgaacttccattttgttaaattgttcttaattattacttattaataacttcttctttgagtctctctgcaagcaatctcctctttagtaatgtttgcttctcctctgcngtcattcctggtttctctgtcattccctctacctccccagtgggttttcctttctgcnccatattttgtatctttttagtcctcaaatcctttctcatggacatcaacttatctctctcctgcntgagaaagtgtcctcgtggccgaagtcctcctgtcccaagtcctgaaaagtttgcnattggtccttcaatgcncgcatgccctaagccaggaatctccaggcctttctgtgggagggaggaagtttcagacctttccactctnctccccaaaggttctattgactgattagcaaaatgcatttaaactcctgagggtgggtgtccaaaaggttcaccatccccttgggaataattcattattgcagcntcactggaatccactgtgggcnctcctgtctaagcctctcaaaactgtcttttcctctccctttctnctccctggtcatatccctctcttgatttcctaagaacttccctcaggattttcatctctccgtgtccaaggtcactgaccacatcagacccatcggttaagcagtcaggtaatacaccattcctctctcgaatcattcgaatggcttgcagcgcgcattgcaatgtctttctggaccatcattgctttaaagatagtaaaatcttctgcngcnaacacaggtggcaaaatggcctgtgatgtatgggtntttgcaagaggagaagtncatgctttttgaaattgatctncattaattccaatttctttgaggnancttctaacagcttttcaacta

SEQ ID NO: 637907 - DNA, 327 bp, Homo sapiens
agctctctctgtggggccagcgggcgtatatcagccactccccttcactggtcctctacttggtggctcccttattttctcccagtcatcagggcctttctttacttttcctaactagctcagatttcacaatcggtccttggactctccctctggccgtctagtcgggcccaatggagctcacctttctcggggggtcggcgccggcatgtcctcggcagagaaggcagggcgatggcggtcaccggccttcaccgggcgtcccgtggccggcatgccggccctgcatctccggtctcctccccacagagagagcgtcgggtaccg

SEQ ID NO: 637908 - DNA, 154 bp, Homo sapiens
tctataggatcccccaagtcataaatttgactcagattttattgttgaagtacaaactctgttctcttttccctatgtcgggctggctctctatacagttaggcacttgtctccttgcagactccgtgctctccgcaaggtattcagtagtttt

SEQ ID NO: 637909 - DNA, 427 bp, Homo sapiens
gacggattccgagtggttaacgccctgcggtatgatgtagagtactgccacatctttgaaaggagctgacccttgtgctatgatacccggctaggacagtggcagaagagcattctggccgtgggtatcgcaggcatgatgactacagaggaggcggggaccgctatgaagaccgatatgacagacgggatgatcggtcgtggagctccagagctgattcctctcgggatgattataggcgtgatgatagaggtccccccaaagaccaaactgaatctcaagcctcggagtcctcctaaggacgatgattcctctgctagtacctcacagtccactcgaagctgattctatctttggaggagcaaagcctgttgacacagctgctagagaaagagcggtcgaagcacgtcatcgaagaaccaattag

SEQ ID NO: 637910 - DNA, 130 bp, Homo sapiens
ctccagctggccccaatgcggctacggggttatatcttctcagcaacgggccgcagtctcttctgcaccattttctacagccagacctgcttggcaccacagggacgctctgtttcctgaccctgacaca

SEQ ID NO: 637911 - DNA, 1576 bp, Homo sapiens
ctgcccaacgcgtctgcagcagcctcccccttgatgccccctcgcttcccgacgttccagttcccccgctgccctgcacttctgacccgccaccagactgcgccgcctatcctgaaggccgtgtccaccgaggaaaaggaatcgtatcgtatgtcctgcatatcctagaacggcatccactcttgtcagaccccatttgcgtgatgcaagtaacggtgatgaccatgcattccatgctcggcacatgaggattatatccatataagaattcaacagagaaacggcaggaagacccttactacatgacacaagggatcagcatgaagattacagatacacagaagaaactagatagaagagcgtacaacaaaaagtacgcctgcaatggcacagaaatagaacatccggaactatggagacgtactacagactacagggtgacccaccgcaccgaccatatgccagcgccacgacgaccaatggaccagcgcaaagcgacagcacacaagaaacagacactggctacataagaacgcaagcggcacactgaagcaccagtgccacaaccctgcatagacagcaaaaccctactcacaccacgaaaaggtacaacaaacctcaaacaggttcacagcaacaaacgggggacgcaccaaaacacgcgaccactcgagaccctacagaactaaacaaacgagccaccgcccacccaacgagacccacaaaaacacaggcagccaaggcgcaagcacgcaaccaaaaccaccaacgcagtacaaggaaaccacccccaatgacaacctaggcctcccaccacacccggagccacaaaccccccgacatcccataaagctcaccacataaatctgcactaaccaaaacaaaacacgatactctcatctctctcttccttccttctcatacactacaaccacaacacatccacaacaaaaacacaccacacacccccataaaaccacaacacaaagcactaacacaacacacacaagccaccacacaaacaaaaaaacaaatacaaccagacacacacgaagcagccaacgaaaggcgcaggacaaagagcagagccgaacacaacaaggcaaggacagagagacacgaccgaacgacgcacaccgaggacccacaaccaaacgcgaagaccgcaaggagaacaacgcgacaccgagaagagggagaaagaccagcacgcgagcacgacaacaaaagaaagacgacggcggaggaagcggagcgcgagagggaagggagaaggaggaagccggaggagacgagaaggaggaggaagagaaccgacgacagcaggagagagcgagggcagaagcagaaagaggaaagaggaagaaggagagacgaaagggaaaagcgggagacagggcagaccgagagacagaggggagcgcaccgcggagaggacatagacacgaagaccacggcaaagaggcgagcgagcgatggacgcacagagagagcgaagagaacaaggaagggcgagagacggagaaagcccggaagcggacgcgaacgcggagcaagggaagacgagaagacaaac

SEQ ID NO: 637912 - DNA, 226 bp, Homo sapiens
ggggggggggggggggggttttttccccccccccccctttttttccccccccccccctgggggggggccccccttttggttgggggcccgtttttttccataaccccttgggggtggggggcccaaatacataaacccatccatatatccccagcccagccatgaaatagggccaagcaattgaaaaaaagaaaaaaaataagcaaaaaacaaatgtggttaaaga

SEQ ID NO: 637913 - DNA, 725 bp, Homo sapiens
gttatgtgtcacacacgcgccccttgtggggagcacacttgtgttgcagacaacaccagctctgtatataaagatcatagagcatcgtatgttatacagttctcgtacgcaacggagtggctagtagggaacactaaatataccgtgatagtttcctagaactatgagggctcttcgccttatagagttgacgaccccaccccttgtggggagaataaggacgcgggacctctttctgcacgcgtcatatttgcctgttgcaggacaactcatcgtggtcttgttggggaagggcatcatttcttctttttcccccggcgacacgcacaccccccgggcgggggtcattatattatgagtctcctcccctcgcaggagttgtcgatatgtgttccgttcagttttgtcctctctgggagagaaattggtcgccatgggttttctgacatggcgggggagttttaaccactcgggcgacccccagaggttactctgtccaagaaagaggcccccctctggtgacatcaccctgggggtgtcatctcgctttctctacatgggcgaacattatgatgattcttgctccggcgctttcttcgtgagtgatgaaaggtgtggagtcgacccgccttgcaaccaggtctccaagattttcatcatccaccctggtcaggaatactgaacaaggttggacaatcccccgctccaatcaatgtcgagaaaga

SEQ ID NO: 637914 - DNA, 219 bp, Homo sapiens
tgctgcatgtactgccagtcccaggacacaggacaggacttatctgttgatgtcttttccctcctcacactcacctccaggccctttctctcattttctttattttctctttttaagacaaggtctcactctgtcaccctggctggagtgcagtggcatgatcatggctcactgaagtctcaaccatctaggctcaagcaatccttccacctcagcctc

SEQ ID NO: 637915 - DNA, 376 bp, Homo sapiens
tttgccccaaaaatgtcctgactttgcccccttgcccctcagccatttgccatccccccaaacaactcagctttggggccggtgagggggggggcctccccccgcccaaatgaggggcagctggggtaggctgtttgtgccatggcccccccctcccccttcccttggagggagggggggcaggaatacttcccctttcctctcccccaggggcaggggggggaggggcgccccgggttgtctttgtgtatgggggaaaggccctgggggcctccagccccccccctgtttcagatggggggtcccgcccccgattgttgtaaactgttgttttgtatgagcgaaattgtcttttctaacccgattttatagttta

SEQ ID NO: 637916 - DNA, 1295 bp, Homo sapiens
  misc_feature (410)..(410): n is a, c, g, or t
gcgcggggacactcgtgcgacttggggcaaggtgcccagagtgcttctctcctaatttgcctcacgctaatgagttgagatcccagagggctaggaaaactgggttctgaatttgagatgagccgtcctcggcatcagatcgagaattcattcatctgcgccagatgacccggctaatctgcggattccacggtcgcctgtgcgtacgcatatttcctaggaagccttggctatctcgagcgttctcttcccagacaggaagcgaatcgggtgtgcattgaacctcccgctcgagagcgacattgcgggttgaacgagcattggcggcgatagcgatagcagcatatgatcgctcaattgagaatgctcggatttgctttggtaatgaagatgctgccccgtggcagcangcatgtctggctacttctatatccaggattgcgtcatagaggcacaagccttgtagacagggcgggtctcattacgcgtttgcgctggcttggcttgcggagcccgagcgtgaggggagtttgctttctttcgggcttagggcggacgaccccttggagctttcctcccctcactagtgacatcaagggaaaccttggacttcctcgtgacctacataacctagttccacaagaggcgttcacgtagaaaggctagggcacgccctcaatgacttattaatgtctctcgaagaacaatgtcgtaccaatgggagttaacaaattgcgccaattcattccccggcccccaggtaggacttgtaccttacgcggggcatttactagtcacgccctagggatgatatcttagagttataccaaagggaattaagaatggggccctttcgcaatatctttcttacgctaagcttttacagggtattggtcaagtccctacattcatttaatcaacagctagatttctctactttttgtgcttgggctaaacgttggttgtatcggtgtctagagttatctccgtgattgatttcccgtttcaggtacgcttaattcttggggggaaacagcccgttgggtgccaatttcgaaggaattgttccccagggccccaacatttcccatagaaaagggttgctttccactctccccttggttgcctttggaagattccaaacttgggcccggcagaaacccattaacacacttgagagaagcacaaggtttaacttctggcttctaaatcaaaaggatattcaccattcttaaggaacttgggcgggttgtggccagggggcctgataggggggtgtgggggacgacacccgg

SEQ ID NO: 637917 - DNA, 332 bp, Homo sapiens
catcatgattaggattctcagggtatcccctcacacactcctcgactcccacccctgggatacatcaagagtctaatattgactgaagagaggccttggtagaaaagctaatgaagtcatatggagttgctgtgcaggccagaagacacagctctgcctccagataggcgagtttgctccttgagctcctggatggtggcgtccgttgactggatcacggcttgtgaattctggagctgcaaaggggtgggatacacgggcggtcatttaggagggactcattacgacgactcaccagaattcaccccagttgctgggaagggtcccgagct

SEQ ID NO: 637918 - DNA, 1237 bp, Homo sapiens
  misc_feature (361)..(361): n is a, c, g, or t
  misc_feature (598)..(598): n is a, c, g, or t
  misc_feature (1004)..(1004): n is a, c, g, or t
ggagagaactagtctcgagttacgatatatatgtttcgataaataccacagacacttgttttcccttttaagtttggttaaaaaaaatttctgacaaatcaaaaaggggggttacaggagtctttgtggtgattgcaaaatcgagtggaacgccagtggggtgtggggcctgttcaggggttgggggcagatagagtgatctctattacacccccacccgtggagttcctctccttgaaggactagcagggtacacatttccaaaattgggagagttcttcataccgggggctcgtgtcacaagtgttaagagagggagaatggctcttatctctctccatatcagggacacggctctcanctataagatatgtgtgagcccctcaaaaagcagaaatcctgtgagcacatatcaatgtgacgagatctcttggagccactccaatttcctcacttgggggacaccacacacagtgtgtttggattacgcacaaagggcccctgtttggtttgtgcctccaaacaacgccgtggcttgtgcactcctgtgggccccacccccagcaagttgcacagagtataaggggtgtctcgaggnaaaactccctctcaaggggaccagtgtctccatctaaattataaaacgagttccaaagtgtttcaccaccccccgactttcgaaagttgctccccagtggtccctctcggtggcccaaaaatttagtgttttggttaaaggcccacaaagaacattctctgctcaggtggggagaaaaactctgtttaaaaagcagtgtgctttgtaatcacccggagaaaaagggcctctcttaccatccactgtgatgggaacactcccctagagtgatagagacatttggcccaaactgggcctgtagggaacgagaattattagggctcccaacgtataaggcatcgtgcttgtggccccacatgtgcaaatgtgacaccccggaatgtgaaaccagggaagtttatcacgncaaagaggactacacccactcttagtgttgtgcaaactctcaagtgggcactttccaagaaagttgttaacaaagaaagcctcccgggaataccatacaacagatggacctttacaaagatcaccagcgataagaaactgtggggtggcaaccccatttgacacggggttcaacacttgggtgtcttcagcatagtccccagggaaaagaatcttccccagtgggaggactgc

SEQ ID NO: 637919 - DNA, 772 bp, Homo sapiens
tggatgggcatgtgttggcacgaaagcacccggctggttcctcaaacgatacctcagcagcagagttaccaacaggtccgccgctgcccagcagatcccgatctcccttcaccacatctctgcaggcacaagctcagcttggactgaggggtgaggcattcctgtggtcccagtcccaggagatcttcagctccttgacagcccttcagatctcaggtgtacatgcaccccagccgtgtcacctgaccagacacacatgatcctctctgggggcacacgccttgaagcctccatactcggcgttacccaggcatgcagcccttggacgatgtgtgaatgcctgcatgtctgtgctcacacctaccaggcccaactgagcgggaaccaaagcccttggtctacgacgggacaaagctcagctcagtgcttgcctggcctgggatgcctccccaagaatgttgggacctccccatgcatccctacacgcaaggcttgaccactgcccactgaccatcggttacagggcatccggggcagcaagcccacgttgatcctgccacccagatctatatccagacatgacacacatgtggcatgagacctctaccgataggggagccccccgaatggaattcctaccgcccgggtcccaaggcccgcccaatgtccatggaacacccagacagagagaccctctcagactggcagcactgacaatggctaccactttgccgaaaggaaaaaacagaattgtccacattcaagagggccg

SEQ ID NO: 637920 - DNA, 393 bp, Homo sapiens
cagcggaaaacggatcggaagcctggtgtcacctaacattgtaaatgaccacacaagggaagcaacaatcttgtctgaaggacgaagtaaatgatacacttctggtgactgaactcgcaatcaaaagaatctgacatcatgacaacaaatggtgtcgttcaggtcgtagatcaactcctctatcgcagcagagacacctgatggaaagtgatcaacggctgggaagtacttcataaattattcaaatacatccaagattaagttggtacggggtagcaccttcaaagaaatccccgtgactgtcaatactactaaaattataaccaaagatgtggaaccaaaaattaaagtgattgaaggcagtcttcagcctattatcaaaactgaaggacc

SEQ ID NO: 637921 - DNA, 288 bp, Homo sapiens
gagacaggttctcactttttcacgcaggctggagtgcactggtgtgatctcatctcactttgacctctgccttccaggctcaatcaattctcccaccttggccccctgagtagctgagaccacaggcatgcaccaccaagcccagctagtttttgtatttttttgtaaagctgtagtttcaccatattgcccaggctggtcatgaactctgaggctcaagggatctgcccgccttggccttccaaagtgctggaatcagctgggatgagtgctcccttctgtcgtctt

SEQ ID NO: 637922 - DNA, 349 bp, Homo sapiens
catatgtacataagactgacttaagattatgaagctgaatgtacttcttttgtattaagagcttaggttgttaaactgacccctaattttgtggtgtgtgtgtgatcctaggttctcgtgtctcttaaatggctacccgctctagttattggatttgtttgagcttcataagacttcactgaattggtgatcgctaaatggcctagtttgtgccaatatgtgttggtttctctctattattcctttaaagttttattgtttaccagtttcttttttgtattgagagaaaaataggccaagcatctttgacatcttttctgcgacaggcaaaaaaggaccttgaacaaag

SEQ ID NO: 637923 - DNA, 694 bp, Homo sapiens
  misc_feature (528)..(528): n is a, c, g, or t
  misc_feature (639)..(639): n is a, c, g, or t
tttagaaccaatgagatattttgtaggtggatcctgagggaaattggcattatcttgcatggcagctgcctccagggaggctattacagtttcctcaggcaatgcagggttagtcccctcagatgttggagacgctgtttccactggcaaagacgactcatcagaatttagaggctcagccaggcgcctgtaatcccagcactttgggaggtgaggcaggcagatcacttgaggtcaggagtttgagaccagcctggccaacatggcgaaaccctgtctccattaaaaacacaaaaattagccaggcatagtggtgcactcctgtagtcccagctacttgggaggctgaggcaggagaatcgcttgaacttgggaggtggaggttgcagttagctgagattgtgccactgcactccagcctgggcaacagagcaagactctgtctcaaaacaaacaaacaaggaaagagtttagagctcagtgtacccagctttatcaaagtctccccacatgtcctcatttcaactntcaagatccagttccttattgatcaataacctcaatttaacagtagatacccttacaggctaggagttcttgctttcagccagtcacaggataagaatctaggtttgattntcaacaatcttagctctgcctacccgcgatatggctggcctttagggcacacacg

SEQ ID NO: 637924 - DNA, 336 bp, Homo sapiens
  misc_feature (25)..(25): n is a, c, g, or t
  misc_feature (82)..(82): n is a, c, g, or t
  misc_feature (250)..(250): n is a, c, g, or t
aataaagtccaagccttgtaagttncctttccatggatcatgccctttgatgttgtatcaaaaaaattatcacggctgggcncggtggctcatgccctgtaatcccagcactttgggaggccaaggcggtaggattacttgagcccaggagtttgagaccaccctgggcagcatggtgagacctcatctctacagaaaatttttaaagattagccagacgtggtggtgtgcgcctgtagtcccagctacncgagaggctgaagtgggaggatcgcttgagctggagaggttgaggctgcagtgagtcatgatcacgccagtgcactccagcctggg

SEQ ID NO: 637925 - DNA, 395 bp, Homo sapiens
gaggtgccaatcaaaattgtaatttaaataatttgtccaggcatggtggttcacgcctgtaatcccagcactttgggaggctgaagcaggtggatacctgaggtcgggagtttgagaccagcctggccaacatagtaaaaccccgtctctactaaaaatacaaaaattagccaggcatggtagcgcatgtctgtaatcccagctactcaggaggctgaagcaggagaatcgcttgaacccaggagacggaggctgcagtgagccaagatcacaccactgcactccagcctgggtgacacagtgagactccatctcagaaaaaaaaaaaagtgtttcaacatacaatcaatatttttaaattattaataaaataaagttttttcataataaaaaaa

SEQ ID NO: 637926 - DNA, 440 bp, Homo sapiens
  misc_feature (10)..(10): n is a, c, g, or t
  misc_feature (77)..(77): n is a, c, g, or t
  misc_feature (84)..(84): n is a, c, g, or t
  misc_feature (101)..(102): n is a, c, g, or t
  misc_feature (122)..(122): n is a, c, g, or t
  misc_feature (136)..(136): n is a, c, g, or t
  misc_feature (151)..(151): n is a, c, g, or t
  misc_feature (153)..(153): n is a, c, g, or t
  misc_feature (157)..(157): n is a, c, g, or t
  misc_feature (169)..(169): n is a, c, g, or t
  misc_feature (177)..(177): n is a, c, g, or t
  misc_feature (202)..(202): n is a, c, g, or t
  misc_feature (211)..(211): n is a, c, g, or t
  misc_feature (260)..(260): n is a, c, g, or t
  misc_feature (312)..(312): n is a, c, g, or t
  misc_feature (315)..(315): n is a, c, g, or t
  misc_feature (334)..(334): n is a, c, g, or t
  misc_feature (337)..(337): n is a, c, g, or t
  misc_feature (351)..(353): n is a, c, g, or t
  misc_feature (405)..(405): n is a, c, g, or t
ctcgggtacngggatattcgtgggctcctgactatgatcgaagccaatggctggatgtgaaattcaagctagacctnaactttnctaatctgccctacctnntggatgggaaaaacaagaanacccagagcaatgncatcttgcgctacancnctcncaaaaaaaacangtgtggtnagactgaagaaaaaaagattcgagnggacatcanaaagaaccaaataatggatttccgcacacaactgataaggctctgttanagctcataaccacgaaaaactgaaagcctcaatactatgagaaaaagctacntgnacaactgaaacaattctcnatntttctggggaattnnnatggatttgccggggaaaagctcacctttatggattttctcacctatgatancttggatcaaaaccgtatatttgaccccaagtgcc

SEQ ID NO: 637927 - DNA, 1326 bp, Homo sapiens
  misc_feature (494)..(494): n is a, c, g, or t
  misc_feature (747)..(747): n is a, c, g, or t
gtgacaagaccattgggggaggagatgactccttcaaacgaccttcttcagatgagacgggcgctggcaagcatgtgccccggagctgagtatgtagacttggtacccaagcagtccacttgatggaacgatatcgtgactgggcgaccgtaccgacaacctgcttccacccatgaatgcatcttcatcacagagacaaagcgtaagatgctgaccaaatagacatatgacccgagggcacatacactcgatatggcgaagcgagatcattgaacccgttgctggttggaatccgagattcgagcaaagcctgcgtcatgaccaaggtgacaaccggctcgtatacagcggtcattcgtatggatagaagcacagcagaatgtttctgagatgcggagtgcagacgtagagttctctcgggattcgaccccatcctggcgtgagcagtgcactgcgggaaaccgcgatctgtgcggtagcagtatctgagagtnctcatatgagtgcgaaaggcaccaaactgcgccaaagagcctggtgaaggatatctatgcgcaattgtttagcacaccggtgcaaacaccacccaggtgatgttgtcccattccaacgtgcgttggataaagcgttctggaaggaggccgctcgaataggcctacagagcatacgcaatttaccaccgtttccatggcgacatgttacccctaacaaagcggcgattgcgcgccgttggtggcatcggccaangcgttgccgtggaaaagttcgtggactgggcggcggtgtacacgtttggggttacattgacggcaggaaatggtaacgcaggcctacaactgcgggtatggtgagcaaagcagaatcttcgtgtcgggctctcgggtcttcaccgagaatgacgtaggcaaccgatatccgaagaggttataagagttcccggaaacgggacctgggtctggcgacaaagaaagcgcacacacttaaaaggatagggcacttaaaaaaggcccccattcctggaaggagggcctacctggacaacctatagtaagttttataaaaggagctcccaacggcacatttggttggggttgtgttaccaccttgacgcaacgatttcaatactccttggggcctatatagcgctccgcctttgggagagcgcaaacttttcttgcgaacgcttttgggggaagcgtagcgcttccgccgtatggaacactggtttggcgataattatggaaatacctctctttggggaaacggcgacgggcgaaaaaacagttgtggttccttcaaagcaaacagaagacaaggggagactcg

SEQ ID NO: 637928 - DNA, 1189 bp, Homo sapiens
agcggggatggaacccgggcctggctgaggcggaggtgttgcggatgcttctctcgtccaggcgcaccgcagattcctgcccgggggctggacccgaggaaccgcacgtctctactgggttccgacggccagcaggctgggccctaggcatgagcggagagtgggactggcagccttgaaacgggcgcctaacaagaagcccgtgcaatccaagtaggcctgcagcctcaggcttggagcactgggcgggcggagacccgcgctgagctcgttctgtccattattactccatagccaaccctgcgccgtcctattatctcacgccggcaaggccgctcaaacactctccggtccttactcagttccacgccaccactcaggttccttactctcgctctactagcaccgtttcctcgtgttcatctgtgcctgtgcgatttcccttggtaacttacaaactcgtcctatacacgcaccccctggctcgatgccaaacacagtttgtggtggtgcattcctcgcggtgacctactttaccgttggcacaatctttgactggctggtcgccccacgtgttccgacctggaaagaccgccagagtctgggcgcactggcactgagctaagtgtttctcgcccctcccgtgggcttgccacccggtgtctcccccaccgggcacgtctaggaactgcgcaccctcagctgcctcacaccacgctggtcgctgttgggctctacacctccctgctaacttttccccccaaattgtgtcgacccctccgcagatcactcctccaagacactggggtcaagcaccccagttctacggcaggaactcacgcatttgtgtaagcgctcgatcagctttgggctcacttcgctcctcccactcaagcccctcccagcgtactcattcgccggccccctccagctctagccactgcctcttgaaaccccttctgagaccgcccatttggcacatctctggcccaccctccctgacatgatactcactatttcactcccacactagcgccactgcctatccaacatagcgcggcatcgttctactgacgcgccccctgtcatacacgacgtcgtcctcttcactcaccggctcgcctcaccatcagggcccaacgctcacaaccccgtacgtctccctcctgacaacgtgtccccgctacta

SEQ ID NO: 637929 - DNA, 202 bp, Homo sapiens
ggctgtttcaagtgctctggaggctgtgggggcggactcatgaggggggatagatctaaatcagtacctggcatgcatggtgctgggccgcttgctcagtagtattacaaaaaaagaaaattggccaggcgtggtggcaggcgacctgtagtcccagctgctcgggaggctgaggcaggagaatggcatgaaccagggaggt

SEQ ID NO: 637930 - DNA, 743 bp, Homo sapiens
ggagggggaaaaacattaatccataccatgctgaaattattttcgtatacccttaaaaagcagaagggcggagaggacaaatagcagtgagcaatttactggttgtctcacgtagattctttaaggttacaaggagcagagagatgtgtagtttaccttagttgaaagttaaaagtgaaatagacaaaagaggagggacatgtgtccatttctgcatagaaatctcatggaacaggaaagccatttgggttgcagctgtaattccagagaccctctggacaccacagctgcagtgatccactcaagttgttatcccctcagcaagcaatatccatttcttcttttttgagatggagtctcgctccgttgtccaggctggagtctggagtggcacgatctcaactcactgtaacctctgcctcccaggttcaagcgattctcctgcctcagcctcccgagtggctgggattgcaggcgtgtgccaccgcgcccggctaattttgtgttttggtggagatggggtttcaccatgttggccaggctttgaactcctgacctcaggtgatccacccgcctcggctcccaaagtgctgggattgcaggcatgagctaccaggccgactagtatccactttttctaaacctatgccccaccattttggggctaaagctacattctgttctgttctacttatttgtgctgtatacttattatctagctaatctgcctaggtgtatcccaa

SEQ ID NO: 637931 - DNA, 559 bp, Homo sapiens
aagtctgaatggagatatggctaaatatgtctgatataagtgcggtatgatagcccttagaatttgataaatgatgactgtgaagatgtacattgtttgatgcggaataggagacgataatagatcaagaacagccatattcagacatccagctaggatcgttttttccacgttattctttcggagtcagtgcaatcatcggtctatctgctctgtgagttgctcagcagcagattcatcaccatgtatggtgactaattatctggtgttgtcgtgtgagttaagggcagtgaagaatgtccacagagtaggactaatggttggtggctagcgtttggtggtaatccacacttgtatgcaagcatgggtaagagccagtgggtgtctgaatctagaagggagtcctctcgaggagaataaagagtgtgtcagaggctgaatcaagaatcgtttggttgggactaattgctgttgcagtactgtgggtgatatttgcctttagtgcactcttctccttcagagtacagtggttggcggtggtgaatcagtgggtgtggtg

SEQ ID NO: 637932 - DNA, 273 bp, Homo sapiens
cggcacgaggttaaagatggccaccaacagctgcgggaaacggcaacaacccctcactttccgggatggtccctgcgggtcggcccggccttgatggagagaagaaacccgaggagcgccgaggctgaggcggcggcggcggggacccagcgaggacgaggacgcggcggagcagggacgggggcaggagaagggaaaggcggcggcgtcgctgcccctgctgcctagcaccgctgcctggcccggcggaccggttcccatacctcgcggccg

SEQ ID NO: 637933 - DNA, 335 bp, Homo sapiens
ggtcgacagccgagatagcgccattgcactccagcctgggtgaagaagcaagactctgtctcaaaaaaaaaaaaactaccacaggggtttatcaggctgccttggagttctcaggattgtcagattgttagggtctctgctgttttgaaattcatttctctctatttacagggcttattttttcccacttcaaactgaacattgtacttgatagagaaacggaaaaaggagtttatcaacagtgagatttcatgtctgaaaaaaatttttttaaaagtcttaatatctacaaatgggcctgttggaaaggttgaataaaacatggatgtaaagta

SEQ ID NO: 637934 - DNA, 441 bp, Homo sapiens
  misc_feature (198)..(198): n is a, c, g, or t
  misc_feature (287)..(287): n is a, c, g, or t
  misc_feature (358)..(358): n is a, c, g, or t
  misc_feature (400)..(400): n is a, c, g, or t
  misc_feature (413)..(413): n is a, c, g, or t
  misc_feature (432)..(432): n is a, c, g, or t
ttatccagcacaaaatgtcagccactgttaagaaaccctggtgtaagcctaaaacttttctctgttgaaggggtatgacttttttctttgggtaattttttattgtaaaatacaacataaaatttatgattttagcccttttgttaagttttcagacagggtctcactctgtcacccgggctgggagtgcagtgggcnaaatcacgggctcgctggcagcctccaatctccccaggtcacaaatggatccctcctcttctcaggcctccctaggtagcgggggactngcagggtgtttggcaccactacgggccaggttaattttttaaaaattgtttttgtagggaggacagggggncctttgctggttggatggcacagggctggggtctttggactnccggggggggttnaggggtgatccttgccccncccttgggg

SEQ ID NO: 637935 - DNA, 448 bp, Homo sapiens
acctgtaggtcagtggcatcgttcctctaccgtgcaacacgtaagtgtggtatgctagaaagatccagtccgtaaaagggctcactgagatcacgtcatcctcagcttcaactgccatctaaacactgcagactcttccccctagtacaagatgccaggtcaggcacggtagcacctgcctgtaatcccaacacttggggaggccgagggaggcagataacgaggtcaggaattcaagaccagtctggccaacatggtgaaaccccatctctactacaaatagacaaattaactgggcatggtggcatgtgcctgtaatcccggctaggagggaggctgaggcaggagaatcgcttgaaccaggacctgggaggcggaggttgcagtgagccaagatcacaccactgcactccagcctgggctacataaggaaactccatctcaaaat

SEQ ID NO: 637936 - DNA, 922 bp, Homo sapiens
tatgtagaagcacatcatcagcaactctgaccacacaatacaagcaactgatttctacagaccaagaagaagcagtggtgctacaactgtgaagaggaggccatgtaccactgctgctggcacacatcctactgctccatcaagtgccagcaggagcactggacgcggaaggaacatagcgcacctgccgccggagaagatgaatgctggcccttcccggagtcaccccgatgattactcttttcagacacagcggtcttagtgtttccacatgaagccaaaattgtctagaatttagcttcccatttaggcagccagcacctttaaacaccttttcgtgaagacaattttgcacagtagtaaaaacatctttgtgtcaattgctcctccgaaacgtcttaacagggggtaaacagtaacatcagtggacgggtattactcatctcaactcaactttcacattgcgcaatttagtctgcatttctcacgcaccattttaagaacattttctaaggttcttacacgacgattttacacctttaacacaacagatctttaaacaacaacaggtggaataccatgtgagttttcaacaacagaaacatttagcacataagatctgacattgtaaacgacaactacacggaactgtttcacgcaaattacacacataactaacttgaatgtgaccatttttttactttaacccttgttggagctgggtatccgtcaggcttcaactatactgtttccaccagggcattaatcatgatggtcacacccagcgggtataatgacaacgcacatcgagggaacaggtttcgaccccaggtcgggtatcgcacaggcaatatttctctacaatattaccccaaataggggtttccaaaatatttcacaatccaacttaacacacagtatg

SEQ ID NO: 637937 - DNA, 258 bp, Homo sapiens
tgcatggatgcactgaataattgcctttcttctaaattccaaccgaacttcttccaacctccaaactggtgaaccccaaatccaagccattaactacacctgacagagcaattgtctgattaatcactgaccccttgaagacagcagaatgccctttgcaatgagagcagatactggacttgcgtccaactggaaagcatttgactatctgaacttggagtgcctcctcagaatggcaggactcacctggatttaata

SEQ ID NO: 637938 - DNA, 224 bp, Homo sapiens
aatcgcgatagatccgggattggaccagaagcgccggtcctcgtgtggcgattactgccttgcgaaacgtcgctggaatttcgtcgtaactcagtggatgcacgcgcttctcgcgcatgcgcagggccgtcgcctgcctcacgcgcgcggcgacgggattcagcgtgtggaagtacacgtcctgtcccatccacaatgcgatcttccgtatcctggtcgtagct

SEQ ID NO: 637939 - DNA, 707 bp, Homo sapiens
gacctgctccagcagctggtgctgcaccagcaggaggtcctgccccctccactgctgctgctccagctgaggagaagaaagtggaagcaaaaaaaaaaaaaaaaaaaaaaaacaaaaaacatttgttgggagcgactgtgccccctagaaagaaagttttataaaccattgtcggttgtggggccgcggcccaggtgggtttaggttgaaccacggtcgccacatgagcggttcccagagggaagactccggggccatgggcatatgggtgcgtgggttttccaccaaataaaaaaagcgccgggggacacacgacgagcgtgttccttgcacacactccaaagtggggagttcagggagacaccaatacgggggctacatacacacagggaggagtcacaaaagggaagagcgtccagagatataacaaaaaattaaagcgcccccgaccggtgggggacaaagaaagacaacaacgaagtcgcgcaaaggacaacagcaaacagacagagcgaagacgaacagaagagaagacaagagcacgcaccagacgacagaacacagcaacacaggcaataagaagcagtagataacaagagacacagagcaaaagaacgaagaaagcaacaatcacagaaagagaaagcaaaacagacgaacagaacactagagcggagcacacgaagagaaagaaaccgagagagagg

SEQ ID NO: 637940 - DNA, 561 bp, Homo sapiens
ggcctcattggttgcgattactggtgcttgccactatgcccaactaatatttggaattttcgcatacgtggattccagaggggtgacatgtgaaacgtggtaccatccagttgcaggaaaacaagctataatacgcccactgattctagattatgctcttacctcccggcagcctctccaggcccagaactttctccagtcaggctctagagaccgagctcatgactcacaatgggctattaaggcccataccctgcgtcacggaagtctccgcagatgagcctactgtcgccttaagagcctccacaggcacagatctatcgttagtatggcctctttagacccagctcctgcgtcgcagcgttctctccaggccctgaagtttctcaagtcgagctcaccaggcccaggtcatgcttctttgcagactctccaggcccagctcctgcaccttggtggtccctccaggcccagcctctgccttccgtcggtctctagagtccgacatcttgctcacaggagattcttcacgcccagcatctggctcactgtggaacctcc

SEQ ID NO: 637941 - DNA, 1983 bp, Homo sapiens
gtttaatgttagtgatgttagttttgttattgatggattgtaatagtgttttgaagttatgttgctatgtgcttttcagtgtatgtgtgctagttgggttagtgtggaagagtttagtctatgtgatgatagggagttgaggttgatgtaagattggtattactattgagtattggataacgggatgattgattaatgtaatgaagtggattattaggataaggggtgtttgttgggtagttgatggtatgattgtatatatgtcattttggtatgatgtgtttagttagttgttgtggttgtgtatgtgtgtgtgggtgtggtgtgtagtaggtggtgcgtggtgtgggtagtgtggtgtgtggggtgtggtgtggctggtgttggtggtgcgcccggtcctgttttgtggttgttgtgcgcgcgggtcccactgtgtttgatgagtccattggcaccccgtttgattgctgtgtacaaatacaacaacataccagaatgttttaagggggggacaaccagactattgatgagaccttcgcgtagagggggtacgccaccgacaagaagtggtggtgggacccgcggagaagaagaacgcacctcaggggcgtttgtggtgtataagactgtcttcggcggcgccccaagtttgtagactgtttatgttgtatcgcgaggttctgcttttaaaaggggtgtaatactccgtaaagggcaccaactttggtgggggttgtgggcagcgtatatatatttgtcctggggccacacccggaagtgggccaacacctattttggtgttgcccctcctgaaataatattatgtggggggaacaccacccccgtcgtaagtttggatgaaattgtgggccgcttttccacacacgcagtcagaagggaggtttttcaaccaccctgcggtgtcttcgcatggtagtaccgtctgtggtgagaacgaccctacacgccgtggtagaagaatttgtggtagtaccgcctcggtggcctcgcgccttggtagaagtaggagtaggtcgccggggggacaactttggagacactccgacggggtcataaaggaggcgggtagaggagatgggagccccctcctgctattgtggggaggagcgtgtgtgtgaggaaaaggtgtggagatgtggagaagacgcccggagacaccactggtgagccgcgtctttgatcgacagaaatacgccccaccacaacagcggtggtcgcctcgatgaataatactttatcgccgcctcataacccgtgtggcgacgttgtgttgagagaaatgttgttcccggtgagtgggggggcggagaacacctctccgggagaggacacaggagagacgcgcacaagacactcctctccgagacgacacagttgaacacatcggccttatgatagagacttttgtcacacacacgagtgtcagcagaagcgcgcagaaatctcatctcttcatatgagatctctcacaacatggtggagagtccccacactgataacagccttgtgagacgcacacacgggggacacacacagttgtataccccttataggtgagatataacacggcgggcacaattccgtatattttctatagagagggctcacatatgagcacacacacacatatagggggttttatacgagccgctccgagatgttgtgtgagatacacaggagacacatctcctgagatttgtgtggcacagccgctattaaaaggtgttcggttgtgtgcacaacgagttaaaatgtcctgaacgtggagttctggaggtttcacgagcccgaggtaaagcccaggtgcggtttgtctatttaacttcacaatttcctcgccctcgtacgcaaaaggaccaaagagaaataaggcctacttctaccaagcgccttcccccgtaaatgaaatcatttccaacttagtatcataccccccacccccccaagaccaggtttgtt

SEQ ID NO: 637942 - DNA, 425 bp, Homo sapiens
cacgattccgagttgcatcattctaaagatatacagtcgaggacttgtgcaggagaatggtcctgtagaagagttcgcccttcatgatcattaatccatagctttctataagaagagtctcagattcaaggattccctgttaggttctgagatttggacatcctcttaattcgcagcttgcctggcccgcagccatgtctcctggcttttagatgggcttttgaatggcctggccctgaccacagtctgcctctgtgggcttgtgggggacagtggctggctgacctgtaaggggtcggctccactcccagcttgctctggctccagctgactggcatacctctggcatctgcgctgcactgggtagggcagggaccaggccctcagcctccctgccctgctgtacctcctcccaaataccccct

SEQ ID NO: 637943 - DNA, 869 bp, Homo sapiens
agcgcttttgctctggcgtgtttgggcctcccggggtggttgctgctgtgccgcggagaggtgcgcgcgcggtggtggcctcttgcgcgtgtggtggtgcgccgagttggctctctcggccgagggtgcgttctcggtcttttgttgcggccggggggcgggtctggctttggctggcaggcagcgtgttcgcttgtggcgagacgagcaggggggtcgcggggggggccgggtcttttgctggcgcgccccgcggctgggttgtgagctggtcccccccgctttgtgtctatggctggtcgggttgtgtggtgttccgctccgccggtgtccatgatctttgcgcggcgagacgagccctaacttcgcgccccgacgtgtggttttctgccctcgggtccatcgtcctcccccgcggggggagcgtgttctttattctccgtcctcggtttcctcctccatcgggttgtttgtgttgttgggcagcgcacgtggcttttcgctggcttgcgtggttgtggtggtggtagcgaggtgttcgtcgttctttttcttgagcgccgggtggctcttccccgccttgtgtggtgttggggcgacgaccgggctgttaggatgagtgttttcttgtttcctcgctcccggctagtttcgctttgtagagtaggggggcgaggccccgctccgctcctcctcctcgccgatctatgtcattttggcgaaagccgcccgctgatcttggtgtgtgtccttattgagcgatggtggcggtgggtctttcgccgcgtgggttgtttcccccggctcttgcggaccggtgggcttctttgcgggtggtttgatacaaaccgggcttttttttttcaata

SEQ ID NO: 637944 - DNA, 919 bp, Homo sapiens
gtgcggtaggattggttatctggaggcgtaacgtgagtctgactcgatgaccgcttttaccatatggttcctacaccccctatctttgaggcccccattctgagtccactatttgttctgcccgtcaaaattgccatcttcgcccatccgcgggaaacaatggtaaacaccgccgcgcttcaatgaacatcacgggatggggcttctttgccgcgcccggccccttttttctcgcgcgccccggcgcaccccttggtgcttggtcattctaatgcaacaccctgctacgtcgcggccccaagtgtggcatcccccttccccggccaacgaagtttgggttccgcccagaatccacatgggtgcgggggccagcccccatgggtgttatccgcgtccccgaaaccgtttatctctgaatgtggttctgtcttgaccgtgcttgcttacgcgcttgtacctcccgccgggtatcctccccccccccggttcgagacacaacgtgccacacacgagcgattttggggagacatatcgcggagtgtcggccacgcccttttctatgagggtctcccaaccagatctcaccctttttccatagggggtccacaccaccgcacaagatccccaaaggacggcggacccaaaggggcccccgtagaccaccccggagtacaagacaaactctgtaacggcccacgctcttggaacgtcacgacatcacggctgctctgtcggaataccacacgcgtgtgctaataaagagagcagagccccacccggggtttgggagctacacccgcgcgaagagttctagaaaaactaagcaaaagtgccccaaagccgccggacgtctcacaccgatgagtgccaactcttttttcaacaatggaggcaaattttttaaaaaaaaacaaaaaca

SEQ ID NO: 637945 - DNA, 733 bp, Homo sapiens
  misc_feature (1)..(1): n is a, c, g, or t
  misc_feature (357)..(357): n is a, c, g, or t
  misc_feature (466)..(466): n is a, c, g, or t
ntgtttcgcttcgtgttgttgtcgtggtggtgggctctaagtttttccgtcggtacccccgcgtgtttctgggggaaacgccggttttcccccccctcttccgcggggttaaacccgccccgcccgcggtgtcttgttaactccgacacccctataatggggcgcgtttttctctccccacctctggaatgtccgtggctcccctgaagtctccttgtgttcgggggatatccggcgccgccataaccttctctgttatgcgcaacaccccttattaccgggagttttttccacgtctctgccgggttcccggacaaaaatctccccgggattttctcgccccctttctccgcccgncggcggactaccaatgctctggtgtgtacacctggctatctttacacaacctagtgaactctgtagagccacgcacgttttctaaagagggagaattattgtttcctancaaagcgaggtgtcaacactaaagaagatagtctatatcttgagaaatattttctatgcgagacattgcgagatgatactaaatcgagtacatccccacgacgaaccaccgtgcgagagcaccaattttcaaacccagaaattcctcctattggggaccacaacccgtgtggggtcaccagtcttctttataagggaatccggtgccacagaaagggcaccaaaaaatttgtctttggggggaacaacaagggcaaacccaaaaaaa

SEQ ID NO: 637946 - DNA, 227 bp, Homo sapiens
gtcgatctctagcaggatccccggtgtcacgtgacattcatgaccagcgatttcagttgggcgctctgccacacagtcatcacgcgtgtctccttagcccaggagaccagcaagatcgtgtggtgtgagggccaagaccctagtctcattcctgctttctcgtataatgccgacctgagctccagggtaccgagcctcgagatttcgtaagtcagtggtcactagct

SEQ ID NO: 637947 - DNA, 358 bp, Homo sapiens
cacaaagcgcagggattacaggctgacctagcgtgcctggcctctataatgacatctgttatatcagctcataccattaggatgcaatatttgcatcatgcgccttgagctgtatatcacatagtcaacatatgacaccttagtgctatgtacttactccagtgactaggagtctagtaccactagcagagttacctcatgcattacccttttctgcatattcattccaattcgaactggaggtctgtgtactacccctgtatgattggctcatctactaagtggagggatttattactgtgatacttaactcaaattggtagaaaaatgcatgcatttacccaaggcaatcaagctt

SEQ ID NO: 637948 - DNA, 665 bp, Homo sapiens
  misc_feature (576)..(576): n is a, c, g, or t
  misc_feature (612)..(613): n is a, c, g, or t
  misc_feature (615)..(615): n is a, c, g, or t
ttcggcacgagaaagtgcttaatagaaggcactggccctcctcctgaacagattctttctcctgtgggagcttgctgactctgttagatggagagaattaatacttttcccatgaggttttttcatagtaagtatgaaaacctgggatctgcataggaaaaaagactcagtagtaactctccgttaatgactttgaatagccaagatttatgaagtgtttactaagcctgtaactgttccaagtgttttacgtgtattaactaatctttgtcacacctgtgtgaggtaggtgccgttattacaggttgagtatccttaatccagaaatccaaaatcctccaaaatttaaaactttttgagcactgacaggatggtcaaaggaaatgctaattggagcattttgaattttagattttcggatttgagaggcttaatcattaagtataatgcagatatcccaaaacctgaaaaaaaaatccgaaatccagaatacttccaagtcccaagcatttcggatgaagggtactcaacctgtttcccattttgcagataagacaactaaggaacaaaaagatnccggagggggaggcggaggttgcagtgagccaaganngngccattgcactctagcctgggcaaaaaaagtgaaactctgtctcaaaaaa

SEQ ID NO: 637949 - DNA, 1106 bp, Homo sapiens
caggacactggtgaacagcaaatgctccacgactgggacggaagcattgcctgatgcctgtacatggtgggcactgagagaacaagattcctgggccctgccttccatacactccccacgatcttggaggaagctctgaggacgccactgctgatgaacccgacagacaggagcgactaactgcgctatgacagcacataaaatggcctaaagaatggagaaatgttcgatggacctgcttgactagtcctccaggtggtgcatgttggggaagctggctcctttctagcgttctaacaatcgcttcctctagacactgtactagtgcatgggaccgcccccgatctaatcataccatcgtgccttctatgagttgtgcaacaatctagcggcgctaatacagctcaggtcggcaccatgaagggctcaggcgtgcaagacttggttagactccgttccttgcaacgcaggtcggcggggtgcaacgatcgtagcggttgagttagaaagtatgcacggaagctagttactgtgttgccaagcctcacttccgtctcccggagatggcatagaagagtatcttaatgaaagtcccctgtgccggtctggacccattgtagatgccggggttcagccccccagacatgttagcaaatacggctacgcggtcaagcatggagacatcccttcctggggacataggtacaagggcaagcatgtggccattcctcatgccttatgggtttgcccaatccccatggtgtaaatgggaataagccaagagagctagccctcttttcaacaatcggtcttctcaaccaagaatgttccagggcagtgaagggggttgggccctaggtgaattgtgcaagggacctagtcctcaccatgactagtaaaccaacctgcgtcaggcaacctagggcaaagtcgaacatagaagcccctttttggcccccacggatgggtctaggtattagacaccaatgctgtggacatccgcacattcgacccagagagggaacggaagagcccggggccaaaagggggtaccttccttgaagaggtccccagaagggccaccaatccgtacaagacaacatccc

SEQ ID NO: 637950 - DNA, 894 bp, Homo sapiens
  misc_feature (279)..(279): n is a, c, g, or t
cacatgggcatctgcacatccacaggagtcatccgggacttcgcgggcccctactttgtctcacaggacaacatggcctttggaaagcctgccaagtactggtaagttggaccctgcctcaggtctatgctatcgggcccaacgcatgtgacacggctgtgcacgacgcctctgaggagtacaagctccgtaatgcacaatctctgctgtgacaactgccactcgccacgtggacattggaccctgacatctgatgcagctacaatcaagcagcaccanactggacatatgcgtgcacgctctgcctgtcttctgcgctgtactctacgcgtgaagtacgctcagcgatcggggacctatcgtgtaatgacctggcatgccccttcatccattcgtcctggagcacttcatcctacactcgtcaggccgtgcgctctttaaaccgtctcaggtgactaggctagactcgtagtgagaccccatcagcctcatccacagggatccccagatggaataccacgctcgaccaatcgccattatgtgggtatcccatgaacttatattatatcgtccctacagcacccatacaagcgcaaggggttaggagccatagctgagttgctgagaaccgagcgggatcaggcgggcttggtcatggatgtggacatggacctgacggaaccatgcattgaacgtgggcggtattgtccgctctcctctgtccctcttcagggaagcagccgctggtccccgtctctcctccagggcactgtgtacctccggcgccttgcgaagacccactttgcttcttgctgtgtgaaacggccttggtgcttcccgtgtgtagcagcgcacgccgggactcatcttgctggaggtcctgccctcagccca

SEQ ID NO: 637951 - DNA, 579 bp, Homo sapiens
tcactctgtaaagcttgtaaaaacataggctatcatagggtgcttaatcataagcctaagacataccggttatcattcacattccaaataagtaattcagagagtatttttcatccataataaagctatcaatcaaagacatgaaatacagtcttccagtggtaattctcatgggcaggacaagcattacatctcacaacttaagcttagtaatccaatagtcaaagatgaaaaatagggatggaaattaaatttagactgcttgctgttatgattactagggaacaataggtcatgtaattaactgaagaacatacttgatcctctcaggatcctactcagtaacttcatcctgggtaggaagcatgtttagaagagagatattatttttccaggatccaggaaaacagggctttaccatctctcaaagtggctatcacttcctgtcctgggcatcaaccctgtgtagcagacactgcccctctcccctcaggccctactgcaatagtgcaagatggattccctactcccagcatctctatggaatccagagaattaacagtccgatctccctagagt

SEQ ID NO: 637952 - DNA, 560 bp, Homo sapiens
  misc_feature (7)..(7): n is a, c, g, or t
  misc_feature (147)..(147): n is a, c, g, or t
cggggtngctactcagtagggcaataaaccgcgattgctcaagaaagttagacaatacggtaaaaagcaatgcgcgcgtcaactccgcttcgcagggtctgctgggttgctgcttgctgtggttggcggctagccggaacattccgntgtacggctatgacaacgataaccggggttgccaccggaccaggcacacaggttaattcttatttaaaaacaacagataatcgttgatgatgttacggttgatgtgggtgattaatacgtgatttaacgttgagagttcaatgacgttattgttgcacgcgaaggcggccaggtagtcggaagggtaaacgtagcatggttattgacgcttacctctacctctttttcggtcaggatcaccacgcaaggttcactgctgctcaattgcatttcgcactcctcagatatcagaaactccgctcaaaggatctatgcttcctgcatgagtgatcggcccgttcgccgataacgatcttctttctttagcacgctttttagcaattaatcttgatggaattcgcggccgcgtcgac

SEQ ID NO: 637953 - DNA, 1089 bp, Homo sapiens
gaccgttgactattctctacaaaccacaaagacattggaacactatacctattattcggcgcatgagctggagtcctaggcacagctctaagcctcgcttattcgagccgagtcatgggccgagccaggcaagcattcataggttaacgaccacatcttacaacgttatcgtcacagcccatgcattggtaataatcttcttcatagtaaatacccatcataaatcggtaggctgttgcgcaactgacttagttcccctaataatcggtgcccccggatatggcgatttccccgcataaacaacataagctgtctgacatcttacctccctctctcctactcctgctcgcatctgctatagtggaaggccggatggatggaacaggttgaacagtctaccctcccttagcagggaactactcgccacacctggagcctccgatagacctaaccatcttcgtccttacagctagcaggtgtctcctctatcattaggggccatcaatttcatcacaatcgaattatcaatatgaaatcccctgccataagccaataccaaatgccccgcttcgtctgatccgtcctaatcacagcagtcctacttctcctatgtctcccaggtcctagctgatggcatcgagtatactactaaaagaacggaacctcaaactacacgttcttcgaacacgacggacggtgggagaacccattatatacaaaaagtattctgatagtcggtaacccgaacgttatatcttattctaccaggctcggaatgaattcccatgtggtaacttactaatcggggaacacacagaacagttggagaaacaaagatgggcagagcgaacggaacatgggacgcacggggaatcagtagacaacccgcaaaattacacgaggaaaaacagcagaaacaacgagaaagttcaccacgcggacaagaacaacgggcaacccaggggcacaaccaacagagcgccacacgggaggagaagagaacacgccgagcgaccacgaagacaaccaggagcacagacaacaacaaaacaagcagacagcgagacacaaaacaagaaaaaaacgata

SEQ ID NO: 637954 - DNA, 302 bp, Homo sapiens
ggctcgcaccgctctcgtgaactcctcagtgtctcatccatgcatgggggataataatagctcctgtctcagagggcggcggagaaggccagataaagtggcatgagtccatgtcacaaggcttgattcaacctcgtgaagcatgaactgaaagaaacacctccacccttgtatttcctacccactcacaagtcttatgacgccccagagtatatctcgctttggccccctcacttagtccctcttcccaacttcacaggagctctcccagtttctccacctgccttgccccccatgctacc

SEQ ID NO: 637955 - DNA, 291 bp, Homo sapiens
aagacaagatactgactagggtgggcaacatagtgagaccgcatctactatatctcaaaaaaagtttatatcatctatagaaactaacatatataactatgataagcagtcttgcacaagacctgcgggatcaggagtccaggactgtcctgggtgcccccgccttgccctggacgtgagagtgctgtgtggggtcccgggagcccctggtcccacaggcagggccgacaggcaggtgccgtgcccgtcctccctgcccacgccaggtgctcagagggacaggtgggccag

SEQ ID NO: 637956 - DNA, 174 bp, Homo sapiens
agatgagtagtgactacatcttctctccttgaaaaagttgccgatatgttcgaggccattgcacataccatgcctccttatcagcagatctacgaggcttgtagaggagattcatcccgtcctgacatgaagcaagaagactaccacctagcagcgctcgtgtcttgtcgacgc

SEQ ID NO: 637957 - DNA, 230 bp, Homo sapiens
cgggctagcagatcccctgagccagcgagtccatagcactcttgggcagcatacttgccatagtgtaaaaattagctgggcagggctgggcttgatggctcacacctataatcccagcaccctgggaggccgaggtgggtggatcgcctgaagtcaggagtttgagaccagcctggccaacatggtgaaaccccacctctactaaaaatacaaaaattagctgggtatag

SEQ ID NO: 637958 - DNA, 903 bp, Homo sapiens
ttcgaaactctgtagctcaagataaaggtgattcttagaggtcgatatattttttttttttggaaaacttagtctcgctctgtggcccagggggagggcgggggcgcaggactgggctcaatggcaaccttcagcctcggggaatacaggcgatgtcgtccggccatcagcctcgtgaggggccggaactggcaggtgcgtgccaccacacataggcaaatcatgcggagttttaattgggggacagagagggaataccccgtgtaggccggggggagcacgagccggacctcaaagtgatcaacctgccgcggcccaaaaggtgcggggaataacaggcaggaagccccttgctaccgggcggagactgtgaaagaccgtgggctgttaacatacggaaccaatcattacaggggcattgaacacaggactctcccctcccggatatggccagaattctagacacaacaacggtcgttgggcggacaagaagtcgaccaaaacagggaacgactggacatccatcacacaggttcatgtgagaaaaataatgggacggacagacgggggggtaagaataccccgcaaaacggaacgggcgctcggagtattaagtgcaagccagcacggacgcaagggctgaaagcccagaccacccaataaaccagagtgtccccacacaaccacgggactactcctgggagggcacccgaagaacaccctaggagaacaggacacacaaccgagacagtacgtcccgacacatgaaggggcggaaaacacccgtaaaaagggctacagagcgcgcaaaggcctacacgcagacaacaccatggccctcacacgagggacaaaggcccaacctaccaaacggggcgacgggcagtacaagaaggagggctg

SEQ ID NO: 637959 - DNA, 743 bp, Homo sapiens
cgccgccaccctgagccggagcgtggctggtggccgccaaggtcaagatggtggactacagcgtgtggtgaccacattgaggtgtcgtgattgatgaagacgagacgctaccccaactagtcgacacggccagtctcttcctgtggcgtgcatcaggcccgggtgtgaacgcatggagcagttccataaggagaagcgaggaactggacaggggtctgccgcgaagttgccaagctgcaacggtgtgccgtaggtgccatgaggtccactgacaggcagctggcaggtgtgccgagggcggctaggctaggagcatggaagctgccttgcaggcccgaggctctagcagacttgcgccaacggagggcgcggttagctggcgtagccatcacagctgtgagccggagactgcgccacagagggacgaataagcgtgcgcctggaacgttggacacgctcatgccaatagactggcgttctagcaaagaagcagtgggtacacatacctgggcgctgtacgaagagcacccgggcacgggacgcggcacttacatgtacagagacacgctcgatggtggaaacgaggaatcacgcaactaagaaccttttcggctggggagattgccgttcaccgacggaagacgcgcgcatcaaagccacattttggacgcactggctttccgcaccgccactggggcatgcaccagcacttaataggtaccatggccagacatgggcgtcca

SEQ ID NO: 637960 - DNA, 612 bp, Homo sapiens
gttttttagaataacacacaagcacaagttactattcctttattagctgcagaacataaatacaaatacatattccatatgctcgcatacaaaagcatatataaaaatgctatttactggacttgacagtctaatcgttgcggttattcaattgcaggtatcatacatatcattgtattatattaactttataagcacttggatcaagcaaatttggaagaacagctttgtgagcttacaaattttattccaagtgctattctttaaacagatgcaactaaaacgaggtcttacctttttaaaagaggacactaaagagcttattttataaaaagtggtccgcaaactcacaaacacccaaacctacatataaaggtggtctatgttcttaggaatcaataagaagtgaggttacaggggagagggagtgaacaagcatgacggttcctgtgaaatccattccaccgagcagtcactcttatgtgtccagtttggccatcgggagttatgctggctcagtcatctaagcctatgcttctgatcatgctgatattcacagttttgatcttggagcactagagcttctggacttcatgtggaataagttgcgac

SEQ ID NO: 637961 - DNA, 283 bp, Homo sapiens
  misc_feature (1)..(2): n is a, c, g, or t
  misc_feature (67)..(67): n is a, c, g, or t
  misc_feature (71)..(71): n is a, c, g, or t
  misc_feature (86)..(86): n is a, c, g, or t
  misc_feature (88)..(88): n is a, c, g, or t
nnaaattttttcaccaaacaaacaccaaaaagggggttttttatctacaaataaaccccctagctgnagtnattataatttaacantnaaccacaaatattaataacttagtgaaaaaaatttttatctaaaaaaactttcttaagacaatttagacttaaacaatattactacaaaaaagttttattaaagaaacttctacagtttacttcaagaaaaataaaaaaaccacagtagagtttttagatgcaagagcaatttaagtataaatttatcagtttta

SEQ ID NO: 637962 - DNA, 418 bp, Homo sapiens
aaaaaaaacccacacaaaaagaccaacaaacggcgcaacaacaagcgtactcccagccctggacgacaaagagtgaagacttcgtctcaaaaaaaggaaaaagaaaaaacataaatctttaaaaataactagttgctgggtgtggtgctcacgcctataatcccagcactttgggagtccaaggtggaaagatttcttgagctcaggaatttgagaccagcctgggcaacaaagcaagacctcatctctgctaagaataagagaaaattagctaggcatggtggcagatgcctgtagtcccagttagtcaggaggcagaggtgggaggattgattgagcccaggagagctggtctgcagtgagctacgatcatgccactgcactccagcgtgggtgacagagtgagaccctgtctcag

SEQ ID NO: 637963 - DNA, 153 bp, Homo sapiens
ctcttcctctaaactgttctagattcccaggcgcctgctaggaacaggtgtgggccacccttggggtgagctgcctcccagaggcctggaaggaccaggccttgcacaatcacctgacaagtggacgtagcaagagcaccccgcaaatggaca

SEQ ID NO: 637964 - DNA, 198 bp, Homo sapiens
tcatgttatacggtaccgtcgcttgtactgaggttgggccgccgatagggctattgaataaaacctcaccatcaaaagtagcgagcctgcgacgtacacccgccagaccaccagaagcatttttatctagagcatttaatggaatacccccagcaccatcatcttgtacttcgagcattacatgggattgcctatgag

SEQ ID NO: 637965 - DNA, 129 bp, Homo sapiens
aacccccgcgaggggggtgtgggacccccaaaaggggggggggaagggggggccccccccccccccccattgtttgggtgggggggtttagggcccccgggaccaaaaaaccccccaaattttttttta

SEQ ID NO: 637966 - DNA, 396 bp, Homo sapiens
acacccaagggaatgggtcctgcaaaaaggaatgccccacaagtgttcccatgccaaaactggaagattctacaatgttcccacgcatgctgttgccattgttgtaaccaaccaagttaaggccaagattcttgccaagagaattaatgtgcgtattgagcccattaagcccaagagccgaaatagcttcttgaaccgtgtgaaggaaaatgttcagaaaaagaaagaagccaaagagaaaggtccttgggttcaattaaagcgccagcttgttccacccagagaagccctctttgtgagacccaatggaaaggaccttgagctgctggaccctattccctatgaattcatggcataataggtgataaaaaaaaaaataaaggctctgtgggccac

SEQ ID NO: 637967 - DNA, 172 bp, Homo sapiens
atcctgtgtaaataccatgtaactactcgtctctagtctttacaggaatttccatttctttcctggttgagacacaaacacccacgtttaacggagggcaacggagtgaccgtgtgtttactgtgtgcctgaccgtggtaaacgcccccgcgaatttagtagtagtaggcgg

SEQ ID NO: 637968 - DNA, 511 bp, Homo sapiens
  misc_feature (290)..(290): n is a, c, g, or t
  misc_feature (339)..(339): n is a, c, g, or t
  misc_feature (385)..(385): n is a, c, g, or t
  misc_feature (414)..(414): n is a, c, g, or t
  misc_feature (434)..(434): n is a, c, g, or t
  misc_feature (489)..(489): n is a, c, g, or t
tgtatttttagtagagacggggtttcaccatgttggccaggctggtcacgaactcctgacctcagataatccacctgcttctgcctcccaaagtgctgggattacaggcgtgagcaccatgcccggctgggcttgtatcttttagcttgtgttagtaaaaggattctagtatgaagtccagattcaaagggatctctgttaatacccactgacaggcatatgacctaacaggaggttggtagcatagatccaagcagcagttgccggccgtagatggcctatcagtttcnggtgccttgcctaagatctgaaggctttgtttcaacagttggaagtcantgtggtccagctgacttggaggaataaggatactctagagtagggnatgattccagataattcggggattgaacnactgagttaaggccgggacnaattggttagtatagaattgaagaattaattttgcagcggcccctgggtggtggnccgtggttggcgactgtccggc

SEQ ID NO: 637969 - DNA, 1157 bp, Homo sapiens
ttgtttttttgttgtttttttgttttgtgggcggaaggggggaggagtggggggggagcgaaggaagaaaaaaagagaagtaccctgggacgatttttgtacacatatcatcctcctgtcggtttgtctctctcactctgttttgccacaaatagtgttccatttgcggtcacccttttggggaggatctggttccccttgaatgtgccaatagggtggatgcttaacaccccttggaccatttttgtgacacttcctaatttctcctctccacactctctgggccccaagaaaaaaaggggttttacttcgtaatgaagtgggctgaccctgggcacaacttggttttggcaccggggctctttttggtgtctacaatacacgggttctggcacaacaccctttgccttacccgcatctgaggggaaaccttttgcccacccgaaagttcggcccctttcccgcggccaaaccttgttgtccccgccacaccccccctggggaaggaggggtccaaatacctccgggttctaaatctcccctcggggacccacgtggttgcccctgtcgacggggtacctgtagatggcccagaaattttcttcccttgccctggaactgtaccacccccgcgcgttggttgggttccccccacactgtcctctctcttgggtggttccccggccccgaagcgttgtcgttgtcctgccccaaatcgctctgtctatgggttctccccacccgtcttttcggggccacagggcttcctctgggcccggggtgtttacccacagctctttaggggggcgcctaacccccctttgtttgcacaccctgtcattgtgtcgttggcgtctaccccctatttgccccaccgtttgcgcccctgttgtgaaactggggaactcgggccctttggggggtgccttcatcgtatttgccccaccactagtggcacccctcgccccacaagaggtggcctgccttcctttcacggctccgcctgtttccggcttgtagcccctcttttggtggaagattcccccccctctccccccccccctttcccagggcaggaccccggccgacccttccttggccccccccacacccgatacggggtgtgtcgtgtttataaagagtttctcctttggaca

SEQ ID NO: 637970 - DNA, 167 bp, Homo sapiens
cgcgctcagcttcgggtcgccggccagcgcggcgttgaccgcgacggtgatgccggcgtcatcgacgctggcgcgggcttcggcggtggcttccttggcgtcggccacggcggcatcggtgccggcgcgcacctcggcggtggcttccttgacctcggccttgacct

SEQ ID NO: 637971 - DNA, 226 bp, Homo sapiens
atatatttttctttgaggggcaaagactctgatgggtatgtagtagtagtaacccatctaatagtaggagatgataaaaataaatcttattctcttactaccttcatagatataatatctgtaagcctccatttcttgattcgtgaaaataatcaggactattttaactccttgctaataagggtaagaaaatcagtacacttatacctccctttccccagctacc

SEQ ID NO: 637972 - DNA, 124 bp, Homo sapiens
tgctctacgaggatctccccagctactcaggaggcaagacagctggttgagtacactgagaggtgcatgtgattatctgtttatgttggagacatccagtcacactacaagtcccatagaagta

SEQ ID NO: 637973 - DNA, 1002 bp, Homo sapiens
gaaatggcggatgacgccggtgcagcgggggggcctggtgggccctggtggccctgggatggggaaccgcggtggcttccgacggaggtttcggcagtgtgcatccaggggaccggggtcagcggaccgatggactgagtggcctgtgggccgagggccagcggagactcgctggagggcaaaggccgcaggcatacggagttggatgccctgtcaccaaagttggagcctgcattggtcaaagtgacaattgaagatcacgatccactggagggagacatctcatctactatcatccactgacctaattaaggaaagtcagagaagtcatgtgacgttgtcattaccatgggggggaccgtctcattcaaggggacatgagagatacgctgacaggacttagttgccaaggtggcaagacaggcgcaggcccgcgtgacccgagacacaagacggcaacgcagaggttatcaagatggcagttatgtatagcgtgattcgagagggcacgttaacaccagtgggaccacaacagagtcagggcactcattggggatgataaaacacggtaggcatccgccaaaaggcaagcggatggggacccaacactgaagccacaattcacacgatagaggcatgcccaccagtacaataccgcttgcgacacaaaagaagagtcaatccccaatacggatacaccgcaggaaatgcacgacgaggaagtgtacctaaacttgtgaataggggacaatcacacaaggaactatcagtagaaaagcggacgccccacaaaaagagcgtgggcatagcccggttttggccaagcggggctaggaaccaagggacaccggaacattgagccgcgagatccagtgacatgacattggactaaccgaaccatgtcgagtacgactgctttggcaacacgcaaaggaggcgcaacacatggggaacaaatcggattacttccagtcagacctatcggtggcccatagagtgaaa

SEQ ID NO: 637974 - DNA, 157 bp, Homo sapiens
aacaaacaaacaaacaaacaaacaaataaataaatatatatatatgtggcatttttttaatgcatctatcgatggacacttggattttgtttcaccttttagttattgtgaaaacactgctatgacatgggtatacaaatatacatctctatatttg

SEQ ID NO: 637975 - DNA, 763 bp, Homo sapiens
tttttatttttggtctttttttttaaaaaacaatatggtttgaaggtggtcttcttgggtagaagtcattgcacatggtaaaatcaatggaaacttaggtcctcgccatctatataaaacacggagagaggaggcccagatggtatgcggggccagggaaagcacgggggtgcatatcatcttgagggcaactacgaaatacttgagctttaattataaaaacaaaagctcaaaaaaatcttatatctccaccaaagaaaaatacagcgttggcatgataatatagtgggggaaccagtaggggacaaaacaagatacggccacattagacagccagtagtgatacaggggaagaacctgggtcaaacccatctctaaattctactttggggggtcaggggataaggagaggacacgggtacaaacatccggtagtacttcacgaaacatcagtccagctcaagaacaaggtgctcgggacaaacagtccgggagagagacaggggcaccattcgcaattggtgaaaaacccttatttcagcgaaacatatgcaggcctcaaggcggtgacataggaagaggagtttggaacaggcatcggaggctcatataatcgcgggggtatcatacacagtggtacagtaaacgggttgagacaagacccttccccaaattaggggggtaataagactaaaatacccgcctaagtaacaaaaaggacaaggagcgcccttgaacgaaccgctgcattcaaaattcggag

SEQ ID NO: 637976 - DNA, 1074 bp, Homo sapiens
ctctagaggatccgatgatctccagaagaaacagcccagggtaaatatatagtgggggaaaaggaagtgaagtgaaatgggaaaagtcaatttgagattatctggagttttaagaagtttgttggtttttattcagtgggagagacttatagctgcaaatttgtgttttatatacgtatatctcttttgtaataatagccaaagaaagtaaaaatcataaattagctcttttcagagctccctctaagcaaggtacccagaaccctggcaagttagcacttggtgtggagaccgtggctcaccggactggtgatggggtgctttttcatttctgccacctttcttggtcattgtaagggcaaagcgggcatactcccatggcatcgaacttttgtcttaaagtaaatcaaggccgttgagttgagaatgctttgcttttgttctccaagtgtatcttcatggagcaaaagtcattgatcccactgagaaaattaagactcagaagtatcttttaaaatcagtttagagcaaaatggggcttaagtaaaacattgaaatcctgaccatattcaccagtcacttatttaggaccaagaaacaggtacacgccttggcattttctgctgtgaggtgtgaagatgggtttctgtcgtgtctaacacttagcgttgttctccatccccatggacatcatgcacatgcagcttctcacccagggaatgcacttcgtagcccatcaggctgcaggcaagagccgctgcttctgatggtttggtgactgaggatagtaaatcactgtgaagggaattctggccgggatttcatatgttgtaggggctcagctcatgccctgcaagttctgcactggctttgcttttctgttgttatagtcttttcatatgagagtaatacacttcaaatatctgcaaaataataaaaagaaagctgctttctgcttcacccccaaagtaccactgtgaacatcttggtacaattttttctgttttgttcacccttctgccctatatttctttcttctggagttcatcggatcctctagatcgacatcaccca

SEQ ID NO: 637977 - DNA, 229 bp, Homo sapiens
  misc_feature (44)..(44): n is a, c, g, or t
aatcgagctcgtaccgactgcatctgtgctcatgtgacaaaaanagtttcgtgagatctaatcaggttcacactgacagtagcccccccttatcctcgggagatgcgttccaagacccacagtgatgcctgaaaactggatagtaccaaaccctatgtattctatgctttcacctatacatacatacctaggataaattttaatttataaattaggcacagttagcagt

SEQ ID NO: 637978 - DNA, 427 bp, Homo sapiens
tgaacggtctgtataaggccttgactggccgtcatttgaaccttacaaaacgcttaaatgaccttggatatctaaccaagagacatgtgtgataaaataggactcggctatgtaacaacacaattagtttgtatcttggttattaaccagtatctgggactgatttgggcagaatattaaacttactattgttgccaattattgtttacccgagtataatgtagctatatagcacatgtgcttggttttacaaaacacacttctccttgggcaacaagtactcctcttttaatattaccttcccactacgcgtacactgcctggacatagctcttgtgcacccttaaaataaattgtttagagtgtattatgagccccagacaaataatgtattaaaagttatccccttgctactttactgatacct

SEQ ID NO: 637979 - DNA, 422 bp, Homo sapiens
  misc_feature (210)..(210): n is a, c, g, or t
  misc_feature (308)..(308): n is a, c, g, or t
  misc_feature (375)..(375): n is a, c, g, or t
agaatattatggtaaattgttcgcctaaggagagttgattctgtgaaaaaaaaatcagttaaaaatttttttcacagctttattgagatttaattcatataccatacagttcacccatctaaagcatacaattcagtggtttttaatatattcagagttgtataaccaccactactctataattctagaacattctcatcatccctaaangaaaccccctattcattagcagtcattcctcagcccctggccaccacaaatctactttctgtctctatgtatttgattattctgggacatttcatatnaaatgaaatcaggacaatatgtaggccttttgtggaccgtctttcttttcactgcaacaggaatacntttccggggttcttcccttctggtttacatctttccctttccacatc

SEQ ID NO: 637980 - DNA, 177 bp, Homo sapiens
  misc_feature (159)..(159): n is a, c, g, or t
caccccatgagcggtatccaatataaggaggccgagcccagtccctttcaccaaaggtaattagataataaaaaaaaataaatgccacgcaaatttttcctttaaaaaaattatccccccatccatgggggaactccgggtaacacgcatagatatatnataaattttttttggggg

SEQ ID NO: 637981 - DNA, 830 bp, Homo sapiens
  misc_feature (96)..(96): n is a, c, g, or t
  misc_feature (129)..(130): n is a, c, g, or t
  misc_feature (137)..(137): n is a, c, g, or t
  misc_feature (181)..(182): n is a, c, g, or t
  misc_feature (197)..(198): n is a, c, g, or t
  misc_feature (234)..(234): n is a, c, g, or t
  misc_feature (259)..(259): n is a, c, g, or t
  misc_feature (277)..(277): n is a, c, g, or t
  misc_feature (358)..(358): n is a, c, g, or t
  misc_feature (362)..(362): n is a, c, g, or t
  misc_feature (364)..(364): n is a, c, g, or t
  misc_feature (367)..(367): n is a, c, g, or t
gattgcgcgtgtggccatggcggccagcggggctgtggaaccagggcccccgggggctgcgtcgccccgtcgccgcccggcccgcagctgcccctnatcacctgtccggccatcaggccgaggacgagnngcagagncacgagatcgagtcgtatgcatgaactgtactgaatggatgacnngcctcctgtcaccannattcccttcttcagagaaataatagtgagctccttntcctgcgagcactgtggtggaacancacggagatccagtcggnaggcaggatccaggacagggagtgcgctacactttgtctgtcagggctctggaggacatgaacagagaagtggtgaagacntgantntgnatgcacaaggatatagctgaggctaggattattgaaacttccctgctataagacacagagaaaggagctctgaacagtgaatgaaggatgatcacacagtgatatctcctggacgttggagcaggaccagcaatgcacgaagggaaacaagagatgctacaggctagaaagaacttgataagtacatcgaaaatgaaggaggctaagaagtagactgccctataataatgatattgatgatctcacgaaacagtctagcgacgaacgaactgcctgctcgaagatgatgccgagtatcaacactaaccgacagacagacgaaagatcagcgactcaagaaccaaagagcccaccgaagtccgatcaggaccgcgcaaatgcagagaggcccaacgtagtacaccatagagaacgaccgaacgacgcggcatgcgaacaacgcccccacatcgcatacaggcgt

SEQ ID NO: 637982 - DNA, 542 bp, Homo sapiens
  misc_feature (30)..(30): n is a, c, g, or t
gcctataccagagcccccccccggcccggnttccgcctttggcgccaaccaaaagttctttacccttgcgctttcccagcgggggtttttcaacgggttcaacttcggcaggtgggagtggccaccctttccggaaccttgggcattctggcgggccacgtggccccctttcaggttcttcggccggggctggttgtggggcattcaaagggcggcccccaccttcccaatactttgttagcagcgggtccattgcagtgaaccccgactttttggggcagttgttggcccaaaaggccgttaccctggacatgttggacctgggggcaaccaaggcaaacttggagaaggcccaggcggagctggtgggggcaactttcaaggccccccgggcaaagattcaaattcgaatttaggcccaccaggccctggtgaaggccctggagtaggggagccaacccccaaggttggcctcaggtttggagccccctttggatgaactggccccagcccccgccccctttaagacccgggaggcttga

SEQ ID NO: 637983 - DNA, 204 bp, Homo sapiens
attgagaaatgactcgtctctgtatttgtattaagccttaaccctttttttaagggcattcggggccaacattttttaaagctggaccaaaacaaaaagcctggactcccatcccaatgtcattttgataggagcgttttgttttttttccaaggcagaatggggggtaacagttgaattaaacttagcaatcccgtgctcaga

SEQ ID NO: 637984 - DNA, 108 bp, Homo sapiens
ttaaggtgtgtgaaatcgttgcagagatgtgtatctgcactgccttgagaaatcctttcaggcagcggactgaaactgtagaataaaacaagatggggcgagcggccg

SEQ ID NO: 637985 - DNA, 1083 bp, Homo sapiens
ttatgtttttttcctaatactgtgatctatctgatctgcagacaagaaccttgtctctgttgaagagcatcgatgtgtacataatctccccttgatgctctacaatcagagacaaggttcgttagtgtgcagatcagatcataatcgtgtgttagggaatataatagatgtgatggtgggtgtgatgtgggggaagatgaggtgtacaggaggagagaaaaaggcatgcgatatttaatataatgttgtatgctcgtattcggtagtggttagattatcgtactcttaggacatgaaatggatgggaatattaagaaaatggaacgagaggtattaagaaataatactagtatatattaacatgactgaattgtgacttgatgtaatagaactgcgatcggctgtgtgtttgtcgtattaataacctaaggggtggatccatattatgctgttgataattgatattgtttgagcgagacccatcgttaggatctgacctattccctggtgtctggattcatcccaatcgctgaaagcgtggtgagctttaatagacacatacagtggtgatctaatggtccgaatctaagcacgtagtatagccaatctgaatagactggatgcatcctggagtaccttggcaatacggtaacgaccaccctcaactttctgctgaagacgcctgccatttgccaaatacatgatgaccatggaacaatacggttgtgtcctggagcacaaaaagcgggggcgcagaaatgccgacccgcgtgtcacgccaaggcggaccacaccgtcacgaccagtcggccgcaccagcgaagtacccgacggaacccgcaggccatagtgaacggagcgcaaacacaaaccgcgtcgctccactgaaagccttgctcgcgatgtacggcctgcgaccacacgagcagcaagcgcggcccgacagacgcgagcgcgcaacccacgcggcacccaggcccaaaccgccgagcgacacaccaggctcccaacacagcacacacccgtaatctgccagcgcccccgaccaggcggcactcaggacgcactgcgccaaacaatacg

SEQ ID NO: 637986 - DNA, 991 bp, Homo sapiens
tcggacgggcgcggagacgcttctgcaaggaacgccgtgatggctgcgcacggatatccccaggtccagcttcagacttgtattggttggtgatggtggtactgagaagaaacgaccttcgtgaaacgtcatttgactggtgaatttgagaacccaagtatgtctgccaccttgggtgtggaggttcatcccctagtgttccacagccaacagatggacctacttaagttcaactgtatgggacacagtcctgcgcccaggagaaattcgcgtggactgtagagataggcatattatatccaaagcccagtgcagccattcataaatgtttgaatgtaacatcagtagagattacttacgaagaatgtgcctaagcgtggcatagagatctggtacgatgtgtgtgaaaaggcatccccattgtgttgtgtggcaatcaagagtggagtattaaggacaggatagagtgaaggcggaacactcccattgtcttccaccggaaaggaagaatctttccggtactacaggacattgtgcttgctcatatacgtaatcttacaaactttgaaaagccccttcctctgtgcctagtctaggacagcttcatgtggagaccctaaacttgtgaatttggtggcatagcctgggtctcgccccaagcaagaagtttgttcatggacccagctttggctgcacatgtattaagcacgaacctttataaggttggctcaagaataacttgctactcccctggatgtaaagaatgatgacgtggtgaagaaatgaagtttggaagtcccagcggtcagaagtcttaagatttataaggcgggtggcctgttaatttcaggggggcaaggggttgttgcaccctctgtattttctactaaggggaacaaggcgctactggggaagctggagagaataaggggcgcccgaaggggagtgggagttaaaaaaactatgtgaggttataagaggaagaggaatc

SEQ ID NO: 637987 - DNA, 1002 bp, Homo sapiens
  misc_feature (260)..(260): n is a, c, g, or t
aatcccgatcacgatgccgcgtactgggaagtccgtaaaagaaaagatgtgctataccgagtttagactgccgacgttgctaagtctgggtgcatcctatcttccggagaccaaaccaagcaccaccagacagggccaatgtaagttctcaaggccagaacaatgaggcaaccacacgtgatgccgtgtcatcatatggcagaggtgtcctgtcaggagatcccgctgagaaaggtctcctatgagatgagccgatcaanaagagcgtgagcactcagaaatcacagacttggagtctggaaccagttccagacacgttcagatccgagtctgatctggaaatgtctctagttcagtcaaacatgctctggcgtggctctagagagaggcatctgtggatagaatggatgtacaaaaggaatgaagtagtgcgtaacgtactcgattatgacatacatttgagttggttcctcaccaaatatactatagactcgacatagtagctcagtagtgtaaccatttcctaggcacgtcgcacgtatatggccttggtgggtttttcctcgtactcacagcggtattcacagatcctcagctaggctttggatgtaggtggggctcatctccctcattttttctttggctagggaccctcgtagcattacttgtataacgagtcaatggaccggaaaagggcatccatctggatctcatagaatttctggacgttccaccacagagacatggttcactgggtagaaaggttgcattggcacagttcttggcaatcgaatattgtcttacgaacctggtgcgacatccgcttggaccagagggtcacttttggtggtagatcagtgcaagccactttcactgaaactccaaaggttgggaactccagggcataccacgtcctgggttctcccagagagagataaatggcgtgcttaacacgggttggacccgaccccaggcacgggttttcaaatttccttttcaccg

SEQ ID NO: 637988 - DNA, 509 bp, Homo sapiens
gatcttgattcccaggtttcccagaagggtcttggcccggttatacagccccagcccaaatcctatttcaagagcatctctgtgaccaagatcactaaaccagatgggatagtggaggagcgccggactgtggtggacagtgagggccggacagagcactacagtatcccgacaccgaagcagtatagcagatcctagtgggtgatccacgaatcaccatagacctccggaccctggatcgatgcctctttccatccgtggacattattcctgggacagttggttccgagtcccaggtagcctgtgttaaccctcagagcgccttcaaagtcctttcctacctctacaccccattgcccaccagttaataagcgttagctctctctgtgccacactcagagggcattgagatatagtggagatagatgacactgagggccagttgtcaggttatgtcagctctacccagaactgatcccaataaaacccttgtattgtatgctgaaaaa

SEQ ID NO: 637989 - DNA, 2729 bp, Homo sapiens
  misc_feature (17)..(17): n is a, c, g, or t
  misc_feature (32)..(32): n is a, c, g, or t
  misc_feature (35)..(35): n is a, c, g, or t
  misc_feature (38)..(38): n is a, c, g, or t
  misc_feature (40)..(40): n is a, c, g, or t
  misc_feature (46)..(48): n is a, c, g, or t
  misc_feature (50)..(50): n is a, c, g, or t
  misc_feature (54)..(56): n is a, c, g, or t
tgcaggctggtacggtnccgaagttcgttcanctngtncntccgannntnatgnnngacgcggctgtcgcgagggcgggggtcggggctgcaggcggggcagggctgggtgggggcgcgcgacgcacctgcctgcttcctgcacgggtggtccccaagcactgcgggaccccagcccaaagcggaccttgactaccgcccagccccgcgctcccaggacctcccgcccgcggagcccactcggattgctctccgcccgggtcggcggaggccccgtctcctgtacccggcgctgggactgctccgcaccgcgcggctccctttcagcagctgcgggagcatgcggaggaggccctgccggccccgcgggtcatggaggagttccggcgctcctacagccgcctgtgcagggagagtggggccgagccccaggaggctgtcctgcagcagctgcaccagcttcccaggggccggctggacctggccacgcaaagcctgacggtggagacctgcagggccctgggcaagctgctgccgagggagacgctgtgcacggagctggtcctgagtgactgcatgctcagcgaggaaggggccacactgctgctccgaggcctgtgtgccaacaccgtgctgcgctttctggacttaaagggcaacaaccttcgggctgcaggggccgaggctctgggaaaactcctccaacagaacaagtccattcagagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctggacctgcgctggaataacgttggcctcctggggggccgggccctcatgaactgtctccccagcaacagaaccctgtggagactggacctggctgggaacaacatccctggagacgtcctcagagccgtggagcaagccatgggccacagccaggaccggctcaccaccttccaggagaaccaagcccgcactcacgtcctcagcaaggaggtccagcacctccgggaggagaagtccaagcagttcctcgacttgatggagactattgataagcagcgagaagagatggccaagagcagcagggcgtcggcagcccgtgtagggcagcttcaggaagccctgaatgagaggcactccatcatcaacgctctcaaggccaagctgcagatgacagaggccgccctggctctgtcggagcagaaggcccaggacctgggggagctcctggccacagcggagcaggagcagctgagcctgtcacagaggcaggccaaggagctcaagctggagcagcaggaagctgcagagcgggagtctaaactcctcagagacttgtctgctgccaatgaaaagaacctgcttctgcaaaaccaggtagacgagttggagcggaagttcaggtgtcagcaggagcagctgttccagaccaggcaggagatgaccagcatgtcagctgagctgaagatgcgggccatccaggccgaggagcgcctggacatggagaagagaagatgcagacagagcctggaggactccgaaagcctgcgcatcaaggaggtggagcatatgacccgtcacctggaggagagtgagaaggccatgcaggagcgggtgcagaggctggaggcggcgcggctgtccctggaggaggagctgagccgagtgaaagcagcggcactcagcgagcgtggccaggctgaggaggagctgatcaaggccaagagccaggcccgcctggaggagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgat

SEQ ID NO: 637990 - DNA, 209 bp, Homo sapiens
tcgataaggcaatgcagcggtttatcagacagggcgtgctgagagacatttgtgaaaaagtgcctttaccgaccacacatacacagagagaaagagagagagagagaagaaagtgcccagggagttgaaacaacttgagggctgcaaagagcctttaaagtcccttggtagaacctgttaactttcagatcagattggcccttatcgag

SEQ ID NO: 637991 - DNA, 861 bp, Homo sapiens
ggcgtcctttgttcttatttttttataaataagttccctatgttaaaagttactgagaactaaagaatatagaacatggttataggcacttagcatgctatcaaatgcaggaattcacttcaataagaagtgcttgctttgtaagcatggttcatggcacgtagaagctccaacttgggagaggatgctttccgtgacaaaaataataacccacaaaaaaaatggtggttgaaggaaaagagtccaaatttacagatgctttaaacttctttgggccttggatcagctttcactgttaaaacaataaacgcttggtgggtgaatgctattctcacgttgcaaaagttaaatgcgtcgtatgagatgggcgaatctgggtcagatatgcatttttaaagcagcaaaaccaccggccaccaatatcttccttgtgcatgcatataaattattttcttctaattcaaatggcagcagaggaatcccggcgtgcatgtgcatggagacacacacacatcactaaggacacaggagaaactatcataaaataagcagtatcccaaacacatcatcatctataggctgtttacacaaggtagaactacaaagaactgaatgtcctcagcgtaacaaggcaaagtctatttgctccatctctgggtggcgccaattatcttacttaagggtttcacagaaaagccaccgttttaattgaacaggcaattcagtaccccagaagtttgactggggagcactaatcagggatggaagttttgaagcaggtactaaaaacccctttaaaaaggtttaaaacccattttactcaagggccatttaagatgagtgttaagatccgtggtccaa

SEQ ID NO: 637992 - DNA, 2802 bp, Homo sapiens
  misc_feature (17)..(17): n is a, c, g, or t
  misc_feature (32)..(32): n is a, c, g, or t
  misc_feature (35)..(35): n is a, c, g, or t
  misc_feature (38)..(38): n is a, c, g, or t
  misc_feature (40)..(40): n is a, c, g, or t
  misc_feature (46)..(48): n is a, c, g, or t
  misc_feature (50)..(50): n is a, c, g, or t
  misc_feature (54)..(56): n is a, c, g, or t
tgcaggctggtacggtnccgaagttcgttcanctngtncntccgannntnatgnnngacgcggctgtcgcgagggcgggggtcggggctgcaggcggggcagggctgggtgggggcgcgcgacgcacctgcctgcttcctgcacgggtggtccccaagcactgcgggaccccagcccaaagcggaccttgactaccgcccagccccgcgctcccaggacctcccgcccgcggagcccactcggattgctctccgcccgggtcggcggaggccccgtctcctgtacccggcgctgggactgctccgcaccgcgcggctccctttcagcagctgcgggagcatgcggaggaggccctgccggccccgcgggtcatggaggagttccggcgctcctacagccgcctgtgcagggagagtggggccgagccccaggaggctgtcctgcagcagctgcaccagcttcccaggggccggctggacctggccacgcaaagcctgacggtggagacctgcagggccctgggcaagctgctgccgagggagacgctgtgcacggagctggtcctgagtgactgcatgctcagcgaggaaggggccacactgctgctccgaggcctgtgtgccaacaccgtgctgcgctttctggacttaaagggcaacaaccttcgggctgcaggggccgaggctctgggaaaactcctccaacagaacaagtccattcagagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctggacctgcgctggaataacgttggcctcctggggggccgggccctcatgaactgtctccccagcaacagaaccctgtggagactggacctggctgggaacaacatccctggagacgtcctcagagccgtggagcaagccatgggccacagccaggaccggctcaccaccttccaggagaaccaagcccgcactcacgtcctcagcaaggaggtccagcacctccgggaggagaagtccaagcagttcctcgacttgatggagactattgataagcagcgagaagagatggccaagagcagcagggcgtcggcagcccgtgtagggcagcttcaggaagccctgaatgagaggcactccatcatcaacgctctcaaggccaagctgcagatgacagaggccgccctggctctgtcggagcagaaggcccaggacctgggggagctcctggccacagcggagcaggagcagctgagcctgtcacagaggcaggccaaggagctcaagctggagcagcaggaagctgcagagcgggagtctaaactcctcagagacttgtctgctgccaatgaaaagaacctgcttctgcaaaaccaggtagacgagttggagcggaagttcaggtgtcagcaggagcagctgttccagaccaggcaggagatgaccagcatgtcagctgagctgaagatgcgggccatccaggccgaggagcgcctggacatggagaagagaagatgcagacagagcctggaggactccgaaagcctgcgcatcaaggagggtggggagtccgtgaggagaaggtagggaggcccgctctccactctggccccacaatccctgccctgagcaggtggagcatatgacccgtcacctggaggagagtgagaaggccatgcaggagcgggtgcagaggctggaggcggcgcggctgtccctggaggaggagctgagccgagtgaaagcagcggcactcagcgagcgtggccaggctgaggaggagctgatcaaggccaagagccaggcccgcctggaggagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgat

SEQ ID NO: 637993 - DNA, 2496 bp, Homo sapiens
ggcagcccgaggtcgcttcctctccaggctctccaatttctgtgccgtagttaaagcgagcaggcgcgccccttcctgcacctgggagtagagggcagttcctctgtatgacgggggagaggccttaacattcgcggtcttacctggttccccgcgtgcagagccggcttggtgcctggcaggggctgcaggtgtttcaaacatgacttcgcagcgagactcttggccagcgccaacccagaccatcgggacagttgtcccttcctgggtctagggagctgccctgaaaaggggcccacggggcagggccttgcgggtcagcaggggcagagagtgaccgccggccccccttacacaggggccacactgctgctccgaggcctgtgtgccaacaccgtgctgcgctttctggacttaaagggcaacaaccttcgggctgcaggggccgaggctctgggaaaactcctccaacagaacaagtccattcagagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctggacctgcgctggaataacgttggcctcctggggggccgggccctcatgaactgtctccccagcaacagaaccctgtggagactggacctggctgggaacaacatccctggagacgtcctcagagccgtggagcaagccatgggccacagccaggaccggctcaccaccttccaggagaaccaagcccgcactcacgtcctcagcaaggaggtccagcacctccgggaggagaagtccaagcagttcctcgacttgatggagactattgataagcagcgagaagagatggccaagagcagcagggcgtcggcagcccgtgtagggcagcttcaggaagccctgaatgagaggcactccatcatcaacgctctcaaggccaagctgcagatgacagaggccgccctggctctgtcggagcagaaggcccaggacctgggggagctcctggccacagcggagcaggagcagctgagcctgtcacagaggcaggccaaggagctcaagctggagcagcaggaagctgcagagcgggagtctaaactcctcagagacttgtctgctgccaatgaaaagaacctgcttctgcaaaaccaggtagacgagttggagcggaagttcaggtgtcagcaggagcagctgttccagaccaggcaggagatgaccagcatgtcagctgagctgaagatgcgggccatccaggccgaggagcgcctggacatggagaagagaagatgcagacagagcctggaggactccgaaagcctgcgcatcaaggaggtggagcatatgacccgtcacctggaggagagtgagaaggccatgcaggagcgggtgcagaggctggaggcggcgcggctgtccctggaggaggagctgagccgagtgaaagcagcggcactcagcgagcgtggccaggctgaggaggagctgatcaaggccaagagccaggcccgcctggaggagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgat

SEQ ID NO: 637994 - DNA, 607 bp, Homo sapiens
  misc_feature (477)..(477): n is a, c, g, or t
  misc_feature (588)..(588): n is a, c, g, or t
  misc_feature (600)..(601): n is a, c, g, or t
ggtgtacagacggcgagtatacgtgatgcgtgattagtaagctggactcgtgagtatacatgacgcgcgagttataaatgatttcttgattgtaagctaggagggcgagttataactccagcatgagtgtaagatgtcggccgaggttaagcgcacagtgtgtggtactctgactccagtgcaagcagtagccgaggtcttagtgtgggcttgggcattggcggaggtagcagctccagcgtcaaatatgtctccaccacctcctcctcccggaagagccttcaagagctaagaagcctgctgcaagtcactgccttccaagtgcagcaacaccagcccatggagattgcctcttctaggcagttgctcaagccatgttttatccttttctggagagtagtctagaccaagccaattgcagaaccacattctttggttcccaggagagccccattcccagccctggtctcccgtgcncgcagttctatattctgcttcaaatcagccttcagttgtcccacagcatggcgcctgctagacacgagaatccaaagtggttcccagatctaaatcatcaatacagatcantacctcggcccnnattttt

SEQ ID NO: 637995 - DNA, 2667 bp, Homo sapiens
  misc_feature (17)..(17): n is a, c, g, or t
  misc_feature (32)..(32): n is a, c, g, or t
  misc_feature (35)..(35): n is a, c, g, or t
  misc_feature (38)..(38): n is a, c, g, or t
  misc_feature (40)..(40): n is a, c, g, or t
  misc_feature (46)..(48): n is a, c, g, or t
  misc_feature (50)..(50): n is a, c, g, or t
  misc_feature (54)..(56): n is a, c, g, or t
tgcaggctggtacggtnccgaagttcgttcanctngtncntccgannntnatgnnngacgcggctgtcgcgagggcgggggtcggggctgcaggcggggcagggctgggtgggggcgcgcgacgcacctgcctgcttcctgcacgggtggtccccaagcactgcgggaccccagcccaaagcggaccttgactaccgcccagccccgcgctcccaggacctcccgcccgcggagcccactcggattgctctccgcccgggtcggcggaggccccgtctcctgtacccggcgctgggactgctccgcaccgcgcggctccctttcagcagctgcgggagcatgcggaggaggccctgccggccccgcgggtcatggaggagttccggcgctcctacagccgcctgtgcagggagagtggggccgagccccaggaggctgtcctgcagcagctgcaccagcttcccaggggccggctggacctggccacgcaaagcctgacggtggagacctgcagggccctgggcaagctgctgccgagggagacgctgtgcacggagctggtcctgagtgactgcatgctcagcgaggaagggcaacaaccttcgggctgcaggggccgaggctctgggaaaactcctccaacagaacaagtccattcagagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctggacctgcgctggaataacgttggcctcctggggggccgggccctcatgaactgtctccccagcaacagaaccctgtggagactggacctggctgggaacaacatccctggagacgtcctcagagccgtggagcaagccatgggccacagccaggaccggctcaccaccttccaggagaaccaagcccgcactcacgtcctcagcaaggaggtccagcacctccgggaggagaagtccaagcagttcctcgacttgatggagactattgataagcagcgagaagagatggccaagagcagcagggcgtcggcagcccgtgtagggcagcttcaggaagccctgaatgagaggcactccatcatcaacgctctcaaggccaagctgcagatgacagaggccgccctggctctgtcggagcagaaggcccaggacctgggggagctcctggccacagcggagcaggagcagctgagcctgtcacagaggcaggccaaggagctcaagctggagcagcaggaagctgcagagcgggagtctaaactcctcagagacttgtctgctgccaatgaaaagaacctgcttctgcaaaaccaggtagacgagttggagcggaagttcaggtgtcagcaggagcagctgttccagaccaggcaggagatgaccagcatgtcagctgagctgaagatgcgggccatccaggccgaggagcgcctggacatggagaagagaagatgcagacagagcctggaggactccgaaagcctgcgcatcaaggaggtggagcatatgacccgtcacctggaggagagtgagaaggccatgcaggagcgggtgcagaggctggaggcggcgcggctgtccctggaggaggagctgagccgagtgaaagcagcggcactcagcgagcgtggccaggctgaggaggagctgatcaaggccaagagccaggcccgcctggaggagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgat

SEQ ID NO: 637996 - DNA, 154 bp, Homo sapiens
gtgagtatgagtatgtacatatcttcgaagggtatgagactatatggaaaatggactcatatgccttaaacaaagaataagaaagatcgagaaaaagaagctaaatgggaggattataaggatatgctagaaaagaggagagcatgttaatcca

SEQ ID NO: 637997 - DNA, 377 bp, Homo sapiens
  misc_feature (55)..(55): n is a, c, g, or t
ggaaaatcgtgcgcccggcctcgtccaccggacagaagacgccgctacacaatgngagtctcgctctgtcgaccaggctggagtgcaatggtgcgatctcggctcactgcaatctccgcctcccggtgagaggtgaagccagctggacttcctgggtcgagtggggacttggagaacttttctgtctagctaaagatttgtaaatgcaccaatcagtgctgtgtctagctaaagtttgtaaacgtaccaatcagcgctctgtaaaaatgggccaatcagcactctgtaaaatggaccaatcagcactctgtaaaatggaccagtcagcaggatgtgggcggggtcaaataaaggaataaaaagctggtagccgaaaa

SEQ ID NO: 637998 - DNA, 1470 bp, Homo sapiens
gagaagagatggccaagagcagcagggcgtcggcagcccgtgtagggcagcttcaggaagccctgaatgagaggcactccgtctcctgtacccggcgctgggactgctccgcaccgcgcggctccctttcagcagctgcgggagcatgcggaggaggccctgccggccccgcgggtcatggaggagttccggcgctcctacagccgcctgtgcagggagagtggggccgagccccaggaggctgtcctgcagcagctgcaccagcttcccaggggccggctgttccagaccaggcaggagatgaccagcatgtcagctgagctgaagatgcgggccatccaggccgaggagcgcctggacatggagaagagaagatgcagacagagcctggaggactccgaaagcctgcgcatcaaggaggtggagcatatgacccgtcacctggaggagagtgagaaggccatgcaggagcgggtgcagaggctggaggcggcgcggctgtccctggaggaggagctgagccgagtgaaagcagcggcactcagcgagcgtggccaggctgaggaggagctgatcaaggccaagagccaggcccgcctggaggagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgat

SEQ ID NO: 637999 - DNA, 139 bp, Homo sapiens
cctctgctgcaagcacggtcttagtggatgctcgcggactctggtcatggtaaaagctctttatgcccttactggtctgtgccagtaaggactgctacaaaaaccccaggttatacgaaataggccagatgatataggc

SEQ ID NO: 638000 - DNA, 180 bp, Homo sapiens
ctagaggatccctgatgtgtcagtaatatctaaagacaattggcccccatctggcccttgcattaacttctgcgtacttactgggagtagaaacagctcaaagtgttcaacaaagtgctgagattttaccttgtcttggtcctggatggacagtcttgtacttttcagccttatgtcgca

SEQ ID NO: 638001 - DNA, 182 bp, Homo sapiens
  misc_feature (6)..(6): n is a, c, g, or t
taggancccctcatcgaaaccctaaaccctggaatggttatctgtgggatcatcttccatagaagggagatcttttaaataaaaaaagaagatgatgataaatggccagctgagctggcctagggtgagtgctcctatctaggagggggggaggcaggtggtatacagggagggtttgatga

SEQ ID NO: 638002 - DNA, 652 bp, Homo sapiens
taaaaaccctcatcaataaatggaaacttccaaaaatattcaaaccacttctacaaaagtgccagttatcgagggcgggcggtttcgaaacccaaagtgaatgttgggttgttaagggtgaatatattagtggggcggataaagacaatatggtgagaaaattgtgagcccatatatgtggacctgtgagaatgtcccgggggaacctctgtgtgggtcctaccaaaaatatgtttggacccctgaaaaatcccgtccgaaattgggtggaaggggaaatccaaattaatctcctgggggtcttgtgagaagggttaaaatataaaaacacccaggattaaacatagggttaataaacgcaagggcttggaaatattaatgtgggttctcgcgggtgtgtttctcttattaacactttagggggtgaacaccccgagggtgatatgtgaataactcctcgtggatggcgaagttaaataagggagatgttgttttagaggagaggtgggcacttccaggggggatattaaaggcgggggtgaaatgccgtgtgtggggggccccggtgcccctccctaaattgggggggtatagggggccataggccggggagttgtggctaaaggggggctccaaaaaaaatctctctggc

SEQ ID NO: 638003 - DNA, 363 bp, Homo sapiens
cagggccaagaggtaaaatcaaggatattacaaagatacttatgaaacaagacagaagcaaagtgcagtggctcacgcctgtaattctagcattttgggaggctgaggtgggcagatcacctgaggtcaggagttcgagaccagcctggccaacatatagacaacatatatgttacaacatatataatggccaacatataatacaaaaattagctatgcatggtggtgggcgcctgtaatcccagctactcaggaggctgaggcaggaaaattgcttgaatccgggaggcagaggttgcagtgagccaaaatggcaccactgcactccagcctgggtgacaaagtgagactctgcctcaaaaa

SEQ ID NO: 638004 - DNA, 158 bp, Homo sapiens
tcgttggtctccattttacgagtcggcttctgcaagttcaatccattgacgctaactgttgggtagcacgcttggtagttgtagacgtttgcaggtaagggagatttctgattcgtacttggagttgatgctcaggtccccagcccggtttgcatcct

SEQ ID NO: 638005 - DNA, 389 bp, Homo sapiens
cggcgtttttcggggaacgagcgttgcttttctgtgaggcaaggcttgtgtgccgttctctgaataggggccactttctttggtccagagtgccggcagtggaagaagagtaccctgctcgcttcagactattcttcaattttctcctcgtccatggaatctacagtgacactcctccacagtttctgaaattctgcctcgccgagcgtggtggctctgtaatccaagcactttaggaggccaaggcaggcggattacctgaggtcgggagttcgagaccagcctgaccaacatggagaaaccccatctctattaaaaatacaaaattagccaggcgtggtggcacatgcctgtagtcccagctacttgggaggctgaggaaggagaat

SEQ ID NO: 638006 - DNA, 298 bp, Homo sapiens
tataatgggtggccgagcagacgcatgaagggccgtgatttgaattgtattgaacgaacatagctcttggaggggaccaaataggttctcggggaaacgtgctcctttcccataagacactgacttgtaaatagctcacagtgtcacctgggccaccccatgaggtctggcgctgttctcaaaccctgagaacgcaggtgatgacaagatgggggatttggaaggatttcgtgaagaggaccttgtttcctgagcacacacttttgtaatgtcaaagctatagttaaagtgacagtac

SEQ ID NO: 638007 - DNA, 315 bp, Homo sapiens
cccgaccttcaggctgatgcaggcccccaccttactttccttaattattcctgggctactgggtcgagctaactttggaggacatttaggctatggtttaaataacaggcctgccaaaaactcaaccacttatttttttgagacgaagtcttgctctgtcgcccaggctggagtgcagtggtgtgatctgggctcgctgcaatctctgcctctgggttcaagcaattctcctgcctcaacctcctgagtagctgggattacaggcgcatgccactgagtagctgggattacaggcgcctgcaatcaagcctggaa

SEQ ID NO: 638008 - DNA, 407 bp, Homo sapiens
aagaaacgggaagttcttcttgcggtatcccttcatggcgtcacaaggtcaggtgccgggttatatttagcccttccggtgacaatagcgtaacggaaaacctcgccgcatcttctgcgtgctttgttggctcgttccattgcaccgcgatcttcaaacctgcggattacttccagcagttgcatcggctcaatatcctgaatttcaaggccgccaatgataggtaaaatgtcgtcgtcaaacattttggcaagttcagttgcataccctactgaccatacttgcttcttgtgctcgtaccattccttgtaaatcgcactaaaggaattgttgttagacgagcctttttcgccttacaggatccatgccaaccgagatgtctttcctcgcagtccatgctttatccc

SEQ ID NO: 638009 - DNA, 190 bp, Homo sapiens
gctggatacaggcattgtgccaccatacccacgctattattgttttgattttttgtagagacaggctctcactatattgtccaggctggtctcaaactcctggactcaagtgattctcctgcctcagcctcctgacgtgctgggattacaggtgtgagccactgcgcctggcccaaatatttgatctttg

SEQ ID NO: 638010 - DNA, 247 bp, Homo sapiens
  misc_feature (43)..(43): n is a, c, g, or t
  misc_feature (47)..(47): n is a, c, g, or t
  misc_feature (62)..(62): n is a, c, g, or t
  misc_feature (83)..(83): n is a, c, g, or t
  misc_feature (85)..(87): n is a, c, g, or t
  misc_feature (89)..(90): n is a, c, g, or t
  misc_feature (117)..(117): n is a, c, g, or t
  misc_feature (132)..(132): n is a, c, g, or t
  misc_feature (172)..(172): n is a, c, g, or t
  misc_feature (184)..(184): n is a, c, g, or t
cggcacgaggcaaaccccacactcagtcaaattcatagaaatntgcnttctcttgctatganctgttttagattatgtatatntnnngnntgcacttgcctagtaatttagaatgangctcttaaaattggngctttccaaatcaatatcacaatttagagactgataaganaccaggtatttntactggactatagggggtaaattctacgctgcgcaaactaacattctgctttgtaagtaaaat

SEQ ID NO: 638011 - DNA, 390 bp, Homo sapiens
cgccaccactgacctgtgacagtgaatctacactgccgcgttttgtgtcgcggggcatactcctgctgtcagacctgtgctgtctgtgccctgtgtccctggctgaggatccccaaggagaggctgtccagaagacacgatacattccacacatgatcaggatcacccaacctttaacaagatcacccccaacctgtgtgagttcgccttcaagctataccgccaggtggcacaccagttcaacagaaccaatatcttcttctccccagtgagcatcgcttcaggctttgcaatggtcttcctggggaccaaaggtgacactcacaaagaaatactggagggcccggatttcaaactcaccgagattccggaggctcagatacgggtttc

SEQ ID NO: 638012 - DNA, 385 bp, Homo sapiens
cgctgacctgttgctgcaacacgatgaggtcttgcaggatctgcacgggctgcacggcgcagtcgtgttcggcagcaatccacagcgccgcttcaaacagcgcagggggtgaacggtccaggcaggcgaaaaaggctgtgcggggattcattgcgttctccggcggatgccccgttttagccttgctgagaattttcgtccagtgacttaagcaataacccacctgcttatgtcgcagatcccacgaaatccggcggcttattccagcgcacttcggcagttttctaccgcaagcctatacttgggcctctaccagaagtgattcgggagctcgacgatgtttgcgcttatgcacagcacccgccttgagtcgctgcacctgagt

SEQ ID NO: 638013 - DNA, 696 bp, Homo sapiens
  misc_feature (128)..(128): n is a, c, g, or t
  misc_feature (162)..(163): n is a, c, g, or t
ggacccggcaggcctgcgcgggcaacatggcggcgcccgggagcggggccgcttccacggcgggaacctcttcttcctgccggggggcgcgcgctccgagatgatggacgacctggcgaccgacgcgncggggccggggcgcggggcggagagacgcggccnnctcggcctcgacgccagcccaggcgccgacctccgattctcctgtcgccgaggacgcctcccggaggcggccgtgccgggcctgcgtcgacttcaagacgtggatgcggacgcagcagaagcgggacaccaagtttagggaggactgcccgccggatcgacgaggaacttgggccgcacaacagcatgggactgtcctcaacaacactggccgcatacataaccccgacctgcccaccccagaacagcagcaagacagtggcccagttcagacattatgttctaaggtattaactccctgtgaggagtgtgctgaagaccctaagaaaaaaggatgtgcagggaaccacccagacaccggcagcccgggcatgcttcacacagtggctggccacgtgcacaatgaagtgaacccgcaagctgggcagagcgtgacttcgagtgctccaaaagtggagagcggggcgcgtacggctggaaggatgctcctgtgagtggcggtggtcagcatagctttccgggagagcaacagga

SEQ ID NO: 638014 - DNA, 99 bp, Homo sapiens
tcaagcttctaacgatgtacggggacatgatattctgcctatggcacaaattgtaaacctttgtttttctaaaataaagtaattgaaaacctgcaaaaa

SEQ ID NO: 638015 - DNA, 428 bp, Homo sapiens
tccccggaaattcggcctttatggccggggggtggcttgagaaaccgccagtatttgccagagccaccaaaggctgaccagaatcctgggggaccaggcaaccttgcttttaagttttggaggccgttgaaccttacgttcccaaggggttaaaggctgaaccattaaccttccttgcggatttttgcccactttttgagaaggggggccaattcaggaaccaacctgcactggttgagctcgtgaaccacaggcccagggcaccaaaggagcacctgaaagctgtaatggttgattccgcagttttggtaaagaagtgctgcagggttgccgataaggaaacctgttttgccaaggagggtaaaaaactggttgttgcaagtcaagctgccttaggctaataccatcccattttaattcatttgttt

SEQ ID NO: 638016 - DNA, 288 bp, Homo sapiens
gggttggggccctggggggggtttttttttcttttcttttccccttttctttttttctttttaaggtggttgcgggaaaagggggccaccccgattgcatatccgggccttgggtattttatgcttttttggaaaaaacccaggtcagggggcccgggcccccccccccctgtttggtttcccgcaaatccacggctttttatttacccttaaaccaattgttttggggggtaggccccccccttttagaaattagtcctttggaaaaaaaattccatttccctggga

SEQ ID NO: 638017 - DNA, 827 bp, Homo sapiens
cggatagctgcggcgggagtgctgctgctgatgcccgagtccgatgctcgcgggcgggcgggcccgagaaatgcactacggtgataggaaagagagccactattctgaagaacacttgtgcaaagggtcattatcgttaattgtgatgctctttctatgctgggggaattatgactgggccctgcaaagcaaacatacaagctcaaaaactctgtaaaaatgaccctgagggaatcaaggatctaattcagcagcatgtcaagttacaaaacacaaatagaagacctaccaaggtcgaacagcaacataaggatccaattaaagccttttatgaccaacagggcctcacacacgctaggagtttatcagcacctatatttactacttccactataaacttagtggagaacggaaaagagatttcagaaaaattaatacaacggaaatggacacacaggttgcgtaatcagaatctaacaggtggcaggatgaggggtagaaggtagatgattgtgagtgtcatcatgaatatttcacacacccattcaagtcaggctacacaaagataaaggcaaagaaaaagaagtttcgaagaaaaatgaatcagaacaaagttcaaaggtatggtagattcagccatatgaactattagagcagcagatttggaagaaagcatatggagagaaacaaaagtttagaataaaatcttcgcagaagtgaacaccaagggaatttggctaataatatgaaaattgtgagaaagataaataacaatggaatatgggcttattggaaaaaagatagcaggaatgagaaaggataaaaag

SEQ ID NO: 638018 - DNA, 914 bp, Homo sapiens
  misc_feature (126)..(126): n is a, c, g, or t
  misc_feature (405)..(405): n is a, c, g, or t
  misc_feature (436)..(436): n is a, c, g, or t
  misc_feature (565)..(565): n is a, c, g, or t
  misc_feature (640)..(640): n is a, c, g, or t
  misc_feature (751)..(751): n is a, c, g, or t
  misc_feature (759)..(759): n is a, c, g, or t
  misc_feature (784)..(784): n is a, c, g, or t
  misc_feature (786)..(786): n is a, c, g, or t
  misc_feature (789)..(789): n is a, c, g, or t
  misc_feature (841)..(841): n is a, c, g, or t
ggagactttcttcgccgagagtcgcgcgggtctcctgcttcaacagtgcttggacggacacccggcgctcgtgtccccagcccgggcaggactgtgcctatagtcagccctccagttcacacatcnttcagcggtgaccctcggaactgtcctcgaaggaccctcctgacgcagtgcgtagtctcagcagcgctggggatctaatcgagacatgcacgtccgtccagcgcaatctcatcactgtagcttccgcatactcactgattgacgctgcgtcccacacgtcgtcatggtggcgtccgagaacatatccagcaagggacctcgagagcgcacggctatccaaactcggccaagaatcgaaagcctttgcgacgcagtcctatcgtctcgtcccctatcagntttgacgcgtggtctcaatcgatctttgacntagccctttgtgaacactgctgatatgattgttagcgcctattggaaggaaacatttgtgcgcaaaaagataacgtattcggtatcgacaacaaatagattcctcagtgcagcgaacgatgcgcgcaangcaattaggcgtagagtgagaaacccttcgaattagaagaggtcctggcctatgaaaagcgcaaaatccggtagngctcgcgaccagggaatttcctctcccctattcagagagtgaatcttacagaagacgccagaacttcgtggaatgaactcttgaggcaagatgcgggtgcgcttgatactngcctactngagactcttgtagtcatttgaacantnttngcgaagataacacagatcggtcgtatatccaatggtcccacgtaatctaggncatatctgtggcaaatccaaaaccgtgagttccggatctgtggaccattcacaacacatttgagggcccccta

SEQ ID NO: 638019 - DNA, 165 bp, Homo sapiens
  misc_feature (2)..(2): n is a, c, g, or t
cncctggggacccaggctctgctctggatttacctgcctcgtcatttgcgcttcgtggtcaccagttgttcaccacaggggtgcgcttctggctacctactcagttggtcttgggcacctgcctgcgacacttcctggaggagccctggcttattggtggaggct

SEQ ID NO: 638020 - DNA, 539 bp, Homo sapiens
atccccgttgcgcttagactgtgtctgcgtctcagaatcaaagatatgcagactcatcaagaacatataaacatatgaatctaaggagactaaataaactgagagatatacgatattacactctgtagatcaacacattccataaaatcctattgtttttactttttacgtggaaattgacaaactgaatctaaaacttatgtggaaatgccaagagccaagaatagccaacacaatcatgaggaagattaaaactgatactagatatcaaaaaaaactgtataatttagaataggatagagaaataaaccagtagaatagaatagagagcctaggaaaagacccatacatgtatggggcctaatgtgtgggcaaagatgagactgtagggaaaagatgatcattttagtaaatggtttggggttaattagatatccatattgagaaaagcattaatcttaactcttaacctcattccataacaagaaaatcaactctagatggattgcagatctaaaagtgaaaggcttagcttctca

SEQ ID NO: 638021 - DNA, 262 bp, Homo sapiens
  misc_feature (170)..(170): n is a, c, g, or t
cactttccagagatagccactgttttttaaagagacagagtatctccctgttgccccagctggagtgcagtggcacaatcatagttcaccacaccctggaactcctgggctaagggatcctcctatagcctcagcctcccaagtagctaggtatacaggcatgtgctacncatgcctggcttacttttttttttatttttacaattttggagcagatgtggctcaaggctgggtcatcaaactccgaggcctcaagagtgat

SEQ ID NO: 638022 - DNA, 863 bp, Homo sapiens
  misc_feature (128)..(128): n is a, c, g, or t
gatccaccgggctgcaggaattcgtgacgagggttgcgtggagtaataagagagatgaagagggtggactactgctgttcagcgatggttgctctaaagagtgatattgatgactgtgctatcaatantacacataatacactggctatgaaaccatatatctcacttaagtaacacagtagatactctgtgtatcactaagtaatagacatgaatcattgactattatttaaagccaacacaacagtgtaacagatataagctcaataatggtaagtatcgatcagaaaatataggaggcaaagttcagatgatgacaattgtgtatatgctactggatgctgaaagtatctctaatgaagtatagtgagtatcacacaatatcactgcccgtcgtatacaacaactcgaggtggggcccggtcgccaattcgacctatagtgagtctgattacaattcacctggtcgcagttgacaacgtcgcgactaggaaaaccctgacgtactcacattagtcgcttgatacatgcgcatgcgcagctgcgcatagcataagcccgtacgtcgccttcgaaagtaggcacctgatgcgatgcaacatgagcgtacatatgtaaatcacgtaaatttagtaagcagtcatcttaacgacagctgaatcgttaagacgtgctcacgtaaggcgaaacgttacagcgaggccttctgacatacctatagttttgggcagggcgaggctatcgacttaagtagccggtaaagtgcggaagcgcaccggcgaagtggagagcaagacgcctggcttaaattcggacccgttcaccccccgcaaggctcaggcgaaggctttggaaatgaacct

SEQ ID NO: 638023 - DNA, 566 bp, Homo sapiens
tggagccggtaccctataggcttggagctgtggaaatagcatctcaaggacaggaatgctgtcttatttatcactgtccctgtaactagcacatacagtatttccaaaagatcttaacaggctgaaatgaaatacactgaaccaaatgagataacgataattgccagatcctacccttccctccaaatatcaaaggcacaaatacaagatgcaggagataatgtcttcagggctgttcctgagaaactgactcatgagttctcagttgacagttaacatgggtcgtggctgcaaagatcgaacacaattttatatgtgcacatgtgccccattaggaggagcaaggaaggtgttattcctgctcagctctctgcccctcagaaatggaatagtaaataaagttgggaagcatggaaaatgagtttaatatgccatgctttctcagactaacggcagtgagtcatgtgaaattacacagttagctttggcaaactgtttcccattatgccctgagggggaaggtacacttacacacagaagagctcctttcgaggcaggggatggga

SEQ ID NO: 638024 - DNA, 147 bp, Homo sapiens
tcatgattgtctgcgaccaccttgtacgaggcggtcgcggaagtctgcacgcgaaccagcgcaagggccagagaggtccctggacgacggtggagttgcagatcagcttgaagacactatgatccccagaaggacaagcgcttctcg

SEQ ID NO: 638025 - DNA, 853 bp, Homo sapiens
gggagtcctctgacagcagcagcagcagcgatggggagggcgccctccggaggcgcagcctccgctcccacgcccggcgccgtcggcgtacgggcgccgaccagcggagggccaagaggggcggaggtgcaagtgagacggcatgtacggagaagttcagaacgggactgaagcgagtgcatgtagtgagcagtgagggagaggtcgagggccctgagagatcaagagggagaagtgaaggtaagccgtgccggacgtagaccgttacagatcacgggtgtagcgagagaggcaagggaaaaagcacgggggtcgatggacttgtgcaatctaagcagcatcagcgtcgaacgtgagtgatctcgagtggagcatagaaagtgcgagcactaagagcgcttggagacgcattgccctccgagaagaagacaggccagtaggatccagcagccagagttccccccgacgtagagcgtagttgggcacagcaagccagggggaaaggccaaagtctagagaagcgcacagtatgcttccagagtaccgctggacaaacaggagacagggcaataaatagaggaccgacaagttcaaaggacgacaggcgacagcgggaaggaacagggggaacaaaaagtgttagcgccattgacgcgaagcgggtgagcttggccccagagagaacgttgcggcgagaacagcggagcgaaagcggcattggggaagtagggggaccggcttggggaagcgagacgctcagacgcggcggaggagacggacaaagacggagcgaatggacctgggaaccgaggaagacgacccggcgaaagacgagagaggcgcgaggccggtg

SEQ ID NO: 638026 - DNA, 121 bp, Homo sapiens
cacaggtcttccggaagttgccaaaccccggtagcggcagttccggctgggggctttattagggggcaccagggtttgctttccgactaccttccgactccgcgcctacgcaggaagcgat

SEQ ID NO: 638027 - DNA, 96 bp, Homo sapiens
catggatttgctggtgcagtacaactaggcttaatagggacatgttagccaggctggtctcgaactcctggccccaagtgatctaactttcttctt

SEQ ID NO: 638028 - DNA, 752 bp, Homo sapiens
  misc_feature (404)..(404): n is a, c, g, or t
ttctttttttttgtttaaaccaaagtctcattctgttgccctggcttgatctcagctcactgcaacctcttcctccggggttcaagtgatcctcgtgcctcagccctcctgttgcgaaaagctggtaattacagacgtgtgcaccaccaattgccgtgacttaatttttgtctatttttatagttaaaagacaagtttttcgctatagtgcagtggccaggctgtgaccctcgaacctccttagccctccttcattatgtgactcacacccacctctcctgtgtgaagacaagcattgttgacccttataacgttctcattgtgacacacccaccctctccaaagtttgtgcgccatgtgcgccgcttctccaagaaccatgtggagggaagaaagaaaggcantctcatgtgggagaccacctgtgaacaaaaaagaccggaattgtgcacacagagaacaagaggacgctataatgtcgccacggacaccacgaattttgtgacacgttgtgggtgggggtctctctcaatataaaacgttttacttttctccacgctttgaaataaaacaacaaaaaacacaaaaacaaaaaaaaaaacacctctgcgaggggactatctcttaatgtgtctgcggggtgtggcgggaaaaaaacgagagaggttagtgtagaaagtgtgggcccaagtgtggctccataaacagtgtgttctcccgctaggccccccagcgtttctttgtgtttatcc

SEQ ID NO: 638029 - DNA, 690 bp, Homo sapiens
ctcttggtaaatgtccactgaggcacaggcatggaacgaatagaataccggactgtaagataaattcgatttgagtaactggactttctgtaaaccattagacagacatttgagaagccacatgtatagctgctgtggagccatgtttagcctatctaagggtctcggaaatctcaggaggagatcacatatatgtacacaatataaatcgcttctctggtgtatgttgtgagcacagtgatctgatgcattgggaatgtgatcttgtgaatcactcaggtgagcaagcctgacatgagtgggcataaaggtcagtaactgaatgaggtaccaaaatgttgctacatgtgtcaattgtgacctaaaagaactgaaggcattcaccctccctgtgaagtaatgaagcgtgacgacagcgagggggctgcaaattccactgcagatcagggtcttgaagctgacatactgaagagtggctctcacttgagatacagagtagcgaactactgtttccgtatggctactgaatattccacaaataatctcctcagcgtgccattattaattaatgtaaagctcttagggtcccatctatcatagatcccctcggaaggcaaactataagggccgtacaaactcatactgcggacatatatgctattatccaaagttttgggctaaatttactgc

SEQ ID NO: 638030 - DNA, 480 bp, Homo sapiens
aaggacccgtctctcgcgtccgtaaattccccctgatgcaccagacagaaagctcggtacacaaagttgacctcggaaggacatggaaaggaaagggtccctttgtcactctcacaagacgtaagaagcaaactaataatgatggccatcacacatattatactcaccatgtagaagctgtgctgccttaaacttctgttcattcagcacttactgattgccagtcccattgctaagggctccgcgtgacttaactcccctaatccttgtgagtagccaattattattcgcattttatagatatggaaactgaggctccaagtggtttaaaaaatgaacttgcccaggttacagtgtgttggtaggtaggggtagtctcaaagttggtaaattttacgccaaagctcacgatacttgccttctttcccttctcaatttatttctctgactgtgtgctataccacacagcagtgtcatcca

SEQ ID NO: 638031 - DNA, 1124 bp, Homo sapiens
  misc_feature (15)..(15): n is a, c, g, or t
  misc_feature (32)..(32): n is a, c, g, or t
  misc_feature (39)..(39): n is a, c, g, or t
  misc_feature (85)..(85): n is a, c, g, or t
  misc_feature (110)..(110): n is a, c, g, or t
  misc_feature (126)..(126): n is a, c, g, or t
  misc_feature (128)..(128): n is a, c, g, or t
  misc_feature (131)..(131): n is a, c, g, or t
  misc_feature (141)..(141): n is a, c, g, or t
  misc_feature (144)..(144): n is a, c, g, or t
  misc_feature (148)..(148): n is a, c, g, or t
  misc_feature (157)..(157): n is a, c, g, or t
  misc_feature (159)..(159): n is a, c, g, or t
  misc_feature (164)..(164): n is a, c, g, or t
  misc_feature (180)..(180): n is a, c, g, or t
  misc_feature (217)..(217): n is a, c, g, or t
  misc_feature (238)..(238): n is a, c, g, or t
  misc_feature (240)..(240): n is a, c, g, or t
  misc_feature (248)..(248): n is a, c, g, or t
  misc_feature (253)..(253): n is a, c, g, or t
  misc_feature (262)..(262): n is a, c, g, or t
  misc_feature (273)..(273): n is a, c, g, or t
  misc_feature (280)..(280): n is a, c, g, or t
  misc_feature (282)..(282): n is a, c, g, or t
  misc_feature (291)..(291): n is a, c, g, or t
  misc_feature (301)..(301): n is a, c, g, or t
  misc_feature (316)..(316): n is a, c, g, or t
  misc_feature (708)..(709): n is a, c, g, or t
  misc_feature (759)..(760): n is a, c, g, or t
  misc_feature (764)..(764): n is a, c, g, or t
  misc_feature (770)..(770): n is a, c, g, or t
gtaggatgtggagtnacatggttctatccttnacttatnagactcagaaatatatctacaaagccagatgctctgtcttcatatntgcagacatctagaccccttgctanaaacccactgaagttntnggntatgttcttnganccanaccatcaanantaccntcaaatctaattgccntacagcatattctatcatgtggactaggttcctgganagccggaactcatgattcttntnaaaactgncagantagaagggngagagaaaacntttctancntttgatcancagtgtgaanagaatccggaatgcngtttcagcgtgacctgcagtcattcatgttcatagggatttgacagatggaaacccaaggttatcgaagattggaaggttgatcattgtgaagaagtagtctcaagaggactccggtttcggtctacaagtgtgatgtctccatgaagaagacttagtatggatatgggtgggtgaagaaagcatttaatcgcccaggaaaggacatgattaaagttgaccttttaatactgtagtaccttgctgttaagtaaccccactattgtatctgcatttatcttttgtcatctactttcacttacatacagtattatataagtagagaaaaatgggaaaatgcaagcaaattcaacttatttatacattgtatatatgtacacctacatattcatnngggtttattaaagagatagtcacaaagggttacgaaaatcattttgaatnnatanttagantattgaataagcaatcctatgatccacctaattcgtgtctagatcaagtctaatcaatattcaatcacaagacatttactgtatattctagtcatcttggagatgagttcaaccccaacatataatacatcaccacgtgtagagatgtctctctcgcagtccttatgatgtggatatactcacctaagtggacttgtatgctgataattctagaccaaagtaacatatggccagaatatttatacatgaacaaaataatttgcaaatattttctataattgtattcatttaaacactgttgatagccttgtgtaagttacaggcaggggtgtatattcgattacagcaaatact

SEQ ID NO: 638032 - DNA, 862 bp, Homo sapiens
  misc_feature (1)..(1): n is a, c, g, or t
  misc_feature (103)..(104): n is a, c, g, or t
  misc_feature (120)..(120): n is a, c, g, or t
  misc_feature (122)..(122): n is a, c, g, or t
  misc_feature (125)..(125): n is a, c, g, or t
  misc_feature (128)..(128): n is a, c, g, or t
  misc_feature (152)..(152): n is a, c, g, or t
  misc_feature (156)..(156): n is a, c, g, or t
  misc_feature (251)..(251): n is a, c, g, or t
  misc_feature (276)..(279): n is a, c, g, or t
  misc_feature (285)..(285): n is a, c, g, or t
  misc_feature (288)..(288): n is a, c, g, or t
  misc_feature (314)..(314): n is a, c, g, or t
  misc_feature (318)..(318): n is a, c, g, or t
  misc_feature (322)..(322): n is a, c, g, or t
  misc_feature (324)..(324): n is a, c, g, or t
  misc_feature (344)..(344): n is a, c, g, or t
  misc_feature (349)..(349): n is a, c, g, or t
  misc_feature (386)..(386): n is a, c, g, or t
  misc_feature (400)..(402): n is a, c, g, or t
  misc_feature (404)..(404): n is a, c, g, or t
  misc_feature (437)..(437): n is a, c, g, or t
  misc_feature (488)..(488): n is a, c, g, or t
  misc_feature (504)..(504): n is a, c, g, or t
  misc_feature (590)..(590): n is a, c, g, or t
  misc_feature (627)..(627): n is a, c, g, or t
  misc_feature (669)..(669): n is a, c, g, or t
  misc_feature (677)..(677): n is a, c, g, or t
  misc_feature (703)..(703): n is a, c, g, or t
  misc_feature (737)..(737): n is a, c, g, or t
  misc_feature (741)..(741): n is a, c, g, or t
  misc_feature (768)..(768): n is a, c, g, or t
  misc_feature (786)..(786): n is a, c, g, or t
  misc_feature (836)..(836): n is a, c, g, or t
naaactaaacaaaaggcaaggtaacatcccaagcaagtaaaggggctgagttttttctaggtgcgggtcagctcaggaactggctgcgcaaggccagagaggnnactgtgtgcggctctntncanatnagaccgacgagcgaggagcgcttnattncctgtgcagtgttcacatctgcccagtgcagtgtgacgtctgggacctcatctgctggctctggatccttcctcaagggcccccggggggacgcnaccgcaatgggcagagggccacagnnnncccggnttnccacgaacatggaggcccctctgatnagcnagcngnggaggggtttgctgtgtggngagcncacggaagaggccctgggtgaggctgagcatatgaanggacccagagaccnnngnatagatgtgtgtgatgccaatgagctggcaganggtgatgatggccctgtggcagcggaggccgtgacctttgggttgtgtctncatcttgatatgcgtncttttaaatcttaatgaaatatcatggaatattgtatggtcttcatatcgttctatataatgcaaatggtgaactgctctgttctntgcttttctgagagcatccatccgatcagtagctttnccaatagaaaaacctgcagctccttttccgttccccacagcnaccaaganacggatcgatttctttcttccctctntcgcagttatagtgaaaacgtttctcacctcaantatnctgggtatcaaaatcctcatatgtctntccacagggaccagggtnaggggggccaagactgacgcctccccatgagttttcacttcatcctcgcncccgtttaaccttcatcttcttcttt

SEQ ID NO: 638033 - DNA, 458 bp, Homo sapiens
tgtccagagttgatggccaccctctggaatataaatgcctacaatcttgaagttgattgcaattagctgagaacattgatacttgtgctcggttgacaagtaaaataactgaattgaaggaagggaaaaatgtacccatgcgcagcttcgatacctgagttacccctgtgataggataagccttacgcacaatgattgataaatcatactttatataaaaggactgtgcacactgagcctagactacaaagacacacagcagatgactaaaaatgattgcagaaacaggactaaaggtatagcactatggaaatcctaaccgatgtagccgataaaccttcaagaggtactaagatcaaggtggcatagagctacgttcacttgcatgaaccactcctaaagtctttagcctggacccaaagacagtaatggactttttctatgacaacctgcattct

SEQ ID NO: 638034 - DNA, 132 bp, Homo sapiens
gtttgggcaggcgaatctcctgccacaaggtgactattatcaacatcttttcgacacttgtttgacgtgtggttctcctggtccttgatgaacagatccacatttatttattaaagttcccttccttaatga

SEQ ID NO: 638035 - DNA, 715 bp, Homo sapiens
taaaggtcagggcccagccattacgtctccccaacgtgcagccaggtgcacgcttgggctccagtatgccatggctcatagatgaaatcctttatagcaggatgtgaagaccatgtgaactgcccgggcctttttggatttttgtgcatcaaattcgaccgtcttgttccagacctctttaagtcacactgcactaacttagctttctctgatggtctggtttgccgccattagtttcttgttactagtagcccactactgggcccactatagctccatcccatacgggtagcttggctccagtctgcgcctaaggtgcagacccgccctgggcatgctggcctgtagacggagcctgaggtcacagcctcctgactagcctgagaccttcctaggggactgtggctgtttccggggaggccgggaggggcagactgtgagccctagtggaggacgttgggagtaacgctgctttcgctttggcaggttgaacggggcccggccaggactcggggaacggatggcttgagagtcagcgatgacctctggggtcactgtcccaggagggacttcacctggtacaagagctggaggcagccgcttgcccatggaggcttgtcccctgaggcgcttcgccagtgagcgtgcgggcataagggcatcgagtctctcctggagcacggctgcggtgcgccggcagctacgggagtacccg

SEQ ID NO: 638036 - DNA, 657 bp, Homo sapiens
  misc_feature (1)..(1): n is a, c, g, or t
nagaaaaatggtttccagtccaggacgttgaccagctcttagtgtcagcactcatggcggcatataataagtaataaacagtgcacacttgaggccgttccgcatattgagctatgttagagcgccttgtgattatgatgagatcagccctcatagcagaacatagtcaagttctggctgaatcctgtcatgagcactcacgatgctataacattaagaaagcgcgggagcttattcctacccagcgagatcagttatgtgaaaagagtgtgtctttgtgtgtttgaactctcaccacgttagggccaactcgatatgcatgctaatgacctcctcttatgcaatatcaaagacaggtctaaagcatgctagagtgatcatcagtcagaggctcatacacgcactctctttcatctgtttccatatgacctcagtctatagattagtgacaccaacgatcatgagtagctataacattcgaaaaatttcttgagcagctctttgatgatggtggtgtttatctccttcttctcgccaggcaagcccagcgtaagcatggcattcagcagttgctgccctagcctgggtctgctggtggtcctgcatctcaccaaggatctgcaggtctggctgtgcagtagggttgtcctcggaata

SEQ ID NO: 638037 - DNA, 201 bp, Homo sapiens
aaggatcgaaaaggggatgcatacgatacaaaaatcaaaagcttatctggtatttcactgattctttctctagcttgtacaatgagagttagattttattctttacatttgctaagctgtcctgcatctgctcattgaaatctttctatggcgggaagctgtgtgggcagattccttaagccgacccatttgggtaccaac

SEQ ID NO: 638038 - DNA, 917 bp, Homo sapiens
  misc_feature (23)..(23): n is a, c, g, or t
  misc_feature (98)..(98): n is a, c, g, or t
  misc_feature (106)..(106): n is a, c, g, or t
  misc_feature (115)..(115): n is a, c, g, or t
  misc_feature (135)..(135): n is a, c, g, or t
  misc_feature (148)..(148): n is a, c, g, or t
  misc_feature (151)..(151): n is a, c, g, or t
  misc_feature (181)..(181): n is a, c, g, or t
  misc_feature (191)..(191): n is a, c, g, or t
  misc_feature (244)..(244): n is a, c, g, or t
  misc_feature (280)..(280): n is a, c, g, or t
  misc_feature (291)..(291): n is a, c, g, or t
  misc_feature (299)..(299): n is a, c, g, or t
  misc_feature (324)..(325): n is a, c, g, or t
  misc_feature (349)..(351): n is a, c, g, or t
  misc_feature (364)..(364): n is a, c, g, or t
  misc_feature (386)..(386): n is a, c, g, or t
  misc_feature (404)..(406): n is a, c, g, or t
  misc_feature (459)..(459): n is a, c, g, or t
  misc_feature (479)..(479): n is a, c, g, or t
  misc_feature (490)..(490): n is a, c, g, or t
  misc_feature (528)..(528): n is a, c, g, or t
  misc_feature (606)..(606): n is a, c, g, or t
  misc_feature (782)..(782): n is a, c, g, or t
  misc_feature (818)..(818): n is a, c, g, or t
  misc_feature (871)..(871): n is a, c, g, or t
gggatatttatttatattataanattttaattttttgagggagtaaatgtaaaagaaagggataatttttgaaattatatagaatttgaagagattgntgaagaangagagaatnggtttttaataattatttanttgttaagaaggntanaaagaaaaatgtattgaatgttagttgtanaaaaatattnagtattttataaaattaatttttaagaaaggaagaaaaagatagatgttgatntttaaaatgggtgtatgggctaaagatttaaagaanagaataaattnatttgcanttaataatgaatttataaaatgtannaaggagggggcataattgtgtatnnngtgaatgatatgnagaattgaagtatggtgtgttnaagtagttatagaagtannnagatgagtgagtggagagagtaaatgtgtgtttagtaaaggaatatgataaanttgatagatgtttggatatnttttggtgtgnatgtgtgtgtgtgtgtgtaaaataaatgtgtatattanttttaaagaagatttatagaaagtggtatgatttatgaggtttagaaatagctagctatatatggtaggtgccgctanagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgntgctttttctgcgcttcagtaacaagtgttggcaangagactttctcctggccctgcctgctggagatagcatgcctgtcctttcagtntgatcatccatctctctcttgcctgaggggaagagagatgggcagg

SEQ ID NO: 638039 - DNA, 425 bp, Homo sapiens
  misc_feature (23)..(23): n is a, c, g, or t
  misc_feature (286)..(286): n is a, c, g, or t
  misc_feature (416)..(416): n is a, c, g, or t
  misc_feature (418)..(418): n is a, c, g, or t
aactgatatttcctggctgggancccagatgcctgaaaatggatgaagagaagtccatgaaaactgaaagagccactgaatcactctgccttaagtgtggagcagaggatccacatggaagcagtgaaaaagctcccagaatgtagcccaggcatggtggctactgccctgtaatccccagcactttgggaggccgaggcgggcagatcacgaggtcaggagatcgagaccatccctggctaacacggtgaaaccccgtctctactaaaaatataaaaaattagcngggcgtgtgcgggcgcctgtagtcctagctacttgggaggctgaggcaggagaatggcgtgaacccaggaggtggaacttgcagtgagctgagatcacgccactgcactccagcctgggcgacagagcgngnctctgtc

SEQ ID NO: 638040 - DNA, 83 bp, Homo sapiens
cgtgagttcagtcctgctctttatctcaaaagatgcgggatattcggaccggcgactgagagagatcatggtgcaccgtggtt

SEQ ID NO: 638041 - DNA, 270 bp, Homo sapiens
ctctcttacaaggtcgccatcatggctctggtagggggaacatgtgtcatttccattacatctttcacattggctatatcacgacccaagacacaattctgtttcttgagacagtcgcatattagctttactagttagttatggcttaatgacactcgctaatcatcaatagaagcatgtacatttccaaattcacaagttgtgtttaatactcatagctgaatacatactgctttcatcttggttccaagtatccaggtaccgaggctc

SEQ ID NO: 638042 - DNA, 175 bp, Homo sapiens
caaaacccacagttacatcttgcaccaacctattaaaataaatagtacataagggtaaagaagtaatgtaacctaatgtattccagaagaaagaaaaattattttccctccggagtctccttctgtcacccaggctggagtgcagtggcccactcttgcctcggggggatacccc

SEQ ID NO: 638043 - DNA, 292 bp, Homo sapiens
tcactcaaaaactttagaaacatggattactctgaagtattgccagcagattagaaaaactggtatcttataatcctgcaacaatacctaactttgaagatccatataaagccgctatatgctatgggcgtctcgaatacacaagcgaaacgtgattgcacaacgaacaattatgccatatgcagcgcacaaaagcctgaagcgtaaagatttgactagcagaacttgtagaacattactctaaggcattacgttaaattctagctaagggtcctaaaagattaaattcaaa

SEQ ID NO: 638044 - DNA, 629 bp, Homo sapiens
ggagagaactagtctcgattttccgaggtcaggatgtcgtcgaaactgggtctatccggcagggaattctatggaatccaaagggtagtatccctatttgaaaaatgaaaacctaaaatcaagtttaaaaagcaagcaatcaggacgataaagcacggtgaaaacgccctttgtacaaattcagccccgagagtcaagagacaccgaggctgtttcataaccccccaagggccaacatgtggacagcagtgctttgtagatatcccaagttaacaaaaaccgagctaaaccagaagcgcacaccccagaggtgggctcaatagaaagtgtaggaccacaatataaagggtgccactttgtagaaacatgtttacctccgtggaagtgttcccggtggggcattatttgagggggcccctccgtggaaaatataaaggccccattaatttcagaaatcctcactagtactctgcgttaatcaaccccgaggcggtgtgtaacaccgaagaaaaagatctcccaactctggtgcgctataaaatgtgtcccccagaaaacacacttttttaaaaaagaggccctctctaaaaagaatctcccagggcgttgggaaaaaaacccacacctat

SEQ ID NO: 638045 - DNA, 659 bp, Homo sapiens
ggtggtgggtgcctataatcccagctgcttgggaggctgaggcggagaattgcttgaacctgggaggcggaggttgcagtgagccgaaattgtgccactgcactccagcctgggcaacagagcgagactccgtctcaaaaaaaaaaaaaaaaaaaggaaaaggttaaaggaaaaacccgggaaaatttcaaattccattagcgggggggaagggggaaatttggccttgtttgagaattccatttggccccttgtgggagtgactcatttattttccttctttaaagctgtaaattttattggcgatcatcccggacttcaaagacaatcagcttggtggggatcccaaccagggcaggagagtatatcttccgagagaggatcaagacttggcaagagggttcaggccattttggggaggccaagaaaccatggggtagtcatgccagatgccaataaggaaattaccctgaaccagttggttgggggcagcatatggagctgctgggtcagcgctgcagtggctctttcaacagaagcccttgtggggagaagccaagaagtggttgccaaagctggtgggagccatgccaaaaagctgagagtcaatgccaggagatcacgctggagctgattctgggccctctgatcatccccag

SEQ ID NO: 638046 - DNA, 264 bp, Homo sapiens
cccccccccgcagctctcattctcgtcaccaatactcattcggccgcatcgttgttgtttttattggaaaataaaggccagcaaaagttctcatttggcaaatatcaggtcaaataacttaaaaatataatattcctgcctagactttctttttctcaattgtgaggcgttctctgcctttctttaggttgattgctttctctctaggtgacttctggggtttccttttttgtgtgctacctcttcttctgggaccagtgactt

SEQ ID NO: 638047 - DNA, 192 bp, Homo sapiens
aggcatagccatgtagataacactatccactcacataacgctcctacatactaggactactaaccaagacactaaccatctaccaatgatggcgcgatgtaacacgagaaagcacatcccaaggccaccacacacacacacacacacacacacacagagaaatacacgaagcgaagaaaaaaaaaagaatct

SEQ ID NO: 638048 - DNA, 867 bp, Homo sapiens
tattggcttcagctgttgttaatggacatacaggtaggcccaataccaacaggccgggaggtgctgcatagtggggaaaaatggaaggtggagggtgaagtgttggctgcagaacagctgacttgagagggtgggtgacagggttgcaagactgggacgaggccatagagacgttaaagaacgcgaatgttaatgggccagggccaaagctcagggtattcaatgggaacaacagcccagtgtgcccttaaggcccctaacatcttgagcgtgggtgtattcttgtgaccccaacgccagggtgtggagagttcctcgtggagcactcccattattcttcgccataagagtggacaccttggcgacaatagatggtaccacccacgtaggagaaacagggagaactgcttgtccacccctccttttgccgactcttggcgctctccagcgggtgcctctcccaagctccagcgaatttcctctctctttcgtctccccttatgaattcgtgggggtgggtgcccacatttagattgtgtgcccaaacccaatgtgctctcttcggggctgttccccccattagaaggcaggcctgtgctaataaccaacgacgcccacgtgtcttcccagagagtggagcgcgagtgaggactcttttcttctcccctgggggtgtgtccccagaccataacccagtgtggcccagtgttaaaaccaggccccagaagtgtgatggtctcctacacaagcggttgtggctttggcccataagagtgggatgggcgccttggtcggaaaaacgggggcgtgtttggggcaaccatggggccctttgtatgaacaggggttccctcctgggtttctcat

SEQ ID NO: 638049 - DNA, 361 bp, Homo sapiens
  misc_feature (76)..(76): n is a, c, g, or t
  misc_feature (132)..(132): n is a, c, g, or t
  misc_feature (140)..(140): n is a, c, g, or t
  misc_feature (147)..(147): n is a, c, g, or t
  misc_feature (162)..(162): n is a, c, g, or t
  misc_feature (165)..(165): n is a, c, g, or t
  misc_feature (167)..(167): n is a, c, g, or t
  misc_feature (170)..(170): n is a, c, g, or t
  misc_feature (175)..(176): n is a, c, g, or t
  misc_feature (179)..(179): n is a, c, g, or t
  misc_feature (190)..(190): n is a, c, g, or t
  misc_feature (192)..(192): n is a, c, g, or t
  misc_feature (199)..(199): n is a, c, g, or t
  misc_feature (201)..(201): n is a, c, g, or t
  misc_feature (205)..(205): n is a, c, g, or t
  misc_feature (209)..(209): n is a, c, g, or t
  misc_feature (211)..(211): n is a, c, g, or t
  misc_feature (227)..(228): n is a, c, g, or t
  misc_feature (236)..(237): n is a, c, g, or t
acgagcccggccgagaagccctgaggggggaggggaggccattttgtcccgaccgactccccggaaccgggcggancggctgggagaggctgcagagccgcggtcgccgccctcggaggcactggacgccgncactgtcngggcttnctcagctgttcgtangtngnccncgccnnctngagcctttttncnacgcttncncggncctncngcctgagaacgccctnntgaggagnnggccgtattgaatggcgaagaagacgtactacctgcttttgctgctactgatcggagattccggagtggggaagacctgcgacctttgtggctgttcggatgatgccttctactacgttttttc

SEQ ID NO: 638050 - DNA, 94 bp, Homo sapiens
tggataaccccctccccgctaaaatgccttggaacacatggcttaacagtggtctgcacagaaaatatacacccctccctgtgtagaatttgaa

SEQ ID NO: 638051 - DNA, 365 bp, Homo sapiens
  misc_feature (76)..(76): n is a, c, g, or t
  misc_feature (132)..(132): n is a, c, g, or t
  misc_feature (140)..(140): n is a, c, g, or t
  misc_feature (147)..(147): n is a, c, g, or t
  misc_feature (247)..(247): n is a, c, g, or t
  misc_feature (270)..(271): n is a, c, g, or t
  misc_feature (273)..(273): n is a, c, g, or t
  misc_feature (289)..(289): n is a, c, g, or t
  misc_feature (298)..(298): n is a, c, g, or t
acgagcccggccgagaagccctgaggggggaggggaggccattttgtcccgaccgactccccggaaccgggcggancggctgggagaggctgcagagccgcggtcgccgccctcggaggcactggacgccgncactgtcngggcttnctcaaagctgttcgtatgtcgcccgcgccgtctcgagccttttttccacgctatcacggtcctccggcctgaaaacgcccgaatgaagagttggccgcantggggaccgatcccttggggccnncngcggcgagagcccganccgctcctnccaatggtgaagcgtccgacctgcttttcgctgctcctgatcggggatcccggagtggggttcaccc

SEQ ID NO: 638052 - DNA, 360 bp, Homo sapiens
  misc_feature (76)..(76): n is a, c, g, or t
  misc_feature (132)..(132): n is a, c, g, or t
  misc_feature (140)..(140): n is a, c, g, or t
  misc_feature (147)..(147): n is a, c, g, or t
  misc_feature (162)..(162): n is a, c, g, or t
  misc_feature (165)..(165): n is a, c, g, or t
  misc_feature (167)..(167): n is a, c, g, or t
  misc_feature (170)..(170): n is a, c, g, or t
  misc_feature (175)..(176): n is a, c, g, or t
  misc_feature (179)..(179): n is a, c, g, or t
  misc_feature (190)..(190): n is a, c, g, or t
  misc_feature (192)..(192): n is a, c, g, or t
  misc_feature (199)..(199): n is a, c, g, or t
  misc_feature (201)..(201): n is a, c, g, or t
  misc_feature (205)..(205): n is a, c, g, or t
  misc_feature (209)..(209): n is a, c, g, or t
  misc_feature (211)..(211): n is a, c, g, or t
  misc_feature (227)..(228): n is a, c, g, or t
  misc_feature (236)..(237): n is a, c, g, or t
  misc_feature (245)..(245): n is a, c, g, or t
  misc_feature (268)..(269): n is a, c, g, or t
  misc_feature (271)..(271): n is a, c, g, or t
  misc_feature (287)..(287): n is a, c, g, or t
  misc_feature (296)..(296): n is a, c, g, or t
acgagcccggccgagaagccctgaggggggaggggaggccattttgtcccgaccgactccccggaaccgggcggancggctgggagaggctgcagagccgcggtcgccgccctcggaggcactggacgccgncactgtcngggcttnctcagctgttcgtangtngnccncgccnnctngagcctttttncnacgcttncncggncctncngcctgagaacgccctnntgaggagnnggccgcantggggaccgatcccttggggccnncngcggcgagagcccganccgctcctnccaatggctgcgaagacctgcgttcttattcgtttttctgatggccttccatactacctttttc

SEQ ID NO: 638053 - DNA, 273 bp, Homo sapiens
gactggagcagcaaaggtgatttgctacttagcaaagagactgggagcattctgcccctgtctagagatctgtggaacttcgaacttgagagagatgatttagggtatctggtggaataaatttctaagcagcaaagcactcaagagttgacttgggtgctcttaaaagcattcagttttggctgggtgcggtggctcacgcctgtaatcccagtactttgggaggccaaaggtgggcggatctgaggcaggagaattggatcaacccgggag

SEQ ID NO: 638054 - DNA, 660 bp, Homo sapiens
tagaggggtgtaattggtattcattaaaatggcctgggcctttaaagtcctttcattgtaagttaataagaccgcttgccagttggttctaagattcctttttcggagtaaaacaagcgacatacaggtatgctttgttctcaaaaaaatatatcccatgtttcttggcccttgatttagaagatataaaccaataaacttcttttttgtcggggcagaatatttgctacccaaagtggggtttttcctgtttgagcataatatccagagggtagtgggagttccagcatgcaacaaggttagaatttgcagggaaggcttaactttgcttcccagggcctgttttcaacaacccaaggggaccctgtgcaaccttttgttcaaaaagagtgcagaggaaaaccaaaattgcaagggctccttgggaccctttgtttaaaaaaccttggacgcccttttcaccatttttggttttacccttttaaaaacaaaaggggtcaattttgccccccaaaaaaatgtcccagggtggagaggggcaaattctgcccaaggatttaaatgggtagaaaaaaaagacgtttccccctgggatgaacataacaagtcttctgaaagaaagtagacagtattacaccctgaataaataaggtgttgttt

SEQ ID NO: 638055 - DNA, 252 bp, Homo sapiens
ttttcgttctggccgcgcaaggtggcccagggcgagccctactaccacctctggtatctgtacatgatcgtggggctgtacatgttcgcgccgctggtgcgcctgctgtacgtgcgcagcacgccgcgctcgcgttcgctgtgggtggtgggcatcctgggcctggcgatcctggatgcgctgtaccgccgcgcgctcggcgcccagcccggctttttcctgacctggttcctgccctacctgggctgtttc

SEQ ID NO: 638056 - DNA, 143 bp, Homo sapiens
ttatgggacatatctcatatgacacaactggaaaggctcaaaatagtaaaatgcttcaagacaggcataaagacggaactccgccataaaattgaagctcttccatcatgatcatcagcatagatgcaaggcaaagttctaac

SEQ ID NO: 638057 - DNA, 246 bp, Homo sapiens
  misc_feature (39)..(39): n is a, c, g, or t
tgatagtcaccgaactcaaatggtaatctggaagggatngccgaaacgtcgagtcaaacgcagcaataaagccagcaggaagaggcagcatgaggaaccagagagcttctttacctagtttactagaccattctgatgcaggtcgctgatacagttagagagaggtcatacaaagataatatttgggccaaacctcattacagtactactttgtttcccgagtctgcactgattgaagaatggaga

SEQ ID NO: 638058 - DNA, 1387 bp, Homo sapiens
ggacacaggtgacgaacagtatggggacggaagtcgtacttggatctacagtatagccatggagaccgaatgaggctcgtcctatccggtgctgcaaatacacagacgaatgatctatggactaccaagggcacatctgacattgccaggatagtaacgcgtctagaagcagtgaaagaggccattatggatagttgcttgttgtccgcaaggtacaagaaagcaataagcgagttccgtctccgccactctggggtgtccgatgaccacgggtgcgtcgcatcatcggcgttcccaatcgcgggaggggatataacatactatcgtcaccagcgccctccagaagccgcgaggaaagctatggctagctctcctctggtcagaatccgcagaagcctcataggacctgagaggacatctagctcgtctcccctgtggcgtactgctatccgtcgatgacggggatggcaaggtacgatttttggccctccgggctagagggggtccaataacacctcggacgaatcaacgaggtagagcgtggggaacgttgcgactactccaagggaggaaaccctagtcggacggacacgggttgtcaatcgtctcgcgagattcaccccctgaaaggcaacgctgacaagaagaaacaactctgccgtttggattcgtcgtgggaaacggctttgcgcgaaattcccctatgagaagcgatgtaacttctatttcgctttctacgcgcgaaaacaatcaagccggtagattgtgttcccgccgatgtccgcgccaagggaagtcgtatacccgctggtaacagaacattgtaccaggggaacttaccttcaagattacgggggatagacctccgaggctttttaattggacccaacaatgtgtgggtccaacaacggttgggaaaacctgatcacgccccgggagtcgggcttaaccaagcggataggttctggtcgcaacccaaccacagggacctaccacggtcgatttggccaacgaaaggaaaagcattttttccccccggaaaataaccgatgcgttcaaatctacagggcgcaaacttttgttgcaacccgtgggttgcccctaccaaggcgccggattcccccttggaagtcaccaaacattgggcggacggaacccaatggggttcctagggccttgttggcaaaattaaccctatggaacccccccggttgtggggccggcccttggcagagaaagcttggcggaacactgcgaggaattgccccttcttcttgttgccagggacgaaggaacattgtggcccaaccccaaagtcttccccaagttggaccccccaattaaaatttgggcggccggggcgaaacagctccctgggggcccacgg

SEQ ID NO: 638059 - DNA, 788 bp, Homo sapiens
  misc_feature (3)..(3): n is a, c, g, or t
  misc_feature (209)..(209): n is a, c, g, or t
  misc_feature (215)..(215): n is a, c, g, or t
  misc_feature (277)..(277): n is a, c, g, or t
  misc_feature (427)..(427): n is a, c, g, or t
  misc_feature (480)..(480): n is a, c, g, or t
  misc_feature (484)..(484): n is a, c, g, or t
  misc_feature (487)..(487): n is a, c, g, or t
  misc_feature (511)..(511): n is a, c, g, or t
  misc_feature (524)..(524): n is a, c, g, or t
  misc_feature (748)..(748): n is a, c, g, or t
agnaaaaggaagaaatgagatgttgaaaaaaagatggaggagggttcactctcttttggggactgattcaaaaaatgatgtggcagtataaaccatttcagagtcaggggtgttcattcttttttgggagtaagaaaaggtggggattaagaagaagtttttggaggtttagggaccaaggttggtttctttcccccctcccaaccccnttgatncctttttttgattaggggaaaggagctgagtgagggaggtagagttggaaagggaaggattntatttgatagagtgggatagaattttccagagtagagcttggagggagattgaaagtggagataatactgctgaaacctcacttgaagctgagatgggaaatggacatacttagaaatttagtgactttaatagcttggatttccctctncaaaacttttagaatggaaaatcccatttccttctttatatagtgacttctantcantancttttaatattttctaatttgggnttaggatgatggncattatctacatgtgttttcagcacctggttggttctaaatgggatctggagacccagcttcttggagatttttaagaggaagtattaactggacaaatggaatgggcacagaaagaaatacagggtcacccagaatggcagaaacctaggtttcccagagtggaaagagagaggagacattcaacaaacaagtatttattgagcgcctactatgtgccaggcntgttctagacccccccagaagaaaaacaaaaacaagatag

SEQ ID NO: 638060 - DNA, 708 bp, Homo sapiens
gccagccggctgtgtatgccatccaccaccagcagctgccccacggcttcaccaacatggcccagtgttacccagtgcccatgtccaaactggaatcacagcagccccgccccctcacgcctgggggtgcccaccctgcccaggtgatgctgcgtgcacccaccccagagtcatggggggcccccctcaaggcgcggtgccccagagtggggtgccgtgcactctcagcttccacaccctcaccctacccctacatctggactacccctcaaggtgagcagcctggccaggcgcctggcatttccaggaggagccgatgacaggattcgtgagttctcattagctgggggaatttggcatggaagagctgatgggctgcaggtggggcaggatgcacggcgttctgggtggggagtgaggggtcttggaggcagggctgtcccacagtggcgcccgccgtacctgcacctgtctgtgaaggtatgtagggtgggcagaagccacgagtcgccgccgccaggggctttgctccttggctctgtcctttgctttcccgtccgtccgtcgctcagtatgtgatccagcagcccccttcccattgctccccagctctcagtgaccccgagtgtctctgacttagccgaggtaaggtcagtgcgctgacagggccgactgcggttgggggttggctgggccatagtgaggccg

SEQ ID NO: 638061 - DNA, 345 bp, Homo sapiens
  misc_feature (1)..(1): n is a, c, g, or t
  misc_feature (14)..(14): n is a, c, g, or t
nccctatatggtantaaggggtcaaagccaaagatataacactgtaatatagcacccaactctagagcacccagaaatatcaagcaatattgttagagctaaagagagagatagatcccaatacataatagctggagacttcagcatcccatttcagcattgtacagatcttccagacagaaaatcaacataggacctaatctgcactatagactaaatagacctaataaatatttacaggacacttcatccaacagctgtcagaatacatattcttctcctcagcatgtggattattctcaaggatagaccacatgttaggtcacacaaatctgaaagtattcg

SEQ ID NO: 638062 - DNA, 488 bp, Homo sapiens
  misc_feature (66)..(66): n is a, c, g, or t
  misc_feature (131)..(131): n is a, c, g, or t
  misc_feature (307)..(307): n is a, c, g, or t
  misc_feature (375)..(375): n is a, c, g, or t
tcgagctcggtggaccccacttatgccgtgtgtatacagtagtccccccttatcctcatccggtgngtatacagtagtccccccttatcctcatccggtgtgtatacagtagtccccccttatcctcatcnggtgtgtatacagtagtccccccttatcctcatctggtgtgtatacaatagtccccccttatcctcatccaatgtgtatacagtagtccccccttatcctcatcccgtgtgtgtatacagtagtccccccttatcctcatctggtgtgtatacagtagtccccccttatcctcatntggtgtgtatacaatagtccctcatcctcatcccgtgtgtatacagtagtctccccttatcctcatcnggtgtgtatacagtagtccccccttatctggtgtgtatacagtagtccccccttatccggtgagtctacagtagtccccccttatcctcatccggggtgtatacagtagtccc

SEQ ID NO: 638063 - DNA, 1358 bp, Homo sapiens
  misc_feature (650)..(650): n is a, c, g, or t
gctcagagtgcactgatatcccaggagtgcctgtggtcacattgccccggtgtatatctcacaggatgcttgtgagcgcagactggtggaagatggactcctcggaccaggtatggtgattggaggagctgtcgagtgagcagccatgaaggcggcgagcttgcgagccgcctggggaacggcatcaacgggagtggcttccgtgtgctgaggaaatcggaagacacaggccgtctcgacggtgtgtaggcagtgagtaaggtcatagccaggtagtgagcgtgaggccggaatagctgatgactgagatccagcgagagtctccaagacagtggcctcggactggagtctccggaagccaaggcaaccaagttcggattgtgggagagcaacttgctagacgagaagcatggaaggtcgcctttattcaggtagtcaggtaaactcagtcataaagtttgggcttgggacagtatatggggagacaactccattgccgggacacgaggtctggacgtgaaggcaggcagatgactactctgacttggacggcacctgggtagaaacaaaagtcagagaaggtgggacccaggagaagtctttagtgtaggctggcacacccaaagccaaaggggaagcgcatagccagntagaggaccggagctttgttcagacacagcgggaagaagtaagacaccatggacttgaacgcgagtgatttcaaacttgtgggcgccattctgccacaagaggtgttcggactttggttggccaaacaataggaacttatggccagagtatacccgtcgcatggcacaaaactgcgcaagcgcggacgaagcgtttgccacattggacaagaaaagcgattaaagaaaagggcttggctgttggccatattatcgggcgggttacaacgatatgtcacacacaatccgggaagtgactttccccaaggtttacaccccatacaacactggaccacggggatccggtgtgccgatgctgggctaccttccccgatgaggacactggtaagggaccttccccaatggatgttgcaagtttgccacagccacatgtgggcaccaaacgtggcccggcacgttgtacaacccctgtatcgagaggcaaaaaagggtagtcccaggggaagcaggttccataagtgtgttggcggaagccgttggaaaggccgcgagctgtgttccaaaagggaacaccacgagggtcccttgtgacgggccgtgagggaaggacatcctggaggggaccaatgcagttggatgcaggctgaacggaccaaacccagtgtgaggatccttttggcaccaagtgtgggcgcctggccccactcc

SEQ ID NO: 638064 - DNA, 285 bp, Homo sapiens
gaggatccccgtccagtagggtgtgcccagtcatttagaagtttaggccgggtgagtggctcagtgcctgtaatcccagcacttgggaggccaaggtgggcggatcacaaggtcaggagatcgagaccatccgggccaaaatggtgaaaccccgtctctactaaaatacaaaaaattagccaggcgttgtggcgcgcacatgtagtcccagctactcaggaggctgagtagcaggagaaccacttgaacctgggaggtggaggttgcagtgagccgagatggtgt

SEQ ID NO: 638065 - DNA, 367 bp, Homo sapiens
taaaagcaaaatcaaaaatacaaggccgggcacagtggctctgtcatcccagcactttgggaggccgaggtgggcgtatcacctgaggttgggagttcaagaccagcctgatcaacatggagaaaccccatctccactaaaaatacaaaaaaaattagctgggcgtggtggcgcatccctgtaatcccagctactcaggaggctgaggcagaagaattgcttgaaatcaggaggtggaggctgcagtgaaccgagatcatgccattgcactccagcctgggcaacaagagggaaactctgtctccacaaatatatatatataacactaataaacagagatccagaatgtaagactgggactgacatg

SEQ ID NO: 638066 - DNA, 742 bp, Homo sapiens
ttaaagtagcaatgttcatttcagcgtggtaactctctccccctttaaaatctttttagttttatttgagaaacatactacatttttttctcttttcttccctttaaaggtggatgctcaagtttgaggactgtcatggggactatcaggttttttaggcatgtgctttctttttcttcaaattaaaacctgttgtctgtctcttgtcacttttcaggacagccacactcggggctcttacaatcaggggtcataagctgctatgtcacctacctcaccttctcagctctgtccagcaaacctgcagaagtaggtaagccagcctgttagtgggcttgtgtttgcggtgtgaatattttcattcatggaggaatgagctattgtttaaatattggagaggccttggagatagagagcagaaagatggttaccagaggctgggaagggtttgggaggaggttaggatgattaatgggtacaaaataaataggaagaatgaataagacctagtatttgatagcacaacagggtgactatagtcaaatttaattgtacatttaaaaataactaaaagagtataattggattgcttgtataacacaaaagatcagtgcatgaggggatgggtaccccattttagatgacgtgattgttacatgtttcacacctgtattaaaacatctcatgtaccacagaaatatgtacgcctactatgtatccacaaaaattaagttaaaaaaaa

SEQ ID NO: 638067 - DNA, 172 bp, Homo sapiens
tcgcgtcccccttccccatttccgccggcctctccggctcgccgttccccccccccccaggcttccccggccttcacgtcattcttggcccccctttcctccccctctgcttccccccccccctcgttttccctttccctcccccccccccctcggcttcgccgccgccgcc

SEQ ID NO: 638068 - DNA, 195 bp, Homo sapiens
tgtgactgagcgtcattctcaagacgctgaagggtgcgctgaggtcatgtaaccgcgagactctgctcatttgcaggtgttccttgatgctcagtggccggacggatccggctcctccagtttcttgatgtgcaccgttagcccgtttcaggaggctcagcgtggtgtggtgggtgctgtcggggcccaggggca

SEQ ID NO: 638069 - DNA, 1544 bp, Homo sapiens
  misc_feature (40)..(40): n is a, c, g, or t
  misc_feature (45)..(45): n is a, c, g, or t
  misc_feature (622)..(622): n is a, c, g, or t
  misc_feature (1012)..(1012): n is a, c, g, or t
  misc_feature (1382)..(1382): n is a, c, g, or t
  misc_feature (1494)..(1494): n is a, c, g, or t
tacagatccttaccactgttcgtggagtttgacataagtngaacnagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaaatcgacagccacactcggggctcttacaatcaggggtcataagctgctatgtcacctacctcaccttctcagctctgtccagcaaacctgcagaagtagttctagatgaacatgggaaaaatgttacatctgtgtgcctgactttggtcaagacctgtacagagatgaaactggtgactatactggggacagcctcttaatcttatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggaggnaccacgggtcatttatgacgagaagaaaggcaccgtctacatctactcctacttccacttcgtgttcttcctagcttccctgtatgtgatgatgaccgtcaccaactggttcaactacgaaagtgccaacatcgagagcttcttcagcgggagctggtccatcttctgggtcaagatggcctcctgctggatatgcgtgctgttgtacctgtgtacgctggtcgctcccctctgctgccccacccgggagttctctgtgtgatgatatcggcggtcccctgggctttgtgggcctacagcctggaaagtgccatcttttgaacagtgtccccggggcagggactggcgccctgtgcctgagtgggtctgaaaaagctttgagagagaaanaaaaatctcctgattagctttttattttgaaattcaaaaagaaactaccagtttgtcccaaaggaattgaaattttcaaccaaactgatcatggttgaaatatcttacccctaggaactggataccagttatgttgacttccttctgcatgtttttgccaaacagaatttggggcacagcatcttttcacagggataaaaatatcttgtggggccagtcattctcatcctcggaatagaaaaacatgccaaatcttgagtccccagcgcctaacagaatccagacccctctcactcacttccgcctcttagagccttgtccccagggggctttgaggacaggactcagcctgcagggcccctggtatttntagggtccaagaggaggcacctgcttttcaactgcaccctcagtgctgcctcttcacggcccctaaacgtttccctttgaggttgtgatgctgggaatcacagacttcactntctgcctgcactcaataaaccctcaataaatattttcattgtcaatcaga

SEQ ID NO: 638070 - DNA, 112 bp, Homo sapiens
cgagtggcagagagaacggataagcacaggagtcaataaattcgatgcaacaggagaaggaaccttgtgacttaacggaacgcatgtgaactagcgggtgtaatttatccac

SEQ ID NO: 638071 - DNA, 111 bp, Homo sapiens
aactacagaaatgcttattccaggaaacagaattcttttatttttgtcattaatattattataattttatcctatatatatatggcagaaggaaggacagttttactatcc

SEQ ID NO: 638072 - DNA, 790 bp, Homo sapiens
  misc_feature (40)..(40): n is a, c, g, or t
  misc_feature (45)..(45): n is a, c, g, or t
tacagatccttaccactgttcgtggagtttgacataagtngaacnagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaaatcgacagccacactcggggctcttacaatcaggggtcataagctgctatgtcacctacctcaccttctcagctctgtccagcaaacctgcagaagtaggtaagccagcctgttagtgggcttgtgtttgcggtgtgaatattttcattcatggaggaatgagctattgtttaaatattggagaggccttggagatagagagcagaaagatggttaccagaggctgggaagggtttgggaggaggttaggatgattaatgggtacaaaataaataggaagaatgaataagacctagtatttgatagcacaacagggtgactatagtcaaatttaattgtacatttaaaaataactaaaagagtataattggattgcttgtataacacaaaagatcagtgcatgaggggatgggtaccccattttagatgacgtgattgttacatgtttcacacctgtattaaaacatctcatgtaccacagaaatatgtacgcctactatgtatccacaaaaattaagttaaaaaaaa

SEQ ID NO: 638073 - DNA, 319 bp, Homo sapiens
tgaggaccccgaggctgttcctcaacgggcagttgcgcgatattcaccacgagaaggatccccatcctggatcgcggctcactgcggagtaccagaggattattcctacggtattcggaaacgaaaaaatatagacaagaatgaccgctgtcaaaggtcgaaagtgaaccattggtcatttccgaactattggtgtggtgaatgatcatggccaaggcacgttgcttttgcggtgataggtctgtgctagagcgttttaggtaggcttggcctaggaattggccatacagtttgccctggcccggaggccgttatgacc

SEQ ID NO: 638074 - DNA, 901 bp, Homo sapiens
gagcgtagtgaccgacccggcctcgttctggctggcgacgtatcgctaaggcggaaataagatgattgcccgcagggcgctggctccagacagctctggacagagcgagagtcaagtgaggccatgacatgcataggcagctagtcgtgatgcgacagccacgacaggaatggcgacgcgacagagcacgcgcagcttctggaccattgtagagacttcatagcaccttcatcaccacgagggatagatgtccgattctcacaagtgatttccgtcgctggaccgattctacacgctgttgtcacgattttggtattctaacaccatgatgagtgctggatcctttgcccttgagccacggggtgtttccagcagcaaaaacctgggaaagacccagagggaaacggacaacagcttatcttctagttcgtcaggaaattttgatcactacgatttccaggcctcaaaaatcctcctctcaaggagcccaagcaatttgatggcaagaggatccccagaggtgagtgacgacttgaacactttgttcccacacaatgatgcttcccactcgaggccagcttgaagggacgaatgataggtgactgcgttatgagcatgggctggacaatgtcaccagaggaggctgtattcagcatgttgtcatatgctgtggagaatcaccttaaagatatactgacgtcagatagtgtcaaggaaggaaagcttatcggttacagagatggtcattttcacatatgcctttggcagtaacgtgagcccgcaggcatacctgaaggaatagtgtacgtagctttacaagcaacttaattagaaaagccctacagcttatacttgttcctgggcagggtccgaatccaggtactcagcgcacgccctgatg

SEQ ID NO: 638075 - DNA, 433 bp, Homo sapiens
tgctgcttctctcctcgtgggttgtgtacatctaggtcaaatttgaatgtaagcatttacctataatgatgtctctgaattgacatgctactactctggtctcgttctatattagacattccatgttcgttaattttgggcgtgaagttttttcatgtcgagagcgactccttacagattttcggtaatgccgttttgtagttcttccttcatgccttccactggaagatgggacgttctcattgccatcactcatacctgaagcaacatctgaatgtgcactgtctacagaggaagccaaagtggtcggctgggtagcttggggctgtgctactgcaactggctctgcaggagcaacctgagagactccctgagtactctccaaaactgcttgctgggaggatgtagtgggggcttgtgctaaactccctcc

SEQ ID NO: 638076 - DNA, 257 bp, Homo sapiens
accgtcacaaatcacagtaagcggtatgaggaggtttgggggtttgttgttttcttctggcattgctgattgactccattacaccaaaactactttcttaagaagggattcatggtctgaatctaatgaaaacatgtttttgtttaaattttcacatttttaaaaaggctatccattttacaaggcaaaaactttcattgaatctgcatcttccaagacagctgtttctaatgtaaggttgttcctaatatgtgcat

SEQ ID NO: 638077 - DNA, 550 bp, Homo sapiens
  misc_feature (457)..(457): n is a, c, g, or t
tttattaaaattggggttcaccaggttggtcaatcttgtgtcacaactcccgaactcaagcgattatcatttgggccatacaacatgttgtggttatacgcaaaagccattagccccggtcgggggaaaaacagattatccgcttctactgtttagagtatctaatccaggcgtgagaccgtttttgttaacaactaccccattatctcattgaagatggattacttgttgcataacatcttatatttaaagcatgatacggaatgaagctctcattaatgcttgagtgctaggctggatcgaccactgatgaatctgcaagtatggcatactgaaatatttgttgaatgggtacatttgcttacttaacaagagtcgcaaaagacgtgatggctattataccagctaacttttggctggcaagcgctcttcctgcaacagtatgaagatgctttgngtggcacgcttaatgcttcccattggaacatgaccattcaagaggattctcaggcgttgacgctctagtaatacggcatgcttcctctcgtat

SEQ ID NO: 638078 - DNA, 410 bp, Homo sapiens
  misc_feature (36)..(36): n is a, c, g, or t
  misc_feature (77)..(77): n is a, c, g, or t
  misc_feature (146)..(146): n is a, c, g, or t
  misc_feature (207)..(207): n is a, c, g, or t
aaataaagtactataaaaaatttgtaacaaagtgtnccctgccatgaaaaatcagttttaaaattcctcctgggaanatatgccccaggagcacaattgcctgaattgtatggtgatatggtttgaactcagatctcatcttgaanttcccacatgttgtgggagggacccggtgggaggtgactgatttgtgggggcatgtctttncctgcgctgttctcgtgatggtgaataagtctcacgagatctgatggttttaaaaaggggtgtctccctgcacaaactcattctctgtttgcctaccgccatccgcttaagatgtgatctgctcctccttgccttccgccgcgattgtgaggcctcctcagctatgtggaactgtaaatcgaattaaacctctttcttttgta

SEQ ID NO: 638079 - DNA, 422 bp, Homo sapiens
  misc_feature (258)..(258): n is a, c, g, or t
  misc_feature (299)..(299): n is a, c, g, or t
gtattagtacgcagtacacagaagaccgactcgaaagaagaaaaggagagtacataagcatattcatctatgaaagagaaaagcaagcagaaaagatgaaagagaagggaaagtcctaacagttgcacccgtccgtggagctcctccaggaagctgcttcctgtgaggcccttttttccgagccatttcgggggacattggctggtcacgcctgagctttccattgtcctgtgagctggtcgtgtgagacacagtganaagacccccacaccatggtgctcaaacttgtggttctatangcccctttctctttctccaaattggcagtaagccctttcttggtcccatgaggggtgcggccacacaaccacgtgctgcagcctgcgagacaacccaggctgtctgtgggggccaggctggag

SEQ ID NO: 638080 - DNA, 163 bp, Homo sapiens
gggtccgaaacgcaaatggattatttcatccaacatatattcctattacatgattcaaactttctacttccggaaagtaatacttaaaagtttgagacaaagaagtgagatgcaacaatatctctaattttatttcttttaagcagtcttcattaataatgtt

SEQ ID NO: 638081 - DNA, 204 bp, Homo sapiens
ccccccctttttccgggggccctggtcccattttttatgccccaaaaggtcctttgttcccccggaaggaaaaaaaaaaaaaaaatgggctgggggggctttttttgggtctttaaaggggggtggaaaaccctaaagggcccagaattgggttgggaaatttttgggggccagggggtaaaaaaacccttttggtttccctta

SEQ ID NO: 638082 - DNA, 549 bp, Homo sapiens
tcgttcatttatttttcaaatgtttattacattctactagaccctacagattgaaagatgtacaaggtatgtccttgtcctctggggcttatggttaataggtattattacaatttacctgactaaagacctatgtggcctcatgatacacaggagcctataagatatgtttattagattatttatttacttttagttaacattttaagcatgtacaaacaatcaccataacctattggatttttttttgttaaaaaaattagtattcacttctgtgtcttgagcccacagatataagcagtatataatcagaaagttataaataaactcagattatatagggaaaggtgtgctcctaaaaacgacacatacattaattaaaaggatgcatctaaaattatgaccaaactatctttagaaggcagaaatgtaaaattatacctttaaaaatgaagacatcatttatatacttcaaaaataaaatgtgatatagcagagatgaatgatcgctataggattgtattggtttaagagaacacgatttctaaa

SEQ ID NO: 638083 - DNA, 198 bp, Homo sapiens
cttgtcggcacatacttctggtgggcactgatgcggaaacttgaggatagaaatcagtgagctgcatgcacttgaaaggcatggcctgtctacctcacttgagtgcaaggtccatcagaccaaacgcccatgttctagatcacatactcactgtacagaccagggggtatcctactacgagatcgcacctagcacggc

SEQ ID NO: 638084 - DNA, 254 bp, Homo sapiens
gacagggagacgataacactggagtgaaagagttataatcaggattcagtgtaatactgtggggactgtattatacatagatatatcagcgtacagtaggggaaaggtaagactggaaatatctttataaggatctgtaggaataagatggatatggtattgtgtgtaacctgcacaatgtgggaagctgatatacctgtgcaaaatctttgcctctgtgctgtcagtgtgatgtgctttctgcatggttatat

SEQ ID NO: 638085 - DNA, 976 bp, Homo sapiens
tatccgccccgtcccgctttgttgtacggcactgcttctcgtcctacagtgcttcccgctccacaggggggcacttcccccctggattgactcggggcttgacatcttttggggaacctttccggtgtagctttcttgcttaatccgtttgcccttggggggtctcatggacgcaacgcgtgggcgctgcgaccccatggggtgctcacttttgtttgcccccttgggccaagccccccctggttgtgccgcaccacacacttggtggtttggacgatagttccctcgactgggggtgagcgcgtcgcggcactcctccctatagggtgctccgcggcatctgattgtggcacttggcccttgctccatctgccagcgggggcgagcttcgcacactggccacgacttatgccgcgggtacgcccccttgtggttgtgatccccgattggtgacccccccggccggaacgcggagtattgcttttggcgcgggtgtgtgtgggcgctgttgtgtgtgtgtgctgtgggttgggtcgtctcttccaagtatttgctcgttttttgtttacccttctttcttgtatttctatccccgactcaccacgggaaggttattgaaatccaaccgtcaccccttagtttgcttgaacttttgtgtaaccccctgcttagggactcttgctacttaagatatatccccttcctcaagtggtgctattttgaaaactagaaaaaaactttgaattggctattttttgttgaatagccatattttgttttctgaattcattatgatccccctattgggtaatgctgaacatttatctggaaccgatgaggatattattattttgtatcccaaccggaattcagattaagggaaaatttgactagtgtaatctgagatatgtcatagggatttctttctgaccaaagggtgctttgctgttctttatattaaatacttttagatcca

SEQ ID NO: 638086 - DNA, 124 bp, Homo sapiens
ccaccgggctgctctggtctcgtcggtcccctcctccgccctgtcgtcctgactctactactccctacctttcctacagaggcatgtccggcttccagatcaacctacaacccgctcaaggagc

SEQ ID NO: 638087 - DNA, 920 bp, Homo sapiens
ggcgctcccgtttggcccaagatggcggctccgtgtgcagcgggttgctggggccacgggtgctgtcctggagccgagagctgccttgggttgggcgcccttaaacctccccggtctgcgccaagaaccgggcggcccgagatacgcgataagcaacggggggacaaggcgggtgaaccttacgagggaagggcaacacgcgcgcgggaaataaaatcggcccaccgtaaggggctggttgtcgctggcaacacagggtacaccttgggatgggagacgggacccattgccggaagagcggaaccgcggggtgacaggagatgttccttcgccaacgtttccattggtggggggtacccttaccccagtggcttggctttggattgacccaagattgggtttttaaaaaggcgcggccgggggtgatacacccaatgtttgagaagacttctggtggccgggtggtctccctgggagggccattgtttggtcctccacacacaaagaggtaagcatactctatacctgcgggtggggcataacaaggttggaaacttttgggtgtggtccctaatatctttcacaaaattggtcctgggtgcaggacttccaactcttacaaagatgttgttgggccttcaaaggggtggtggtattaaaggttactttcttaggaagaaattccccctttttttttccaatcaaagggtttgttagccttgtaggaagattgtgaaacggtggggaagggaagtggtagtgtgggagggaaagtgatcccccttcaagagggaattggaggcaatagtctcatcatgagggtaatgggaataaggagactttttatcccaataatataacacataacacaaaaaaaaatgtttggggcggcgtggcactgggagggttaaaaaacattg

SEQ ID NO: 638088 - DNA, 284 bp, Homo sapiens
  misc_feature (120)..(120): n is a, c, g, or t
tctcactagttgaccaggcaggtctcaaattcctggactgaaacaatcctcccgccttagcctcccaaagtgctgtgattacaggcgtgagccaccacatggcttatttctcttttgggnttttttttttctttttttttttttttaaaagtatacctttgacccccagttgggaggccatggggtgaattttggcaaattggaaccttgggcttcgaaattaaaagaaatcttcctccttaacctccccgggtggggggtttaggggatttcccccccacccc

SEQ ID NO: 638089 - DNA, 353 bp, Homo sapiens
  misc_feature (20)..(20): n is a, c, g, or t
  misc_feature (37)..(37): n is a, c, g, or t
  misc_feature (39)..(39): n is a, c, g, or t
  misc_feature (79)..(79): n is a, c, g, or t
  misc_feature (108)..(108): n is a, c, g, or t
  misc_feature (149)..(149): n is a, c, g, or t
  misc_feature (152)..(155): n is a, c, g, or t
  misc_feature (190)..(190): n is a, c, g, or t
  misc_feature (194)..(194): n is a, c, g, or t
  misc_feature (215)..(216): n is a, c, g, or t
  misc_feature (240)..(241): n is a, c, g, or t
  misc_feature (244)..(244): n is a, c, g, or t
  misc_feature (249)..(249): n is a, c, g, or t
  misc_feature (266)..(266): n is a, c, g, or t
  misc_feature (269)..(269): n is a, c, g, or t
  misc_feature (280)..(280): n is a, c, g, or t
  misc_feature (282)..(282): n is a, c, g, or t
  misc_feature (318)..(318): n is a, c, g, or t
  misc_feature (320)..(321): n is a, c, g, or t
  misc_feature (328)..(328): n is a, c, g, or t
  misc_feature (336)..(336): n is a, c, g, or t
tttctcctcatcattgcctnttttgtggttgtaaatngncttcttgcactttgaagatgagttactccttgtcatcttncaaatatgtgatatggtaattttcatagnagatgtcagttttgaaccaagaattggtgatttgtttatangannnnaggtggcttcatttctgtgaaattgctctttgaangggnctttttacacgtgtaagccanntgagataccgtgatggtgttgatnnctntcaangatgcttaccatctatnttngccactgagcntnttattatttgtctatttgtaaagattatttgtcttngnnaaaatantaaatatnctgtttatctgtttctg

SEQ ID NO: 638090 - DNA, 934 bp, Homo sapiens
tctgtatgcctgcttcagcagcagcaaaggtgctaccacctgtgccgtcgccagcgccattgatgtcaggaagagtccggttctgggacagctggagcacagctggtggtgactgaaataactttaccaaaggaaaagctatttgcgaactatcttctccagcggagatggccaaatgtgctttggtaaacagagccagactggttttcctatctcccaggatatatgcatctttagcttaaacagggttgtcaatcccaaagccatttacgacatgcagtggatcatcaggttcggatgagctctcatgctaggctgctgacaccttccacgatatatgctcatgcaacagtgtggcctgatgacaactatgcggaccctttggacactcaccggatcagagcgttccagcttctcctgggaaccattagcgttagatttgtcaccctcaaatggagacctggcttcaccagacagaaaacacgcctgcgtccatcaaaacttttgccgtgactgtcctagcagaaacctattattcaacgtttgctacgaccttgacgatctggtcaatcgaccacccagcattgtcgacttgccattccagcgcgtacatggactgcacccctgtatgtacacaagacacttaaccagtgaccaaacccttcacttggacacgttgcccacagtaacatgttccaataccacactgtcccgcaatcgcttgtcacacccatttaccatcacctgttccccgaactgtacgcctaatggccaaccacactgaactgactggcacatcacaaacctaacaatgcactcacttctttcaccttcaccactcctcaatcccacactcacgctccaccacacctacccctgcccacccgcatcctccttttccccgcacccatccacacaccacaactaccatatc

SEQ ID NO: 638091 - DNA, 691 bp, Homo sapiens
  misc_feature (11)..(11): n is a, c, g, or t
  misc_feature (88)..(88): n is a, c, g, or t
  misc_feature (90)..(90): n is a, c, g, or t
  misc_feature (101)..(101): n is a, c, g, or t
  misc_feature (121)..(121): n is a, c, g, or t
  misc_feature (125)..(125): n is a, c, g, or t
  misc_feature (127)..(127): n is a, c, g, or t
  misc_feature (164)..(164): n is a, c, g, or t
  misc_feature (166)..(166): n is a, c, g, or t
  misc_feature (168)..(168): n is a, c, g, or t
  misc_feature (176)..(176): n is a, c, g, or t
  misc_feature (179)..(179): n is a, c, g, or t
  misc_feature (181)..(181): n is a, c, g, or t
  misc_feature (185)..(185): n is a, c, g, or t
  misc_feature (224)..(224): n is a, c, g, or t
  misc_feature (226)..(227): n is a, c, g, or t
  misc_feature (230)..(230): n is a, c, g, or t
  misc_feature (239)..(239): n is a, c, g, or t
  misc_feature (256)..(256): n is a, c, g, or t
  misc_feature (274)..(274): n is a, c, g, or t
  misc_feature (277)..(277): n is a, c, g, or t
  misc_feature (317)..(317): n is a, c, g, or t
  misc_feature (320)..(320): n is a, c, g, or t
  misc_feature (339)..(339): n is a, c, g, or t
  misc_feature (341)..(342): n is a, c, g, or t
  misc_feature (434)..(434): n is a, c, g, or t
  misc_feature (498)..(498): n is a, c, g, or t
  misc_feature (520)..(520): n is a, c, g, or t
  misc_feature (549)..(550): n is a, c, g, or t
  misc_feature (553)..(553): n is a, c, g, or t
  misc_feature (573)..(573): n is a, c, g, or t
  misc_feature (575)..(575): n is a, c, g, or t
  misc_feature (631)..(631): n is a, c, g, or t
  misc_feature (677)..(677): n is a, c, g, or t
gatcccatcantacaaaaattcaaaaaattagccgaggatggtggatcgacgagcacttgtcgatcccagccagctcaggacgtgctnanagtgtggacgnatatagctatcgagtgcccncggnanttcaaggctagagtcaagcacgtgataaccagtgcantntngcctgggnaananacanagatccgtgtatcaaaaaaaaaaaaaaaaaaaaaaaaanannaancttctgatntttgtctttctggagtnctatttgctttgtgattnccncaatgcaatgcttcacctagtacatcatctggttctcccnggnccttttaggactgaactgngnntgaaatagttacatgtctgcctgttacacagtggaaactagtttccttcagagggacacgaaaccacagatgaggccacaaagaaagcattntccttccacagcaactggctgagaaaacagaaccaggaaaattctgccttgaggaaacaatgtnagcttcctgaatcatccagggngaaagggggagagaatagattttaaaatnnttnaaaaatggcctttcagagtncnctgttccaattgtttgtgtgtttgcaatcctgtgtcaataatacttggcctctaanagaaacacctggcccccagccatcgtcaacacacattgggcccctnctccaaaacacagg

SEQ ID NO: 638092 - DNA, 303 bp, Homo sapiens
cttgggaggtcccggcaatgctataaagaaagaaaaataagaggagtcctaattggaagggaagagagaagatgaatttgatcatgtctatggaaaccagcatagaatacacagaacaactcttacattcttatgagtgttcagcagggttggtgcaagctcaacttacagaaatcatcattaagaagcccaaggaatccataaataaatatacacaatttttctttgtcaatttaaagaaaatttaaaaatacggattccttcccatcacaatgaagatattaaatctgtctcaacagaaag

SEQ ID NO: 638093 - DNA, 117 bp, Homo sapiens
cttagagcataatgtgtggcagtatgtaggacttgaagattagttcgccgtatttagtgtactcattggttcagtaccattggtggccaattgatttgatggtaagggatggacact

SEQ ID NO: 638094 - DNA, 240 bp, Homo sapiens
gggccccccccccaaaaagggggggtttttttttggggggggccaaggggggggcttggggggcccccccccccccccggggtttttttttccccccccgttttttttttaccccccccccccccccccccccatttgggggggggcccccccctttttttttttttttttttttttgggggggggggggcccccggggggcccccggggggggggccccttttttttttttttttttta

SEQ ID NO: 638095 - DNA, 350 bp, Homo sapiens
ccaggggggtagccaagtagacaaatggaatcctggggtgaacccgaattttccaaaaaacagcctccaatttgtgcccccccaaagatgtgccctaaaggcaggtgaaagttttaattcaaaggggccctttttttccccttccctgcctagtttccttttgttccttgagtccacgcagaattccattttttggtcagcagacaggcttaagctaaagtattgcctttattctgtaaagttctggacatagttcccaagcttttgcagggggtgatttttgctcttgtcctgaaaaaaaacagggctgttttaaaaaacatttgaaataaatcccgcccccaaaggca

SEQ ID NO: 638096 - DNA, 543 bp, Homo sapiens
catcactgaaacaagattagggccaaaggctgaatgtagttaccttttctctaaatttgtcttcagcttctctgtggttgtacatagtactagtttaaaaaaaaaaaatcaaaaatacatttcaaagtgccgaagttgcatttttataaggtcctcatgggtagtactatgttataacttattttacaaaatcaccatgatagttacaccacatatttcctagcatttcacacagattaatttgcagaaaatagagggaagttcttggggatatactgcctgtgctcaaaactatttggctttaattatttaattatgagatatctttaaaatatctaaattataaatattttcagttacttttatagttactatcatatacctgtttaaagcttatgtccctcctttttttaataataagggggatgggggcagtctgtgctgtgtcgccaaggttgatgtgcagtgaccccttctcagtcacactgaaatttctgttccccaggtccaagcaagtatcaggcataagcctcctaaatagct

SEQ ID NO: 638097 - DNA, 194 bp, Homo sapiens
catttagattggaggcctgcagcatgggaggtaccacgctggctagtcagcagtcacaccaggatggtctagccgacactggtgtgcatacatctgtagcttgtcgactgctttcccagggctgtctgttttagatccctagctgtctccgcacaaagatcccccagtgaggtttctccgtgacttaaattgtc

SEQ ID NO: 638098 - DNA, 953 bp, Homo sapiens
aactccgtctcaaaaaaaaaaaaaaaaaaaatttcagataaaatcgggagcattctggttccatcaatttggaattaaattattaaattccaaaaaagtccggttaattgttattagcccccaaattctatttaggttaagcgggaattaaacacaaattgaagtttttcaaaacccttttggacagagaaaaatacaatggggataaaaaggttcttaaaagagtgacaaagagtggccgggtgtccatgagtttgaaaaaccaagggccatcaaatttattatctcctaatattattatttatagcatttaccccaaataaaaattctcaataggaatttggggtataccttggataaaggggcatttcacagggtgatatagggagggaaaaggtggtccaggctaaaaattttcttgaaaggtctggcagaaattgataagggaagggactggtaattatcagatacccaaaaatttttttaatcgaaaaactgggggtactgggtacccgggatagaccggatttattcgggtcacaataggagatcccagaagattaaacttgcttaatataaggcagggggatagcagtttttttctgaatttttgtctgctaccttcgctgttttgtggttacccacaaatcggctccttttgtacctcagaagaccatggactcatccgggtaacacccgaagcaccttcgggttattaaccggtggcacttggccagcagtatggtgcggaattcatcgggagggagcgtaggccactaataaggcgtgctggccattaatgtgcatgacgcctcgtcggaatacagatcaaggcggccgggatctacatctagatttaagaagccgttagcacggtttctacggagaacgagcaaaccgcggtggccaagaaacggcaccataacagcggaacaccgattgagacaagcgcg

SEQ ID NO: 638099 - DNA, 92 bp, Homo sapiens
aagtagacaagtgtgaagaaggcatcaacagaaccacccgtgaatcctgacgtgattgccgtaccttgaacgttacacctgccacagctgta

SEQ ID NO: 638100 - DNA, 896 bp, Homo sapiens
gctgcgaggagcggccggcgggcggcggctggcggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgctggtgtgagacctgcctgtgcctggcgcgcccgatggccctgctgtggctgctgctgagccctgctggcaatgcgccttgtggcttcactcaccaagcaacatgcagcaatgacccgctgctgcctactgccgagaagcttgcggctgccttgggcttctggcgtgcccctgcggggggccctggctgccaagccttggcaggtcttctgtgcacgtgcctacttgcacctgctgctcctagcctgctgccaggcgccttggcctggctgccccctgctgcccagaggccctactgtgctgtggcagcccaggcccttggcctgcggagctgcgaggcctgtgggccgtcgccagctgtgggcgtaggggcccgagccagctgcaggtgcgaggggtccggcgactggctgcacgcgccgctggagcccgacgtgcgcgcggtggtaggtagggctttgacccgcacttcagctacattgaagctcaccaagggcctggcgctacctgcagcaagcccggcctgcctgctcgtggagcaccaacattggaccacccgggcttccgcttgaacacgggccgcttacatcgcggggaaccgtggatgatcagggtccgaagccgtgcgacaattgcctgccaagcggccagggccgaccctcatcggggaaagcacaaccggtttacatttcagacttcgttttccaggaatacgggattcaacccgaagg

SEQ ID NO: 638101 - DNA, 1207 bp, Homo sapiens
  misc_feature (297)..(297): n is a, c, g, or t
  misc_feature (386)..(386): n is a, c, g, or t
  misc_feature (388)..(388): n is a, c, g, or t
  misc_feature (599)..(599): n is a, c, g, or t
ggttgcgagtaggaaccccgagaccccgatcgactgaccagcagccacggggtgacagtgctgcagacggtccgagacgatcataaccggtacttctgcgttgcgctgatctgcgcggcgcgcctgagctaatgcaccagacgatgcatattggcatcgatatggggtaataagcgtagagagtagatgtagtatagacccaatcaaacgtttggaccgcgcattcaaatctgaccacgatcgaaaacgtatcactgcggatgtgatctaggtcggttgccttaaataccttgagcnttccagtccaccaatgcgcaaagaagtctcccaatgtcgctacacagaacggacgcgcgcttgacgaaacgagaggagaacattgatgngntccacactgggagagagtacccaatcgagccaatcgtctccgcattgcatggcgcagaaatcacgcgtcgcaaataaactccatgtgaggagacagaatgtgcatgagtcggctagagatagcactcgagtggcgacgatcacaccgtcgtggcagtcgtttgccatgccgaccaattgcgcagagatgagccttgtgggtgcttccattntgccagaggtgagcgctaggtcctaaacatatcggtgggtctagatcccattgcttcatggctctctcgcatccttgcatagatctgtcccacctaaatggttctgttccattgcggatgtttcgaaacaccattgcaggcaaagtctactttgaacaaatcaaggtcctttcaacggaatccactccatgcctaatttggctcttcgcttgacaaaccgaacacaaaactttgccttttaggtcgagcccccttgtgtgcccaaagaggttcattcccaattgaacaaactttatagaggtacttccggtccgccaagggaagcgtcaggtgaaccgacaagtttccatttggcccaattcaactttggccactctccaagaaatgaacttggtgcagacttgtggccccccttctcgggggaaaaaaccttggttaaggccggtttgaaattgcgccccggcccgagggtggtcttcttccccaggaaaaacgattccaattccccctgggctatcttatcttgtgccggcttaggccaaagtggccttgttggggggtaaaagtggtccaattccccttgaagcttgaaacgggcgaaagcttca

SEQ ID NO: 638102 - DNA, 710 bp, Homo sapiens
acatgctgtactgctcggaattcgggatctgggcggcgggcctcgcgagtacgtgtcgacttcggaagtctgcgagcccagccaggtgtgcccgcttccacccctctcccctgagcgtcgtcccgtcggggtcgaacctcccccgcgacagtgcgccagccgcctgttcccccaatgccttgcctgcggacgccctgggaactggcgtctgggagccccgaggggctggcgggactcggtgtcccgggcatgcggcagctgccccgccctccggacatccccgtgcatcgggatgccgcatgctggggtttctgctcctcgctgcgccggcgaccccggacccggcacccgtgacccctcccgctgcctgcggctctgcgccgaggcctgccccgggagagacctgtccatgccgtccaaggcggagaatctagcgtgcactcctgagcccgggaccacgcagttacgccgtggaaggggaagtgacggctccaagtgacagttccctgtgagcctccggagccaggaccatgcgccgcgggtgtgtccccaaaccgattgctccgggctccgagaagccctcgcgcttgccaagctagcaaataccgggacaaggcccaagcggctaggtgacaccgcctagcccgaacaagcacccaataagacacagatggaccaccagaaagagacctcggacttggagccgaacc

SEQ ID NO: 638103 - DNA, 311 bp, Homo sapiens
acccgttttgcaccgtggtaccgcaggaggtaaagaatagaaaactggccgggcacgtggctcacacctgtaatcccggctttgggaggccaaggcgggcggatcacctgaggtcaggggttcgagaccagcctgatcaacatggagaaaccctgtctctactataaatacaaaaattagccgagcatggtgtcacatgtctgtaatcccagctactcgggaggctgaggcaggagaattgcttgaacccgggaggcggaggttgcagagatcgcaccattgtactccagcctgggcaacaagagcgaaat

SEQ ID NO: 638104 - DNA, 1088 bp, Homo sapiens
  misc_feature (60)..(60): n is a, c, g, or t
  misc_feature (128)..(128): n is a, c, g, or t
  misc_feature (159)..(159): n is a, c, g, or t
  misc_feature (175)..(175): n is a, c, g, or t
  misc_feature (398)..(398): n is a, c, g, or t
  misc_feature (477)..(477): n is a, c, g, or t
atctatgctggcaggaagaagaagaattgtgtcagttctctgccagcatgcctggtgacnttcctgccaacggttttacctaatacatagaataatcgctagttctagtcaggctgccctcgctgtcntggatttgagtcgaggtatctcgaggcattntatgactcatctattnaagcgtcacgatggagatcgttatcttgaagactgagatatgcagttctatcatgagagacgagcatgcaggatacataaggtaaaagggccgtggcattaatcggctaggaagatcagaaatacggagaattataccacacacgtaactgagcagtgtgccatggaggcaatgtgatgacagcacgcgaattgtatgtccaggtaacattacgctacgaganagaaagacgcgtgtaagtagttctagcgaaccgagacggttcccataattaagatgcctagccatgtgtgtcgcccttntgttgagtgtatggtacctgttctgttactgaccgtgaagacggcatctgtgtggcggtgcaaggacacataaacagtctacctgtggagatcgttgtacgtgagactgttgggtgcaccggagagccaccggtagtctattacctatcttggaatcagagtgctatcgggcttacttgtagtcaagtcaattcctgaacggtcaacccggcattgcttgcccctcactgggggtttccagttgtgtatattggcattgcgtctatggtaggaaggaaagacgcgcgggatcctctagggcggatggctaaaaccattcgtcttacccattgtggtacaggaataaaggaatatcagaaaggtttcgtatgaagacaatcaagtgaggagttttgcctcgattagcttgtttgactcgaccaagtcaatagaaatagacatgggggttccaccgatttaccagactggggcgtgtggactttctccaacctcagccattcggcattcgtattcattcaatttggccggctaccgaatttatttttccaaccaaataagctttaactttaaattggggcgattaaacacttctgcttgagggagaaaccaga

SEQ ID NO: 638105 - DNA, 399 bp, Homo sapiens
cagagatgagatcttggcctgttgcccaggctggtctcaaaccgctgggcttatgtgattctcctgctttggctcccagagtgttgggattacaggcatgagccaccacctccagcctgatgctttttaaatatatagtatttaggtctggtgcagtggctcatgcttgtaatcccagcactttgggaggctgaggcgggcggatcacagggtcaggagatcgagaccatcctggctaacacggcgaaaccccgtctctactaaaaatacaaaaaattagccgggcgtggtggcgggcacctgtagtcccagccactggggaggctgaggcaggagaatggcgtgaacccaggaggtggagcttgcagtgagccgagatggtgccactgcactccagcc

SEQ ID NO: 638106 - DNA, 513 bp, Homo sapiens
atcttgctctgtcatccaggctggagtgcaatggtgcagtcaaagctcactgcggactcaacctcccgggctcaagtgattctcctgccccagcctcctgagtagctgggattacaggcatgcaccaccacacctggctaatttttgtatttttggtggagacagggtttcaccgtgttggccaggctggtcttgaactcctgggctcaagcgatccaccagccttggcctcccagggtgctgggattgcgggcgtgagccactgtgccaggtccatatctactctgtctgtatctctctgtctctgtgtatctctctgtctctgtctttatctctatttctgtttctctatctctttgcatatctgtctctgtctctttctctgtctctgtctctgtctctctctgtctctgtctgtttttctatctctctgtctctttatctctctgtctctatctctgcctttgtctctgtctctctatctctatctctctgtctctgtctctctatctc

SEQ ID NO: 638107 - DNA, 141 bp, Homo sapiens
cgatctacaggatctggaacattgccagccagtagaggatgctgaagttggggagcggctgcaggccacacaggataagctcagcgttccattcagtggcacttccacctctggccaggtcacttctctgctggatacctt

SEQ ID NO: 638108 - DNA, 677 bp, Homo sapiens
cctggtctctctaaccgcgccagtgtgcctccgactcggaacggcttcctgtgtgccggggcagcgagggccgggggcggcgggcgggatgagtgcgtgtgtgcggtggagcggcgcggatgctgcggacttgccgggacgccacggctacgccgccgagttctcccacgtacctagcctgggccgcctgtgctagagccacctgagcagcactacggcatcgcgggctgtggaaccctactaatattggatccagatagaagctgggctaaggctttaaagaagctttgactggaatgatggtaagtaaagatgtgacttggagtgagaaacaactgaacatgtcctacatacacctgtagatggaggatggctcgactgcagcatctgggacactgaacaaagcaatgaagagagcaaaatagaaaggtataatagaagacacacagcatcaggagagatgatataaatagtatagattagtaagccaaataaacaagaaggtgaaaacagagtttgtaggatggtactggggaatacagtgaggaataaaaaacataggtaaaagtagggtagaagaatcacaaacatagattggaaaaagatatacatgatagcaaccattcagaaagaaacaatggaaaagtaataaaataaaaatagcaacaaaaaaatga

SEQ ID NO: 638109 - DNA, 115 bp, Homo sapiens
aaaactgggcatgtagcacatccaggctgatgtatggccacttgggattgatatggtcctccacattccagatggagttgagggtacctccaggtatggggtgcaagtaacttcc

SEQ ID NO: 638110 - DNA, 1056 bp, Homo sapiens
gggcggctgggaccctgtacacgtatcctgaaacactggagggccttcaaggctctcatcgctgctcagtacagcggggctcaggtccgcgtgctctccgcagcaccccacttccatttaggccaaaccaaccgcacccctggaatttcatccgcgaaatttccgtgccggccaagggtcaccagaccattatgcagggtgtgcatagcatgtgcattcgtagtgatgatgtatgccagcagcacaactgccccatttgcgctcacatcatagtgcagccacattgcaggcagcttgcggggcacagtcaatccaagcaggccagcaagccccagagtggtagccagttgggtgcagctttatgctgcattccggatctcgtgcccccagaccagtacctgggtgttccccaccttgggcatcatgcaacacaacaaacaggccactgagcactgcacaggaggaagtgcggcgaattctggggctgctggatgcttacttgaagacgaggacataaactggatgggcgaaagagtgaaaattggcttgacatcacagattgtctgacccctgtatgtggatctaataagcaaggtactagagccttctttccgccaggcctttcccaataacaacgctggattcctcacctgcattaacaagcccagttcgggctgactagggggcacgtgaaactgtgtgcgacagctggacagcaagacgctacaaacgatgcagaagacccaaactacaccagacaacaccacggaccgagacgggacccgacaagagaaccagaacgccagagcgaacgcaacacgaaaacaaggggcagacaccgaaacacgaacacgaaacggcagaaaggcaacgggagagtcagaagacaccagggcacggaaccatggcccagtgcaacaacaacaggcggaaaacacacgcacaacgacgcgagcacgccgaggacaggcaccaggaaacagcaagacacggacacggcaacagaaacccacaaaacaaatacgagaacgcgagcagcaaacacgaacacactca

SEQ ID NO: 638111 - DNA, 415 bp, Homo sapiens
agcactgccaacagaccagagtgcgcgagcaacccaacagtgacacagcatgcgctcgcgatgtaggaagaacttcggcgagagggaagcattgagactctgagtaacaggtcaagctccaccagcggcagcataccaagaaactttgatggctaccgatcttcgctgtccaccaatgagagccagacccttagactctttccgactggctttccgtaggtaccagaaacctggttctgactggccaggccccttccctgttggaggaagggagaagccccgctctgtgcctacaccttagactctggtcttccttcatccacactttcccaagcttagtgacaggagacgcccatactaactggatggagaagagaccctctttcgcacctcagagcacttggcctctgtcacc

SEQ ID NO: 638112 - DNA, 498 bp, Homo sapiens
agcgcacacgttcggtgtcctgcagtacgacgatgacgtggcgggcgaagatctcgccagcggcggtcaggcgcaggccgccgggcagtcgctcgaacagcggcgtgccgacctcgtcttcgagcttgagaatctgccggttgaccgccgaggaggcaacgttgagccggcgcgaggcttcgcggatcgactggcagcggcgcaccatgtcgaaatagtgaatggccggcgagtggatgcgcagcttgcgggccaagccttcagcgctccgctgccggtggcttgagtccgcagcccttgagaatgatggcgatcagattgtcgctggcaagggcgaagtccgcgcgggtcatccgcttgccgttgatgcggcggatctggtcggagaagtcggcgtagtgctgcgttccggcccagatcaggaagatcaggtgcatggggtcgaccgggtccatcttgccggcggcgatccaggcgtcgaataccgcggcgcggccg

SEQ ID NO: 638113 - DNA, 444 bp, Homo sapiens
atggcggtctttattgaaatgttatcctttgtgctaaactggctgggcattccacagcaccatgttgaggtcatcgatgatgtcatgaggatggcggcatcaagattacaggccactgactgggcagtccccaggatctctttaagggttccagagagttctctggctaagaatcggtgccgcatctgtcgagcaaggttgacaatctcatcaaaagtgatattcccactgtgttcaatgttgttctgttactttctgtctcttggtggttccttgaggggctttgatgatcagggcagaggcagaaggcaccacctcaatctgggcctgtctgtactgaatggtcagtttcactgtaatcctcaggcccttccagtcacccagttgccttggcaatgtcatcaccaacttttttgggagacagacccagggggccgatcttgg

SEQ ID NO: 638114 - DNA, 188 bp, Homo sapiens
gacggaccactgcacactcataaaggaattcccatcatttcctcatgagacagccacctcagggtgtgaccatggccttggtatcccccactatggatggagacccttccgtttagaaaactcactcacacacattaagtttcagagggcacagcggaaaccactttctttgtttattgattctgttt

SEQ ID NO: 638115 - DNA, 498 bp, Homo sapiens
gcgatgcgattcatcgtcttgcgttggtgcagactgctcactcgcggatgctggccgagtaggataactgccggaagtgggtccgctggttccagactccagatatgcccaggctgtcatatcggtcttcctcgtgtgtaatatgatggactgggcggtaaattcatcatcgaagtaccttgtgtcgacctcggacgtgacctgaggtttgaagggtggcaggagcttcttctggaccacgtcctgccagttgatgctgaggaagaacctgtgctccatgacctccttggcatcgctgggccccccaccaagcctctgcttggggtccttcttaagcagcccagcaagcagggacttggcctcggggctgagcgtgcgcgggaagcggatctcttccatgaggatgagctcgaagaggcgctcgtggtcctggttgtagaagggcaggcgggcgcacatcatctcgtacattaacacacccaggcccaccagtcccgg

SEQ ID NO: 638116 - DNA, 240 bp, Homo sapiens
tgacgggaggatcccaggagtgtgtctcttcagtgggtattggcggagccgctcgtgcttgagatgctggtaggaaaaggagtagctaaagagcacgtagcatgccagcaccagggtaatccccgagatgctccccttcttcacatggatgtacttgtggtagtaccggtagtaacctcttggaaacgctccgaaaaggccactaggactgaagtcccgcatcaagatccggcggtctca

SEQ ID NO: 638117 - DNA, 1360 bp, Homo sapiens
tgcagtgaagctggcacgggcaccgtgcacgaccctgtggaaagccggggtccccgcgagttgcagctcccggagctccgtgtttgctggctccaccggcgaaagagatcccggaggatcctagtggacccacgcagccgtgcggcgctatgtgctggggcctgctttttgggcaagggcggcttttgcaggtgcttcgagatctcggacgcggacacccaaggaggtgattcgctgggcaaacgacttgtgccgtaagtgatctcttgccttgcgtccaagcccggcaaccgcagaagggcgaagacaagcactggtcgccatgggagccaattagttcgcggagtttcaaaccaggacacaggacccatcggggcacacaaagcccaagagcaacaggatccgttaacgagagaaatttgacccgagcaggggggccatatcaatataccagggaatgaggcagcccaaaacaggaaccttttacagcgataggatcacacgcgtggagctcggcacagggcgaaggcatcagttgacgcaagaaccaggagaacgctgatccttcagatacacgttgaggaaaggcattgggcaaacagacaggatcggggacgggggtagaaacgggaccccgagttgaaccttgggacgccaccttgcaagggtgcacccccggaagatacgaggtaacgcaattacaccggcggagaaaaaaagttttggatggcctattggcgctttgacccagggttacccgtgtgacgagcccggatagaacacacaggaaggattactaaagtgcaacaattcaggacaggaaccactatccaagaggccttatggtgggccacaacgccccatttgtataaccctttgcaaacaattggcaagggaaactccttgggcgaacgcgaattgtaacgaacacagttaggcggcggcggcactcacgggggggacagtgggggcaacaaccacgcaacaagcatccgagaacagctacaatggaaacagacgggacggcaagaccacggaggacagacaagagtgaccaccagtatgggaaagatcaggcggcgagacgaccccgcgaaagaggagacagaggaaaagcagacacccccggaaagagagatatggacgagtgcaggcggcgacagaagaaaacgaaggcggggccgacaaaacgacaagcacacgccaacgatgcaagtaggaatcagtccaggtaaggagacacacgaacaaggagagggaagtgcgacagaccaacggtcggatagcacgcaaccgagtagagggacaaacagaggggagggacaaaaaacgagacagccgaataaaaagacacagaagg

SEQ ID NO: 638118 - DNA, 497 bp, Homo sapiens
atacatgtcgtcgctcgggcatcaaccggggccccggcgcccatgcgtccggcctgtacgaaaccttcgacggcctgccgctgaccggcccgggcggcacgccctacgaactcaaggacccgttgtggctcagccgggttgaagtgctgcgcggcgccaatggttttgacctgggcgcattggccctcggtggtgcggtcaactacgtcacccacaccggctacgacgcccccaagctgcaagtgcgctacgaagccggcagccatggctacgcccaacgggaaatcagctcggggcaggtgctgggggatgccgactactacatcagcctcaccgactcgcactacgatggtttccagaaccacagcgccggcagcggcaaaggcatggcggccaacttcggctaccgcttcaaccccgacctggaaacccgcttctacttccgctaccgcgaaaccgataacgattcccccggcaagctgacccgcgaccagatc

SEQ ID NO: 638119 - DNA, 479 bp, Homo sapiens
  misc_feature (19)..(19): n is a, c, g, or t
  misc_feature (58)..(58): n is a, c, g, or t
  misc_feature (90)..(90): n is a, c, g, or t
aaaaatattcccctcaganaaaaaggtttgggtacccctaaaactttaaaaacctcantacgtttttttttaaaagtatgttgtcctcantcctattgaagaagtttatacaacatacaggccttcctaggtcctaccccggcccatcctagtttagtcaagacagctgtgtaacaaacgtagccttgaggcccggcacggtggctcatgccctgtaatcccagcacttttgaggctgaggcgggcggattacctgaagtcaggagttagagaccagcctgtccaacgtggtgaaaccccgtctgtactaaaaatacaaaaaagctagccgagtgtggtggcaggtgcctgtaatcccagctacttgggaggctgaggcgagagaatcacttgaactggggaggcagaggttgcagtggcccgagaccccaccattgcactccagtccgggaaacaagaacgaaactcccatctcatat

SEQ ID NO: 638120 - DNA, 592 bp, Homo sapiens
atgtaaaattgtacttgaatatgcttgaataattttgcacttcttcacttttttctctatgaattattcaatggtcattacttaaatttgtattttaatgtatgataaatgataatatgggggggggaaatagagtgaagtaccctgacattctacagatataatatgatatgctatgaaaaacaaaacaaaaagaaaatgtgccatatattttccatgtaccatctttatatgatatacagtgacttcattattagtgagtcaagttgtttaaaggactaccaaaagaagtattgctattttatggtttttatggtgtaaattatttttctgtcttcttgagtcttatgtctaagtctgtcttccttgtccagatgctgtcatatttttccaggaaatcatactgaaaacatttaaaaatttatgcacgatttcatcaacttgtttttcattatattatatttagttcaattttgcaactaacagactctctatcagagtcattaacctgtgaacagtataaagtatttaacatgtaactatagataatttgatccgaaacaataaaaatgaacacttttcaagaatatgg

SEQ ID NO: 638121 - DNA, 521 bp, Homo sapiens
cggcatacttggatgaaggtcatttaactcagagcggacaaaaggatatggtcttatatggctctcaaatttttctcggatcggttcccaatcgggaaacgtgtgagtacatcacttcagatattggctaggcatctgagctgggcctgaggatatccaccagcatgatggagaagacatgctggtcctcaggaaggcccaagtctaagcaccggctcatgccccttcctgggcggtgtggcttttctacgctggaaaccaagctggtagacatggtgtacctttccataacaggtctctctcttcggtcaggtggtggtcacggaatgggattgggcagaaataccagaaagtgcaacatgtggtcgcagctggtgaccttcaagtcaggtcacggtgggcattggccagcctcggtgtgtgggttctgtgtgaatcaggcctaggtgggactcggctcctactattggagggcttgtgaggcttttctgaagtgtgtctcctgctccttgagtcgggct

SEQ ID NO: 638122 - DNA, 246 bp, Homo sapiens
tcaatatcctgccaggcagcaagccatactgcccagacccctttggcccataaattgccccagcctgtaagcagcagtgggctctggcattatgctggttcctgacttctgtaggttttatgctggacataaagcctgcatttgctattaagccaccctcttacgtatgtctttctttaaccctcgccttcccttcaaaacctaacagccagttttgtcccctggaaaagagtctcctttctccca

SEQ ID NO: 638123 - DNA, 222 bp, Homo sapiens
ggcttgcagatagaggaagaagaagaagaagaagggaccaaaggactaaaaaaagttgaaaaaactgtcttgggactgggaaccttattgaattgatatcaaacccaatattggcagagaccatcaaaagaagtagaaggaagatgaatacaaagcttttctacaaatcattttcaaagggaagtgatgaccccatggcttatattcactttactgctgaag

SEQ ID NO: 638124 - DNA, 615 bp, Homo sapiens
  misc_feature (50)..(50): n is a, c, g, or t
  misc_feature (75)..(76): n is a, c, g, or t
tacacacgtggagtttaaaacattgtgatactttcaggtcacttattccntacacaaacactatagagaacctgnncttggcagcagagcagtgaacatgtggaagtggtctctaaaacaaatattgtcctggaactctccaggacaacacaaccttatgagtgacatctgttggcattctgtggaatttctgtttatagcctgagtctctgtttgaatgcaagtaaagacccttaaaatttgtttgccaagtatcatattagaattggtgtttttgttatccggcattaatacaaacttcatccaaaaaaaaaaaaagaaataggccgggcgcgagccaccgcgctcatagctgtagtcccagcactttgggaggccgaagcgggcagatcacaagatcaggagatcgagaacatcctggctaacatggtgaaacaccatctctactaaaaatacaaaaaattagctgggcatggtggcgggcgcctgtagtcccagctactcgggaggctgaggcaggagaatggtgtgaacccaggaggcggagcttgcagtaagccgagaccgtgccactgccctccagcctgggcaacagagcgagactctgtctcaaaa

SEQ ID NO: 638125 - DNA, 306 bp, Homo sapiens
  misc_feature (50)..(50): n is a, c, g, or t
  misc_feature (75)..(76): n is a, c, g, or t
tacacacgtggagtttaaaacattgtgatactttcaggtcacttattccntacacaaacactatagagaacctgnncttggcagcagagcagtgaacatgtggaagtggtctctaaaacaaatattgtcctggaactctccaggacaacacaaccttatgagtgacatctgttggcattctgtggaatttctgtttatagcctgagtctctgtttgaatgcaagtaaagacccttaaaatttgtttgccaagtatcatattagaattggtgtttttgttatccggcattaatacaaacttcatcca

SEQ ID NO: 638126 - DNA, 709 bp, Homo sapiens
  misc_feature (46)..(46): n is a, c, g, or t
  misc_feature (50)..(50): n is a, c, g, or t
  misc_feature (55)..(56): n is a, c, g, or t
  misc_feature (60)..(60): n is a, c, g, or t
  misc_feature (68)..(68): n is a, c, g, or t
  misc_feature (72)..(72): n is a, c, g, or t
  misc_feature (78)..(79): n is a, c, g, or t
  misc_feature (83)..(84): n is a, c, g, or t
  misc_feature (86)..(86): n is a, c, g, or t
  misc_feature (91)..(91): n is a, c, g, or t
  misc_feature (95)..(95): n is a, c, g, or t
  misc_feature (106)..(106): n is a, c, g, or t
  misc_feature (108)..(109): n is a, c, g, or t
  misc_feature (114)..(116): n is a, c, g, or t
  misc_feature (123)..(123): n is a, c, g, or t
  misc_feature (128)..(128): n is a, c, g, or t
  misc_feature (140)..(140): n is a, c, g, or t
  misc_feature (142)..(142): n is a, c, g, or t
  misc_feature (156)..(156): n is a, c, g, or t
  misc_feature (164)..(164): n is a, c, g, or t
  misc_feature (177)..(177): n is a, c, g, or t
  misc_feature (181)..(181): n is a, c, g, or t
  misc_feature (184)..(184): n is a, c, g, or t
  misc_feature (203)..(203): n is a, c, g, or t
  misc_feature (226)..(226): n is a, c, g, or t
  misc_feature (235)..(235): n is a, c, g, or t
  misc_feature (237)..(237): n is a, c, g, or t
  misc_feature (244)..(244): n is a, c, g, or t
  misc_feature (253)..(253): n is a, c, g, or t
  misc_feature (267)..(268): n is a, c, g, or t
  misc_feature (272)..(272): n is a, c, g, or t
  misc_feature (331)..(331): n is a, c, g, or t
  misc_feature (435)..(436): n is a, c, g, or t
  misc_feature (439)..(439): n is a, c, g, or t
  misc_feature (693)..(693): n is a, c, g, or t
ggggttatctccaaaagggtacttaaaccaggtctggtgcagtggntcangcctnnaatnccagcacnttgngaggcnnaggnngntggancacnaggtcaggagntnnagacnnncctggcnaacanggtgaaaccccntntctactaaaaatanaaaaattngccaggcatggtngcangcncctgtaatcccagctactngggaggctgaggcaggagaatcncttgaaccngngaggtgnaggttgcantgagccaagatcannccantgcactccagcctgggtgaaagagcaaaactctgtctcaaaaattaaatgctgtgctgnttgagttctggttcatttagataacattctttcctgccctatgaccaatcaaaaggctttaggaaaatagcatttttaaaattaaaatgtatttcagtgcatgnnatnttaataaaaatagaaaaccaatgtgtacatgatttccaatttcacacgggcctagattctcctctcatcagttgctattgaactgatttttttgtgtgctgccatagtgtaggctctttagtcatcttggtagaattaaggccattattaatgctattataattttcaggccagcacaatggttcatgctttgaattcccagggcctttggaagcccgaggaggccggattgcctgagatcaggggtttagatnaaccttgcccgtgatg

SEQ ID NO: 638127 - DNA, 766 bp, Homo sapiens
  misc_feature (46)..(46): n is a, c, g, or t
  misc_feature (50)..(50): n is a, c, g, or t
  misc_feature (55)..(56): n is a, c, g, or t
  misc_feature (60)..(60): n is a, c, g, or t
  misc_feature (68)..(68): n is a, c, g, or t
  misc_feature (72)..(72): n is a, c, g, or t
  misc_feature (78)..(79): n is a, c, g, or t
  misc_feature (83)..(84): n is a, c, g, or t
  misc_feature (86)..(86): n is a, c, g, or t
  misc_feature (91)..(91): n is a, c, g, or t
  misc_feature (95)..(95): n is a, c, g, or t
  misc_feature (106)..(106): n is a, c, g, or t
  misc_feature (108)..(109): n is a, c, g, or t
  misc_feature (114)..(116): n is a, c, g, or t
  misc_feature (123)..(123): n is a, c, g, or t
  misc_feature (128)..(128): n is a, c, g, or t
  misc_feature (140)..(140): n is a, c, g, or t
  misc_feature (142)..(142): n is a, c, g, or t
  misc_feature (156)..(156): n is a, c, g, or t
  misc_feature (164)..(164): n is a, c, g, or t
  misc_feature (177)..(177): n is a, c, g, or t
  misc_feature (181)..(181): n is a, c, g, or t
  misc_feature (184)..(184): n is a, c, g, or t
  misc_feature (203)..(203): n is a, c, g, or t
  misc_feature (226)..(226): n is a, c, g, or t
  misc_feature (235)..(235): n is a, c, g, or t
  misc_feature (237)..(237): n is a, c, g, or t
  misc_feature (244)..(244): n is a, c, g, or t
  misc_feature (253)..(253): n is a, c, g, or t
  misc_feature (267)..(268): n is a, c, g, or t
  misc_feature (272)..(272): n is a, c, g, or t
  misc_feature (388)..(388): n is a, c, g, or t
  misc_feature (492)..(493): n is a, c, g, or t
  misc_feature (496)..(496): n is a, c, g, or t
  misc_feature (750)..(750): n is a, c, g, or t
ggggttatctccaaaagggtacttaaaccaggtctggtgcagtggntcangcctnnaatnccagcacnttgngaggcnnaggnngntggancacnaggtcaggagntnnagacnnncctggcnaacanggtgaaaccccntntctactaaaaatanaaaaattngccaggcatggtngcangcncctgtaatcccagctactngggaggctgaggcaggagaatcncttgaaccngngaggtgnaggttgcantgagccaagatcannccantgcactccagcctgggtgaaagagcaaaactctgtctcaaaaagaaaaaatagaataaaaaagcaggcttttaaatgagtagctacagtgttaaatatatttaaatgctgtgctgnttgagttctggttcatttagataacattctttcctgccctatgaccaatcaaaaggctttaggaaaatagcatttttaaaattaaaatgtatttcagtgcatgnnatnttaataaaaatagaaaaccaatgtgtacatgatttccaatttcacacgggcctagattctcctctcatcagttgctattgaactgatttttttgtgtgctgccatagtgtaggctctttagtcatcttggtagaattaaggccattattaatgctattataattttcaggccagcacaatggttcatgctttgaattcccagggcctttggaagcccgaggaggccggattgcctgagatcaggggtttagatnaaccttgcccgtgatg

SEQ ID NO: 638128 - DNA, 1501 bp, Homo sapiens
  misc_feature (685)..(685): n is a, c, g, or t
  misc_feature (763)..(763): n is a, c, g, or t
  misc_feature (837)..(837): n is a, c, g, or t
  misc_feature (839)..(839): n is a, c, g, or t
  misc_feature (1098)..(1098): n is a, c, g, or t
  misc_feature (1243)..(1243): n is a, c, g, or t
ggagacgccacagagcggggggtgctccgacaccagtgtgttcaacagaagggggcttcacacgccgtgtggggaggacgttcgttcgttcccccgcgggaggtcgcccccccccccaggcccaagaggtgccaaagtgcctcgttggaggaaccccccggggggccccacaaagaaaggggttccaccaacgaagaagtggcctaccggccggcgcgcggagagggggggggaaaaacccccccccgcgggggaaaatgtgttataaaggcccccgccgtttgggagaacaccagaaccgcccccccccccacggagaggggtgtaccaccacaaaagaagtgcgctggcgccccccctgcgggcgaggtggaaaaacgccgtcgggtgtgccgccccccccctccggcagataaaatgggggaggtaataaaaggagtgtgtcccccgccgccccgagggggggacgctgcgacaacccccctcccctccgagaatggaaaaaaatatgccctgtcgagaaaccttatagtagtagagaggatcgaggaaaaatattgttgtcgtcccctcacgcgctgcgagggtctcaacaaaaaggtttcccctcttctctctctctgggagagaatatggaagtattgaccaacacaccggagagggagagcgccacacacgtgtgttngggggtcgtctctctgagagcgcctctgtcctttttccggcggcgtcatcacacaggtgccttaatatattcttctcncactcctctcgcgggttatagacaccacacgtttgcacgcgcaccacacacacaagatgtcccccacatcatgngnggttgtgtctcttgtaaaataaaagagtgccgtctcttgtgtgtggtgtggtgtgtggtatgatgaggacacaccactcgtaatgtgtggtgtataaagaaaaaaaaaagaggaacgacgtcgtataattggtgtctttatagagaaaacaccctctatatatgggggtgtctctcgagaagagattttttttgggacacacccccccgtcgagatatagagatctctatatagagagctctcgtagagagagagcacntctcgagagagatgtgagacacacatctgtgctctacacatagactctctgttctcatcactcgtgtctcgagagagatcacacagagaataatatgacacactctgcccacagtgataagagagaggctctataaatatagtgntttcactctctcttggtgtgtttgtttttcataagacacacactcttttctcttatattctccccagtgcattctctcgagatattcaccattttgatatatataaagaaaattgaggcgtatacccatacaccacacccgtgtatattacattttatattccactaatagcgtttccagcgtttacattttattgtgtatagataatagtgaggttttataaaaatagtttgagtccaataaaattagaaaagctta

SEQ ID NO: 638129 - DNA, 169 bp, Homo sapiens
cacacagaccgcatcgcagcagcgcacctgtggggagggaggcctgactgctacagaggatgatgctgttgttgtcgagggctcagatgctgttggttctatgagaacaacgaagcttccatctgttatctaggcgagactgtgtgagacagaagctaagctaagatgc

SEQ ID NO: 638130 - DNA, 255 bp, Homo sapiens
gaaaatgctgcttctccaaataaacaaggacaatgggggccaaagcctgttttggacaggatttccaccctcccctggtttttgccaatgagatgtatataatatccaaggttaaaaaaaaccccgcccccagttttcatttaaattgtttattatttatttccaaggaattttgtttttctttattaagaccaaaaatgtgtttctcattaaaaaatggcaacttttatgggcccttagtggcctgtgccttca

SEQ ID NO: 638131 - DNA, 986 bp, Homo sapiens
  misc_feature (1)..(1): n is a, c, g, or t
ncttttttttcctctgtgtagtgagaacgagaagtcagtgacgcgagagggaccggacattgtgccaccaggtgtgtaatttgtctcggcttgtagacctaacccgccgttgggggggaccttcaaggcctgtggccgattgtgcccgccctatttattagcgcccggcctgttggccccgccgccttttaggtgtggctttcgccgtcgttttgttcggaccctcaggccttccgcgaaaaacggtttggggaccaaacaacataggcgcccatgacccgaagatccgtttctggacaccaagggggccccactgcacaccaggtgcaatcctcggcagggccgggtcacctccctgagcctcagccacgacccactcacctgctgcaactgttcccgagaccaccaccactcaaggtcatcgacctgcgtgtcagcaacatccgcccggtgttcagggcccatggcttccagatgtggttctgactggacccaagactgtgttcagcccggaccgtaagctatgccactggccggctcctgtgatggggccccttaacatctgggaatgtggacacccgggagaactggagaccacgactaccacgggacccccattgcgctgccgtcaacgccgctggcctggtgctaactccggcggagccaccactggtgagcgctggacaccccgggccacggaaaggttgtgctctggcacctagggccaccgacctcgcctgcctgggctcggagctcttgcccgaagcctgaagcttccttcggcgccacatgcacccaggggttggggttgggactggaggctggccttgggaatttaaatggggaagaaaggcctggccacggacctggcctgtttgtttaaaaatggtaagatatgggttgggggattacgctagatttttctttgtatttttatctctatctatctcctccctttttctccccaagtagaaaaaaatgatatc

SEQ ID NO: 638132 - DNA, 182 bp, Homo sapiens
gcggccgcctactactactactactgctcgaattcaagcttctaacgatgtacggacatgcactttttttttttgtatttttagccgaggtgggtggatcacttgaggttaggagtacaagaccagcctggctaatatggtgaaaccccgtctctactaaaaaaaaaaagttgtactgcacc

SEQ ID NO: 638133 - DNA, 471 bp, Homo sapiens
tctgcttgaagactcagcctatgctctttgaaggtcagttgaatagagctaagagaaacaggccaagatagcaatacattctttagtaaatgaggcagtgatcatatgaccaaactcaaaatatgcttgaaatcccagcatatggttgcacattgtggcttcaaactccatgctcttaattcctaaactatcctttctgtcttctgaaaggacgtgtaggacctgatactcctagtcatcttgaaaatgttgtccttggtattacatgtatcatagaattgaccatataagcattttttgtaagtattattgctcttagaaatctgttaagtaatttcatattttttagccattaccttacttatgaatgtaaagctttcaatcttacatctgtttttactttgcaatcaggaactgtgaccgtgtcatttgtaaagcagaagtaaaagatgttctattgaaaaaaaaaaa

SEQ ID NO: 638134 - DNA, 229 bp, Homo sapiens
gaaaccatggtgatttgccccagaatgtgtatccaggtgagaactgaggtatccttagctgctggaggagtctctctctgtcacccaggctggagtgcagtggcgcgttctcagctcactgcaccctccacctcccaggagaatcacttgaacccaggaggtggaggttgcagtaagccgagatcgtaccactgtgctctagccttggtgacagagcgagactgtctta

SEQ ID NO: 638135 - DNA, 336 bp, Homo sapiens
  misc_feature (35)..(35): n is a, c, g, or t
  misc_feature (147)..(147): n is a, c, g, or t
  misc_feature (168)..(168): n is a, c, g, or t
  misc_feature (217)..(217): n is a, c, g, or t
  misc_feature (249)..(250): n is a, c, g, or t
  misc_feature (252)..(252): n is a, c, g, or t
  misc_feature (279)..(279): n is a, c, g, or t
gtaattctccggtaatagatcctaaccaaaaaganataatcaaaataccaatttaaattattgattgtaaagaatctcatggaaataaaaagacaaatctgaaaaccagtactgatgaatcaacaaattaattttgaatatgaatgncaagtgtaccaacgagatggntatcattatttctaaaaaagccagaactgctagaaaataaaaatttttngaagggatttaaaccaaggccaggttgaaagnntncaaccaaggaggacttaggagccaagncaaagccaggggaatctcacttgcttgaaacaaatctttttaaattaatagagtcag

SEQ ID NO: 638136 - DNA, 908 bp, Homo sapiens
  misc_feature (94)..(94): n is a, c, g, or t
  misc_feature (97)..(97): n is a, c, g, or t
  misc_feature (105)..(105): n is a, c, g, or t
  misc_feature (112)..(112): n is a, c, g, or t
  misc_feature (118)..(118): n is a, c, g, or t
  misc_feature (132)..(132): n is a, c, g, or t
  misc_feature (138)..(138): n is a, c, g, or t
  misc_feature (147)..(147): n is a, c, g, or t
  misc_feature (154)..(154): n is a, c, g, or t
  misc_feature (161)..(161): n is a, c, g, or t
  misc_feature (168)..(168): n is a, c, g, or t
  misc_feature (191)..(191): n is a, c, g, or t
  misc_feature (198)..(198): n is a, c, g, or t
  misc_feature (207)..(208): n is a, c, g, or t
  misc_feature (233)..(233): n is a, c, g, or t
  misc_feature (235)..(235): n is a, c, g, or t
  misc_feature (244)..(244): n is a, c, g, or t
  misc_feature (250)..(250): n is a, c, g, or t
  misc_feature (312)..(312): n is a, c, g, or t
  misc_feature (323)..(323): n is a, c, g, or t
  misc_feature (333)..(333): n is a, c, g, or t
  misc_feature (335)..(335): n is a, c, g, or t
  misc_feature (350)..(350): n is a, c, g, or t
  misc_feature (363)..(363): n is a, c, g, or t
  misc_feature (499)..(499): n is a, c, g, or t
  misc_feature (813)..(813): n is a, c, g, or t
  misc_feature (815)..(815): n is a, c, g, or t
  misc_feature (826)..(826): n is a, c, g, or t
  misc_feature (887)..(887): n is a, c, g, or t
ttacctgagcttcagattacatggaattttggactgttgaatacttttgattgtgtagtggatataactaagcaattttttttttggggtgcanacntagaatgnaattacnggatcntatgaaaggcaaanagattnagtatgtantcagcancaaaaanaaaaaanagaagacagggtaatgaaaaaanaaaaaanaataaaaannctcaaaaaacaagagaatgaccaanancaaggggcngcatcnggtgaaaaccttcttgctgtgtccaaaatggtggaaagcatcacatggcaaggaaacatgcntgtaaacaganagaatgagancngaacttcatcttttnaacagcaacaccncaccagcaataattaacccaaacccaaaaaaaaggcctaaaagtaaaaaagagggcagagtccttataactcaatcacctcttgaaggtcccactcttaatgctgtcgcagtagcaattacatttcaacatgagtnttggaagggatatttaaaccatagcatacatgtttgctataaaaacgccagtcttccaagtgaatgtacccattttaaacacccaccagaatcatttgtgagatctaattgttcattcaatcttactatacttggtatagtcaattattttaattttagcaccataatgaatatgtagtgatattaaatttggtattactttgcattaatgactaaaaattagataacaaatgatattgaacttatttccacatgcttattgatcatttggatatattactttgtgaagttcctttttgaagccttttgcccantnttctttgtgtngtatttattttccatactcatcaaaaacatcccaaaatgctagaggaaatgctctagaatncaggaataacttcttttgtgg

SEQ ID NO: 638137 - DNA, 396 bp, Homo sapiens
tatgaataccagcgaccgatatctgatgtacaacttagggtccttgagatatagcaggatctgtatgtactggcataaacccattatttgagctctcttaattgcttttgggatttctttcttgtttcttccccacaaaggacctgtaattgtgcctttccataacatgcatccaggtaaatggagaaacaaacgtgggacaaaacgctgttaccattctttataatctaacatggctttcccacacaaagatacattttcttaaggaggttcctatataaaggattttcccattgaaaatggcgcaggtcctacatatgctgggataacctgtatgtgaacaaaccttcttctccaaaggcaccgcggtgattccccgcgctgggtgtattccgg

SEQ ID NO: 638138 - DNA, 266 bp, Homo sapiens
  misc_feature (7)..(7): n is a, c, g, or t
gcggacnttctctctcccactccaattacacaaaaaagctcatatagctatttttataaaccaaaagcaaataaagttcatatactgcatttgattataaggaaactttcatctcttttcatctagaatatgcctcttttttaaaaaatctatgacattcacttttagaaatgatcaactcaagttatttcatataaatgtcccatgtgaaagatttgtccaattgtttcctaatagcataatttaacttcttattttatcatttg

SEQ ID NO: 638139 - DNA, 839 bp, Homo sapiens
ggtccttgtcagtgaaaagtgtcaaacaatacagccatggatgaaccgactcacctgactccggacgtcagccgcgtatctgccagatgtgatttacatccgggatggggcagcatgaccaaatgcgatgtggagcagtcttacaacctgatggaatagttgtagagacgacgcgtccgtcacggtgcactctccatgtcacattagggtgtacacaatgcgcgagaagtcgccgggttctaccatgtagaaggagcttacctcgctctaggctggatagttgccataggctagtcaaccgggcctcggcctactgtctcccaggggaacgactcggagccgctcggagaaaccgctggatgggtcaggatacgcgaagcagtctcgcctacgaatgctagccttggcatcgtaacggtgtgcgcatcggtgcaacggcattgccttggatgcgatcgtgcggctccgatgcgcccgttggtgccgatcgagcggtgcgcctggaccttgtgctcctcgcggacgcgacggtacctaccatcgccgtgcccgagagcgtcgttgtgcgcgtctagtcggctggctgtgcgccacgaggactggtctcccagacgagtctgtcgatgagcgtgggttcccgttggacggtgggtgtttcatgagtcggtaacagagcgtccttcttgcacataccgaacctcatatggacaacaagaggcgagcgctaggaccaaagttcggagggccgttgcatgccatccgtccgtccctgaggttgtggcacctcgtgattgcaggggtgctggtcaccccctaggttgcgatccccgaaagggaga

SEQ ID NO: 638140 - DNA, 171 bp, Homo sapiens
aagtgacgccctcccagtgtgcaaatgagggctgcggtcgcgacgacacagttcgtggggtccccaggtgcttctatcctaataccatcgacgtccctccagaagaggagtgtgaatttaagacacttctgcagggatctgccagcatcctgacgcggtgcagtcccagga

SEQ ID NO: 638141 - DNA, 440 bp, Homo sapiens
tagaggatccccaatccatccagcgttacttttcctcagcaccttgggctagatagtctaacctgtgactaatccacggttggcttattctaagtcgttgctccacgctgcccactccaggtgctcagatgatgaggagccagggtcatgggggcagcctgtctctcttcccatgtgatgcacatccttacatcattggctggtttgttctgcaatatggatatctcagcctggatgccgagaaagctgctgggactgcttaagggtgcgagaggtctcacgtgtgtctgacaggcaagcagtgagttgttcccccatggcggaacgaaatcctgtgtgatgctctgtaatggaaacataaaatctggcagttttataacattcactttctgcctctgaggaaagatacagggaacaaaaatccatttgtacaggggtac

SEQ ID NO: 638142 - DNA, 365 bp, Homo sapiens
gagatatacggggtatactcaagatagatagagtcaactttgaattctcgaggccaagcaatgggcgaaacaaaagagctttgtgtttgcgtgctttggcttttggttacagtcagagcaggacaaagaataatgaaggagtagacatgttattacttgggcatttaataatcagtgcatggcagagccttgtgtatggcttgtctttttttttcctttccttttctttttaaaagacagggcctcactctgtcacccagatgggagtacagaggccccatctcagctaagtacaacctcagctcctggggtccaggtgatcctcttgcttcagcttcccaagtagctgggactccgggcacgcg

SEQ ID NO: 638143 - DNA, 596 bp, Homo sapiens
cgcgatggctcacgcctataatctcagcactttgggaggccgatgggggtggatcacgaggtcaggagtttgagaacagccggaccaacatggtgaaaccccatttctactaaaaatacaaaaattagccgggtgtggtggtgtgtgcctgtaatcccagctactcaagaggctcaggcaggagaatcgcttgaacctgggaggcagaggttgcagtgagcctagattgtgccactgagctccagcctgggcgacagagcgagactccgtctcaaaaaaaaaaaaaaaaaaaaaaaatttttgggcggcctgggcccacagagaaagtttttaaaaccatcctgtggggcgcgcggcgggcccccaatgatgttacatgtgagacattggcgcaactagctggttcccaaagaagaacccggggccagtagactagtgtggctgggggttcctccacccattaaaaaaacgccccggggggaaccgggacgctgtcttggaccaaactcacaagatgggaggtctcggagggcaaacgggactctaacaacacagggagcccaagagacgccgatatcaattatccgcgcgctgtg

SEQ ID NO: 638144 - DNA, 1025 bp, Homo sapiens
gtgtcaggctaatgactgggtcggcgaatcacatatataactgggtgccgaagcaaaggaaccacgaagcctaactttccagcgggggtgagcgatgtgctgtcgctctcatgggcctcttaccttatagtagaaaggcagactgctggggtacaatgggttgccatatcatggacaaggacattgtgacatacgttcgtatcattacccgtgtctgggcttgaggcaacatgggagaactgaactgtggtttccaggagacgacgatacgtactcagttaccggtgggcgaccactttgcatacatagcgagaatgccaagaaagccagtcaggagcaggccatgcagcgggcgacggtggagcagagggctgtcccagtggaatgagaggaccatcctgggtctgctccatggttatctggtgtttgggaggtgcctgaacccaatattggagtctagcagaacacaacctgtggcagtggcgcatgttgtgcaggtaccagtgagacccctcagcctccttggaataatagggcttcggtctatgactcctactgttggatgtgaggacaccatcccttgaccagacgtgggattttgaacgtctacagtattccgtgtgtgagcatacataccggggtttgttgctggcgtggggactttgagttacacagggcaataaacgtgttcttgtatgcttccgtgcaaggagggaatcgtgggttccagtccgttgagtcgattaatggaacttacaaaggtacctcggtggaactcggcaatacgagtcctgcggacgaggtgtggagggataaacatatttcatgagacgtagggaccaagaatcgaatatttggaaagcccgggaggggactttgcgagttccgagagacatttgcggtgggcgcagtctctgtatttgggatgcgcacgggtataccttaggagcggcttaccaatttcggcaaagagagaaatatttcccgaaaggctgtcgatgggcacacgtgcacactatatgcga

SEQ ID NO: 638145 - DNA, 493 bp, Homo sapiens
gccggacctccccgggtacttgcgctactagtagccttcatcaggcttagctgaatagcggatatataggctgagcaagaggtggtgaggttgatcgatggttcatcgagtaaccgaatcaggttcctctatagggatatgacaacaccgcaagtcctttgagctttaaactgtggctcgtattgttctgacgagcatgttttgttagcatttgactgtcgaggtttagggctaagcatactggggctatctatcccagtttgggttatatcttttgtgtgttcaaatatgttaaagccactctcgtagtcgatttcgtgtcagctgtatgtctccgacaactcaggtgagtttgagtctctcattggggagggggtgatctaaaacactctttacgccgggttctattgacttgggttgatcgtgttgacgcggtggctggcacgaaattgaccaaccctggggttagtatagcttagttaaactttcgttt

SEQ ID NO: 638146 - DNA, 303 bp, Homo sapiens
acacaacaagtcctaataaagataagattttaaaactcaatgcccaccaccccaccaatgcccccacccttgacacatgagctagatctcagcaccaatgccagcacacttaccttattctcacattttcggagtaacttcttctttcccaggtcatagacacgcaacagcttccccacaccaatcaacaccctcccctggaatggggcaatagcagcagggaccccttccacaggagtctatagaggaaaagcaggtaatacagctattataaatgccagccagacacaggccacacttctc

SEQ ID NO: 638147 - DNA, 143 bp, Homo sapiens
cttgcgagtctcatatcacgaacagcaacgcgaccaaaggtggatagtctgagaagctctcaacacacatgggctatgcaagtgaaccatatacaacaagtggctgcatcaccatgacttcaatgaatttacgggccatactt

SEQ ID NO: 638148 - DNA, 137 bp, Homo sapiens
tagacatatcaggaaactggttcactggctagagaatataatgtggatcttaagtccaagacgccacatgtcatagaacgagtgctctgctgtatatctagtatagtgactttggaaaagtctgaggcctcgatttc

SEQ ID NO: 638149 - DNA, 141 bp, Homo sapiens
tagctggcctgtgtgtcgagtaggagagagaaatggacagaaagattggacagtcaagggaaagatccagagaaagagagaaaaaagatgaaatgaacagaaaaggggaaaaaacccagacgactgaactgcccacattga

SEQ ID NO: 638150 - DNA, 356 bp, Homo sapiens
cattttcccccccccccccaacgggttcccaaaatattttttattggccccaaggatggacccctttaaaaggggggggtaaaaattgtttttttacccgggaaaaaaccaattgggccccccccccccagccttttaaaaccaaaggaaaattttggtttttttaaaagggggggggggtttatttttgaaatttccccggggcttaaaaatggttaaaaaaattttttaaattgggtccaattttttccccccccccccccctagaaaggttggccaaaaaacctggattttgggccccccaaaaaaccttttgggggggtttacctggtttaaaaaaaacctttttaggtgga

SEQ ID NO: 638151 - DNA, 481 bp, Homo sapiens
aggacccccctagaaggcgctgacagaaataagtgcgtataggccgtactttaactactagtatacctatagcttgctccttacccccttccctaggtgatttctcccacagtggtctgtatctcaacattctacttattcaaaggaaaaaatatatatatataatttcttttaattgatcaggtctagtaaatgtgtactaaaaaaatcagagtttatttataaacaaaatagtttatttaaagcagaaggtctctcccttattgatatacataggtatagcattaattccatttgttactattgtgcgcaaaagccctgttcacaggggaataggtgtaaacatttaaactagttttgtccactgtatattagtagacataactagttgaatagttactgaattttagatgtaaagaataatgtgaccatcttcaggtatagggatatactgaacgtttcaaatttcaatcaatgagca

SEQ ID NO: 638152 - DNA, 257 bp, Homo sapiens
gtcgacaataaagggcatccaaatcagtaaagaggaagtcaaactgtcactgtttgctgacgatatgatcgattacttcgaaaaccctaaagactccaccagaaagctcctaggactgataaatgaattcagcaaagtttctggatacaaaattaatgtacacaaatcagtagctcttgtttacaccaacagcaatcaagttgagagtccaaatcaagaagtgaaccccttttacaatagctggaaaaagtcgacgc

SEQ ID NO: 638153 - DNA, 240 bp, Homo sapiens
ggggccccggcccccttggggggggggggtttttttttaggggggggcccaaacccctttgggggggccctccctttgcccttttttgggggccccccctttttgctttttggtttgggccccgggggggggggaccccccctttttttttggggggggggccccccccccccctggggccctggggtttggcctccccccgtttgcccgggtaaacccttttttcgccggtttttaata

SEQ ID NO: 638154 - DNA, 393 bp, Homo sapiens
attcgcggccgcgtcgacctcgggtccaacacagacgtctatctcgcgcgtgtcaactggtttccagacagcagtacgctcgccgtacaacgggagtcgcgagatcaaaagacactggtattgctccgcgcggacgcgacatcagggtcagcgcgggagttgttgagtgagcatagcgacaaatggatcgacctcaacgataacctcgccttcgtgactcgagcccaccagctcatctgggcatcgagtcgcagcggcttccaacacctatacctttacgactgggacggtaacctcatccgcccgctgacccagggcgactggatggtcacgggcgacaatgactcgcacggcatccgcggtgtcgacgcgggcgcgaatttagtaatagta

SEQ ID NO: 638155 - DNA, 288 bp, Homo sapiens
tgagacgacgtttcactcttgttgcccacgctggagtgcaatggcacgatctcagctcactgccacctcctcctcccaggttcaagcgattatcccgcctcagcctctcgagtagctgggattacaggcacccaacaccaaacccagctaacttattgtattttcagtagagatgggatgtcaccatgttggccaggatggtcttggaacccccgacctcttaacgatccacctggaattggtttcccaaaatgttggggattacagggcacaagccactgggtctca

SEQ ID NO: 638156 - DNA, 184 bp, Homo sapiens
ttatgagacgcgggaaagagcattctccgcgcgtccctggggaagccatctcgatagactctcaagggccgtcagctccgccatggctgccgacacctgtggcttccgtggggacctggtgtgtgacgagaaggagggcgggaagggtcagtgcgaggcaacccgacctcgatacccgccgatg

SEQ ID NO: 638157 - DNA, 113 bp, Homo sapiens
cggttatggcgcaggacgctggccggcagtgccaacttcgcacgctggatatcgacgatctgctcggtgagggcctgtgactggggcctgcgtgcaggctatcgccacggcaa

SEQ ID NO: 638158 - DNA, 132 bp, Homo sapiens
  misc_feature (68)..(68): n is a, c, g, or t
ctggaaggaccataaatttaaatggagaaaggaccctcaagacaaatgacccccatcccatggggtanataagagcagtagcagcagcatctctgaacatttctctggatttgcaaccccatcatcctcagg

SEQ ID NO: 638159 - DNA, 142 bp, Homo sapiens
tggggggggggggggaaaaaaaatttggggggggaaaaaaaggggggggaaaaaaagggaaaccctaaaggggggggggccccccttttttaaaaggggccaaaaggggggggggaaacgggcccccggccaaaaataaaaa

SEQ ID NO: 638160 - DNA, 198 bp, Homo sapiens
acggtccccccggcttgctcaggtctggtgataggttcattttctactctttcatcagtgactagtaggctgggtaggtactttgtcttcttgtattatgagatgatttgaaacatgatgttcaaccgtctccctaaagtgagtagtacagacaataattgatgctgcctgctcttggctggcccattattcctttca

SEQ ID NO: 638161 - DNA, 945 bp, Homo sapiens
agcgggggggcggctgcatgcagtgcgctcagagtccacgtgatcctggcccgtgaccccgctgagactctgaggaccgcgacgagctcgtgtctgaatccgtgtcttatccaattggtgctgctccgctcctgaaccaggcgtctcacatccactgggccgcggctccgtgtcgcgtattgcgccttggcctgctgtttgcgtcagcgccctccgtggtctccgtggcagaccgttgcgtcggcctggattccagggcaggattgcgctgccgctgcagctaaccgaggctagtgcgcctcgggcctgacaatcccagcgtctcctaggcttgcagtatcgtcgcgtacttgtgaccgtgtaagacatagcctctctcctgcctagcattccggggacaaacccgtgcccaatcgaaagcatctctagctagccctggtcccgacagctcacgcacgcctttcccctcctcccgaaatggtcatctcatgtacaccccccgtccacgagcaaatgcgctagccaacacccctggacctccacaagcccctttcttgcataaggccccaggccccgtgctactgacgcgtgcgccctctcactgagccaacggggtactgagagcgggccttccctgtgacaacgcgactcactggagtcgatcgtactttgcgttcgccactgtgcatgtcccagaagcacgcaatgcagggtccctactgcgaattcgcttggagagtccccatcagccacataggcgggcaacgtgggcgagcgcgcttccagttgaaaactacagaggcgtgcccgggaggtggagggtaactgagcttcggccctaggcccaaactttggctcctaggaccctggcctcgccagcaaggctttcgttgggcaatccagggggggaactaagcgcgcagaagccctgtaccccatagcagt

SEQ ID NO: 638162 - DNA, 419 bp, Homo sapiens
  misc_feature (388)..(388): n is a, c, g, or t
cgggggccaggctatgactccagccatggcagcattatagaaaatctacccccaccctcctccaaaagcgaaatcctttccttcccagggctaccaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagatnacacagtcaaagggtggccagcctgctttaa

SEQ ID NO: 638163 - DNA, 328 bp, Homo sapiens
gctctagagaatcccttacctggaaggacatcctactatcctgccagagctttctggagcctgttaggagcccatccctgggccgttggcagcgcctgatgcgctttgactatagatttaccttttctggccatttcatataaacagaatcatacaatatgtcgtcttttgtgtgagactgcttgtaggagtgaattacactgtaaaagctggtaaagtagctggctatcggaaccaacagagaagtctttcgaaagaatgattcctcatgggaatactttcttctttagacatgatgtctatcagaggtagggtaccgcgctcgaat

SEQ ID NO: 638164 - DNA, 255 bp, Homo sapiens
atcccaggcttatccctcctgtgtgttttcgtctagcttcttcatggtccatgctgccagctgaggttgtcagtacaatgaaaccaacctggcgggctggccgcagattcttctgccatttttccaggtctattgagttgcacgtcaaatctaggggctgatcaccccacacttgtatagcctgcctagtgcggttcacatcaatatacccagctctagaggtcctcaatgatatcaaatatcgccaatgtaaac

SEQ ID NO: 638165 - DNA, 150 bp, Homo sapiens
ctcatttggaaattgcgggatggagggatattcgaaggttggatgcaatccgagaagccagaggaagggttttggtgatgctcccaggatggtgggctcagatgggatcttaggagggggtgtttcttaggtcgcttggttcaggaggtc

SEQ ID NO: 638166 - DNA, 585 bp, Homo sapiens
tgcagctggttttctctgaaacatccctgcttccctgcttgtcactggccctgggaacggcagagctgaccaggctcccttgccccatgggctgccgggaagctcagagccgaaagggttacaattagtgttcggcttatttccaaatctattttgtgtacttattcttccccttgtcttcctctttccttgaaggcctccttcaatcctttcgagaatgaagtagagcataaacaaaccaacagaccataataacaagaacagccatcaggccagagccccacattccccaggcacctggaagagtatgggtgaggcaaacatgggagtcccaggctcggcggccaggctcagcagaccagggtgtgagtgtcagctctgccactcagtgaaggtgacatggagcaggtcctctgatccctctgaacctctcatttgtcattcactagggacacactggggataataatgacatcaacctgcagggctcttgggaagatcccacaagatcagggtgggagcttagcccagagccaggtgtccagttaggactctgtgaatgtcagataatgcatcatcatgagg

SEQ ID NO: 638167 - DNA, 938 bp, Homo sapiens
aagcttgtgtaagcacacgctgttaacctagcgttgtattcataaatgctgccgtgatacgtaaaatagaacggttttgcgcaaaccacaaaggggtaagggtccaagatactattcctcccttgtcgtcctagtctgtgtaaccgggtacacacacccctgttgtagcgccggacacaagtggcgcggaagagccgttgaccctttgtggccaagcatttgggggtccccacagcctccgatggtgccaaccctccccactactgtcttaggtccagggggagtacccccttgtgtatgtgtggtacatggtgccggcagcaaagttagtgtgccaaagggtgtataaaaccaacccggttgcccctaatgcccgccacgtgttccacacgtaaagataacgttgagaggatggggtccaccccggggttgtccccccgggagtctaaaaacaaaggtcggaaaaaacaagccgaggactattgacgactgggtatatttgcgcaattatatgaccacgcagtttcaaagtgtattccaggtgataccactcgagcaccgatgcttctcttcgccatgttattagaccaccccggctgctggttgcacggagtattaactcgccttcagatctcagagttcaccaataacccccccgcgttctcaaagttggtgaagaacatcattctacttgtatagtcgtcctatagaattacaataattttagttatggcccaccatccacgtcggcccgcttatgaatcaccccaaaagtctcgtggagtcctacaaaattaatttttttcaaatttctatcgccttctatcggaaagaacatgccccaagtgtctcccccaagataatctttttttgttttaacttttactagtcaaacagtggtggattccaaacaaaaaggcccgtcgcccacaaagaca

SEQ ID NO: 638168 - DNA, 463 bp, Homo sapiens
tttttagaggaagccaccaaaccagactgatgcaatctcccgaaaaaagtgcattttattttcacctaacatatcacatgtaacactagttaccaaattctatcctgaaatcatagaaagaaaaagattctgtgaaacagcctcaggcaaaagtagtaatggtgccgtgttgaccccacccccaaaaaacaaaattccagcccgcatatttattagggatgtgaccttgaagaagttacactctgagtgtcagtttataaaatgaatgctataggacttaatttcactggattataagagtcgtatgaataaatgaaggtttggaagaccgccaagcatctggcaagcacacaataaatggtaactattattattggccttttgtattcttctcctccaaatccagcacaattccttgtacatacaagatattcattacatttttttaaaaaagtaaatatat

SEQ ID NO: 638169 - DNA, 753 bp, Homo sapiens
tggtaaatagagacaaggtctcgctatgtggtccagcaggtgaccctcaccactcatgcccccttgggctggggggcccatttacaaagttcctttgaagcaggtatcttgcatggcccaccgggggtgaatggcccgggccatggctacctctggaaagtcaaaggccgacggcttctatttcctctgggacaaaactgggacacttccctaaacacaaaactctttggacaatactggtggggtggcctaccgggagctgggtggaagaaatggacctcaagtcactcacctctccaagaggaggataaaaactggaacctgggggagccaggtgtgttgggttcacacctggttggtaatcccagcacttggggatgggtgagtgcaggagcatggtctcgagcccaggctggggcaacatagcgagacctgtctctatttacaaaaaaaaaaccaaaaaaacacggccaatcttagaggggggtaacaaccgggttcacacacggggggtccagatcataaacacaattaagggggcaggctcccctaaggggaacgtcggccaacacacgcaacacaacaaaaaaacaacctcgggagggtcaacaatggcgggggcgggacacacgggcaacatgggcatcggccacacttggtccaggaacaggttctgggcaccgggggaacaacgagcgcgccacaaaaggaggcaaactcagaacaccggaactgaatgagacagcgagaaga

SEQ ID NO: 638170 - DNA, 237 bp, Homo sapiens
  misc_feature (46)..(46): n is a, c, g, or t
agaggatccccttgctttgggacggcgggcaccgccacacgccggntatttttgtatattagtagagacgggttcacggtgttggcaagctggtctcaactctgattcaggtgatcacctgctcggctcccaagtgctggattacaggcgtgagcacttgtgcaggactgtttctttttcttaccgcgctctgctcccatttttgccttcccatttgtgcgccgtcccaaagcacag

SEQ ID NO: 638171 - DNA, 246 bp, Homo sapiens
tagaggattactacctaaatggctgtcttgctgtagtaaatacgttggtaaatctctgtttggggctctcagctctgaaggctgtgagacccctgatttcccacttcacacctctatatttgtgtgtgtgtctttaattcctctggcaccactaggttagggtctctctgaccaagctggtctcagcaacaggcatggatcaacatgcctagctactgtttttgttgtttaaggagatgtgatctt

SEQ ID NO: 638172 - DNA, 345 bp, Homo sapiens
acgactgcagctgtgctcactcctactctgcgctgagcgatggccccgtgtctagaatctctccagttcaacttctctggcagtaaaccttgctctctgttagcaagtttattgtcattggccaggtgcaatggctcatgcctgtaatcctagcactttggaaggcccagggaggcagatcacttgaggccaggagttcgagaccagcctggccaacatggtgaaaccctgcttctactaaaaatacaaaaattagctgggtgtggtggcacacacctgtgatcccagctactcggtaggctgaggcaggagaattgcttgaacccaggaggcacagattgcagt

SEQ ID NO: 638173 - DNA, 431 bp, Homo sapiens
atgaccagcagattacgggttggctgatctgtgcactgttaagtagatagggttaaactatgagccctacttataatattgctattggttgtaccgggaattgatttatgggctttgcgatggtactaggtactaatgaggttgttagcattggggacggagacgatgaagacaattgcggtattatagactaatgggaagcgcagtatttacgatagttgtagttactaccgtagcatgtaaggtaatataatcttatgcaaattagaccagcggttcgtagcatccaatagttgagttgatggagataatgttgatgttgattatgatgttaatgttgatgttgatagtgatgatgttgattatgatgttcatgttgttgaataagatgttaatgttgatgttgataatgatgttgatgtagatgttga

SEQ ID NO: 638174 - DNA, 436 bp, Homo sapiens
tgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgatttttcatacagggttattttttacgagtcttggtttctcaaaatcccccttttcatgttccttttccaccatttcttctggggttcccggggtggtcacttttgtttactccattcggggcgccaagggcactatatgcagaaagtgtgctctaagaagcactttctcacctccccaaagcgggcctttttcccaaagtgccccaagagagtgcccttaagcagttgtgaacttcctgaaagggaagggcaaagagcagaggaatttggctg

SEQ ID NO: 638175 - DNA, 886 bp, Homo sapiens
ggattgcaagatcatcgtaagagtcccaggttacgtgattaattcttttgtgcttgtaaccgattggttgatgggttagacatacatttcagcagcctatgatatgaccgggaaatagggttgcgagaaggcaaaggatgaaagatatatctacaaggatacatgaggttatcatggtggtggatggattaaataggatagaaggtacatagattgtacaatgaataattagttaggagaaaagagatgatggatagctggagatgactcttatttgcactgggaatactgagaaataagtgatgttccaggtccgttcagcattgaagtgtgttgtggtctctgctgtgactaagttggttgactcggattagtggatggaatgagaaagttggaaggcaagagagaagatttgagtgggttgaaacgaacccttgtggaaaacgattctgtgcatggcagacccatgggaggcaatttggagaacctaacatcgatgttgtctaataagaatatgcttggtctaagtaattatatggtcgtgaggcatctacaatctgtcttgggatgagtagtggttgattgaattgctttatgactctactatttacatggctatcgttcttgcaagctggcataactttatagaagggggtgagttaacttgtatggatgagcgaggaagtgtctgttgggcttacgtaatcggtaatagcatgaacgagggaattagggaattcatttttcgattccacggagggagtaaagtgacttaagaattatgattggcaggaaacattaaattcggttaagcggagtttaagtctggtattaggagaacggagtattgtgaagattgtacaatcgttataaaccttttaatagg

SEQ ID NO: 638176 - DNA, 697 bp, Homo sapiens
  misc_feature (227)..(227): n is a, c, g, or t
  misc_feature (287)..(288): n is a, c, g, or t
  misc_feature (292)..(292): n is a, c, g, or t
  misc_feature (294)..(295): n is a, c, g, or t
  misc_feature (300)..(300): n is a, c, g, or t
  misc_feature (306)..(306): n is a, c, g, or t
  misc_feature (341)..(341): n is a, c, g, or t
  misc_feature (353)..(353): n is a, c, g, or t
  misc_feature (379)..(379): n is a, c, g, or t
  misc_feature (381)..(381): n is a, c, g, or t
  misc_feature (406)..(406): n is a, c, g, or t
  misc_feature (410)..(410): n is a, c, g, or t
  misc_feature (418)..(418): n is a, c, g, or t
  misc_feature (429)..(429): n is a, c, g, or t
  misc_feature (473)..(473): n is a, c, g, or t
  misc_feature (475)..(475): n is a, c, g, or t
  misc_feature (516)..(516): n is a, c, g, or t
  misc_feature (521)..(522): n is a, c, g, or t
  misc_feature (533)..(534): n is a, c, g, or t
  misc_feature (551)..(551): n is a, c, g, or t
  misc_feature (562)..(562): n is a, c, g, or t
  misc_feature (570)..(570): n is a, c, g, or t
  misc_feature (572)..(572): n is a, c, g, or t
  misc_feature (582)..(582): n is a, c, g, or t
  misc_feature (590)..(590): n is a, c, g, or t
  misc_feature (592)..(592): n is a, c, g, or t
  misc_feature (594)..(594): n is a, c, g, or t
  misc_feature (597)..(597): n is a, c, g, or t
  misc_feature (601)..(602): n is a, c, g, or t
  misc_feature (605)..(605): n is a, c, g, or t
  misc_feature (620)..(620): n is a, c, g, or t
  misc_feature (628)..(628): n is a, c, g, or t
  misc_feature (632)..(632): n is a, c, g, or t
  misc_feature (635)..(635): n is a, c, g, or t
  misc_feature (688)..(688): n is a, c, g, or t
cgagttggaggcggttggtggcagcagtaggagtgtgtagagtgctgggattgggggccaggccctgcggagggcgggggaagttgtcttcttttttttccggaggggcctggtaaacctggtggctgtttggcaagatgatttttctccgcgggttattgggtggtcattttgcctgaccccagtactcagaagctgagtctatttaatagtgggggttctttggntctgcagtttcgtgatgttattagctaagaaagtcgttgcgttctctcaaagcaggagcnntgtnanntcgcngtttantgggttttcaatcgtttgaattttttttgcattgnttataaacagancgtggcagaggcgtaaattatatgtnangctttgtacacactatagaagagtnagtnctaaggangatatattaangaagtatattttaattcctctagatagtgttaatatttggtttncnaattttcattaattttctttaagcatcaggataatgtctcntggcnntggagctggtnnggagtatgtttattgcnatggctgtggntcgggatntntttggcggtnttgctcgngnanaanaacnngtncctcaggggcacaanaggagggnagtnagnctgagtgttggggctatatggagggactgacgagctgatgccagggaagtganatggaagga

SEQ ID NO: 638177 - DNA, 262 bp, Homo sapiens
attcgcggccgcgtcgactttttttttgtggggatgaggtttcactatgtttctcagacttgtctcaaattcctgggctcaagtgatccttccgccttggcctcccaaggtgctggaattacaggcattaatcaccacgcttgccctcaagtaattttaaattcgggtacatggaagtagctagagattgcataatcagcccccgctgggactggtaaatgcctggttgcggatgccctatgtttcttcttttctacctaca

SEQ ID NO: 638178 - DNA, 614 bp, Homo sapiens
tggcaaggctctcacctcggtcagctccagctccagtgtggacacgctccgccttctttctggccgggcactcctcctccagctggttcagcttctcctccaggatcgcctgcggttccgtgcgggcgtacacttcaatagccgctcgaaggtcttttcttgcctggcgggagctgggccagcctatacggcagggcctctttcctctacagcagctcctcctctggggtctggagccgctgggcatcggcttctacccgattctggccatattggtacggggcagcatccgaacccgtcctttccacaagagccgcgggatccgcttgctagggcggacggctcagagtcttccctttggccggtgaccccataagaggcgagggggggcatattaaccatggagcgagccgttgatgcacggggacatcgtcataatgactggtgccgccggggggggtgggcatagcggtgggaggtgcccctaagatatgggtaagcagatataacaggcttgtacatgaaacagatggttggtttggctggctgaatgagatttgcagacttctccacatcaatgtagtcatagtgcagagtctccgggtctgtgacca

SEQ ID NO: 638179 - DNA, 100 bp, Homo sapiens
ggcttatcctcagtgtggaaggaactattgactcagactcgttgggcctgaaggaggagacagtctaccaggaggggcgttacaaactctggcttgtacc

SEQ ID NO: 638180 - DNA, 500 bp, Homo sapiens
  misc_feature (382)..(383): n is a, c, g, or t
taaattatgtgactactgcaagaccatgtaagtggcttggcactgttagatggggtgctttattacaacctaatgaattaagtgtactaaatttttaatcattaatttctagtatcaaaatggtgagtataaggtgtgaagttttatttaatgacttaattttgagtcttagttccaggaaagacttctaaattagaattcaccctaggataattacaactgtatttgcaaattggaagcattacagaattcattaaaaacattttatttataagacacccctgctgcttatggtaataacttttttacatgattaagtgtccatatgagacagcctttaaaaattatgtatatccatgcaatttataagctttaattaaannatcaataatgaatgtagacatttgcttgcttcccctttaccttctgccatgattgtaagtttcctgaggccttttcagccatgctgaattgtgcatcaattaaacctctttccagtt

SEQ ID NO: 638181 - DNA, 82 bp, Homo sapiens
cccttttgggggggggggggtttttttggggggttttttccccggggttttttaaagggggaaaagggttttccccccctca

SEQ ID NO: 638182 - DNA, 96 bp, Homo sapiens
cccgaggacaccgctgtgtattactgtacaagagcccgcattgtgagtggttacgattatcaggacctaggctactttgacaactggggccaggga

SEQ ID NO: 638183 - DNA, 409 bp, Homo sapiens
  misc_feature (24)..(24): n is a, c, g, or t
ggcccccttaagggttttttgggntacattgggcacagggtgttttcttttattttaaaagagcaccccccttcctccccttttgggggggggggggggtttgcccccaacaccccttttttcaggttttttttttggtttacacaaaattttggtcccacccccggggggggggcctttttggcccccatggctttcaagggttttaccccttggccccccggccccgggaaggggaaaaggggaagggaggacccttttttttgggggggtcccccccccctttgttccccccccccattttttttcccctttttccggttgccttgtggccccctttaagggggggggggcttggggggccccccctttttttttcccctttttaagggcccctgggttcccccca

SEQ ID NO: 638184 - DNA, 125 bp, Homo sapiens
cctaagttcaccttctaacaatgaggatccctcactcagctcctgtgagtctagctcaatatttactagggggcattcttttaaaaacaagggggggaaaatttttgtgggattttaagttccca

SEQ ID NO: 638185 - DNA, 999 bp, Homo sapiens
  misc_feature (455)..(455): n is a, c, g, or t
  misc_feature (457)..(457): n is a, c, g, or t
  misc_feature (538)..(538): n is a, c, g, or t
  misc_feature (591)..(591): n is a, c, g, or t
  misc_feature (616)..(616): n is a, c, g, or t
  misc_feature (672)..(672): n is a, c, g, or t
  misc_feature (690)..(690): n is a, c, g, or t
  misc_feature (748)..(748): n is a, c, g, or t
  misc_feature (955)..(955): n is a, c, g, or t
  misc_feature (959)..(959): n is a, c, g, or t
taaggccgcgcaggactgcccgaatcggaagttgcgatctgtccgaagatgagctgactaggagcacgacatgtgggaatctaggatgctcagaagcgaagaacggtacgctgcctgcattcagcgtgcgttgttcccaatcattagtatactcgacgacactgcagacgaatcgtgagactaagtgctggcggtgactgtatgcgagacgcttgaggagcatcacgattgatcgtgcacatactcatgacgacgagctaactacgctgactgactgacgctgaatttatgcaagctctcgctgactagtgacttaggtagctatcatacatgctgtggcatgctgactaactcagacgtgacttagtctacgatcagactgtatgtacgattctagctaccatgcaatacgctattcaagtacgctcactactgaacattcatcagtttcattngnagcggcacgaaccacaccaacacccacgacgagggcgcgcgctgggagtggtgttggtgtgtgatatgagatgtgtggcgntccgccactatactacagcccgccctgggtgagggcggcaggtgaagtgcgcntccatgtgtatattgttgcccgctntgattaggtgatgttgtccggctccctcgttcgtgtgcatctgcctactgacgacngcactcctatctttcacntatttatattttaatttatataaataacaacaccgccatgaccttatatattatgtcngtggttgttggtgggtgtggtgcggaaacgtaatctctcttcttttcctctcttctgactcaccccccgcgcggcggtgctgtgtgtggtggggggtgggttggtggtgatcaggcaccacccctcactgattgttgttagttttatcatcatacacctgcaccgcgagggtcggtgggtggtcgacacgacagacacaccgaccgnctgnattattatatttatcttctcctctctcgagcgggggcagc

SEQ ID NO: 638186 - DNA, 306 bp, Homo sapiens
cgcggacgtacttgccacttggtgaaaccttctatgtgcttttaagactcagcttgagctccttcaggacttctttagcaccttatgtttcctctgttatagtactgaacacattggattatataactgtatagtcttatgtttatagggctgcacccctagcataaggaagttgccaggctagggtttgaatcggagctacagttgccggcttacaccacagtcacagcaacactagatccaagccacaatctgtgacctatgtcacaactcacggacacaccagatcagacctctaccagaccg

SEQ ID NO: 638187 - DNA, 224 bp, Homo sapiens
gcctggttatgacattccacattcagtgctgtgggttcattaaacaccggtgaacctggtgcctacattatggatggactgaggtctggaattcaacctttctcttgtacagttctgtggcatttgccaaatgcataatgctgtacagccacaaatgatagtatcgtccagagtagttctcctgccttaaaatctcttttgctgcacctgtttctctctcccca

SEQ ID NO: 638188 - DNA, 1824 bp, Homo sapiens
  misc_feature (1647)..(1647): n is a, c, g, or t
tgctggctagcgtgcttgtgttttctttctacgtcatgtgaggatatgtcttctagagtagatctacgttatgcggtgtgtgtcctcactactgttgttgccactcggtggtggatgactcacctcattcgctcttctctcctacttctttgggttgaatgattttgttgtcgttgctcattctgttgctttcatgctggcggtcctcgtctattatttagttgtgtctcatccactttttgtgggcgtcgctacccaaccaccccactcctcgggtgggtgttttgaccaccactccccgctgtggtttgccccaccaccccatctgggtgggggggtgtcaacaccacgacccgcgcggtccgcgtgtgtttgtaccctgtcgggcaccacgttcacttatcttttggtgttggtctcttctcctcctgcccatgcatctggtggtgcgccagttagattaacacatgtgggggcgcccctgttgtccagaaacgcggttgtccaccctagtttggtgttgtgaagtatccgtcttgtggtttggttgtcccgcgccctttttgcatgacgcatcctcctcgctgtggtgagttaccctccccccgcactgtttgttgtggttcggttgttttcgacacagcacgttgtttctcgggggatgtttttctctctcccccccagcgaggggtgttttttgtggtgttcctccctgagtgaacacacgatgaagtgggggtctggcccccctgcggtgtacatccccccctcctctctctctcggtctccgcatgttacacttctcccatcccccggcgggggtgcgccttgtttgtttttctctcccgctgggtgtgtccgagagtggtgtccccctcctgatgatgagagagagtgtgttgtcagatggtgagagacaccacaggcattggtgttcttttatatcatctgctgtcgccagctcagacacacatcgtgacttcacgcactgtctactttcttttgtgttgtggtgaagagagagtgagatgtgtccctctccccctcacactgctgtgttctcagcagaagacacccaccctctcttctgtgtgagtgagacactctgctcacacactctctctgctgtgtggtctctctcacaacagagtgttgttgacactcctgtctccacgctctctctgctgtgcgccactactgtgtgctcgcaccactcgctctctctcgcagagagatgtctctgctctcagcaggcgcgctctactctctgctggacgacacactgctgtgtctctctggcacactagtgtgtctctctcccccggagagagcgctcctctctctctctcacactctgtggagacacacaccgcggcgcaggggccatctcggagcagcagcaagagaggagagagttatctccgcgcgaggtgctagagagagaccacacacactcggtggcacactctctctctctctctctctagagagatattctcacccctgctctccccgcagagaaacccacccccagcacagagagagagagagagagagagagagtattctcgcgggagagggaggcccacagagagagggggccctaagaggccgaggacaccaccctctccaccctccgcggtgttnttccgagtgtcccctctagacacctggctgttttttcccccggccccctcttctctcttccccccgggaatttgggtttgccccctcttttttttttttttgtttttttttttgggggggtgtttaaacacagcccgggcaaaaattagcgccccccaaaaaaaaatttttttttga

SEQ ID NO: 638189 - DNA, 1160 bp, Homo sapiens
  misc_feature (1156)..(1156): n is a, c, g, or t
gctctggggcggtcgcgttggcagcgagatgcggagaagccggactctgggccgtcatgtactacaagttaagtggcttcactgcagaaagttgggcaggagcatggggcttcggaggccctataggccccgcagtgcataaaagccgtggtggttatccaaaagaatgcaaccacctaatccatattgggccaccaaccagacttaaaattggacctccggatctccaccaggggtactgaacataatgcgtggggacaaaaaccaatgttcccagaagcttaacaaaaaagttttttccagaacacgctcgatggttgttgcccggtttatacctgaaacgggaggcctgccggacccaaattggattaaaaccgggacaaacaatggtgagctgaatggtggcaaggaacccattctaatggccctggatcggcaccttctaaatggtctctcggaagcccaacaaaccacattgaagtacggctgcagaagtgcaccttggatatggcgacattgtgggcaatcacccactcttttggaaagcttcccttatcgcaaacattggtcaaaattacagagcctttgaggcatataacgttggcactgcgcttaacccattccttgggcaagaaaataattacggccaccattctggcaccatatgcatgttacgtgggatagtgacatagtgaaattggatataagggttggttaggagaataaattagaaaaggtgaaaggaccattggggaacaggaaatgggtggctttggcgggtgttttggtgactcaaggaatatcactgaaggttgcgtgaattaaggttgtacacaggtcggtaaacggcagaccggtacggacgacccaagggacaggagagggacacgagaaacaaggggagcagaacgccttgggacaggccacgtgccacgtcaccgaacaggagacgaggcatggcgtttaagatgagattggtgatacgacggagatgatacattggggaaaggggtatatggaggcgagatgtgagagaagagagggagtacgctatatagtgacagttgtataggggaaaaaatttggaatagatgtcgtggaagaacattattgaaaagtgggtgaaaaaagcgtgtgttgatggttgtgatattgnagag

SEQ ID NO: 638190 - DNA, 151 bp, Homo sapiens
  misc_feature (118)..(118): n is a, c, g, or t
aacagtgcactgaagcaaggcaaagtgttgaaatctcttaaagaaacaaaacagaattgaaggatttggatgaagatgccaatggaataacagatgaggggaaagaaattaatgaaanaagttctcgcgtcgtagagagatctcttctcgt

SEQ ID NO: 638191 - DNA, 189 bp, Homo sapiens
gatggacgaagtagtggccggacacgtaataggagtcctgagatgtagcagaaatcgggggtatgctgttcgaattcataagaacagaggaggttagaagtagggtcttggtgacaaaacatgttgtgtagagttcaggggagagtacgtacgtgtccggccacaacggtccggctacgtgtccggcca

SEQ ID NO: 638192 - DNA, 843 bp, Homo sapiens
  misc_feature (72)..(72): n is a, c, g, or t
  misc_feature (76)..(76): n is a, c, g, or t
  misc_feature (84)..(84): n is a, c, g, or t
  misc_feature (97)..(97): n is a, c, g, or t
  misc_feature (105)..(105): n is a, c, g, or t
  misc_feature (133)..(133): n is a, c, g, or t
  misc_feature (138)..(138): n is a, c, g, or t
  misc_feature (196)..(197): n is a, c, g, or t
  misc_feature (204)..(205): n is a, c, g, or t
  misc_feature (226)..(226): n is a, c, g, or t
  misc_feature (239)..(239): n is a, c, g, or t
gtatttaactacatctgcctcggctcacaaattccgattagacctttatccagctagtgccaaataatgatnagangctgaatnagaataagaattnaggtctanattctggtgttaatttagagcgttggtnaaagnatgtccttcagctgactccagtataatctcctctgctcattaaactgattccaggagnntggattnnctgtgactagatacagatggngcaaatgtcctancagagaaatagaggtgatgctgctaacaggcgagaaactgccaggcgcacaaagttcagtgtcgggaatttctcccccgtgaccattcactggggccatgcaaggattcgcaacggacagttccccacttcggctcctccgctctttctctcccctctcctttctctattcagcctagaatctctgccgggcccgactggctcggcgctcctcactgtgtctgtgctcgcttcccactgctctgaacagcgctactccctgccggcacaagtccctgcctctccatactctagccattctatttctctggcaacactccacctccaccccccaaaagcaacactgcgtactcgacgtctcaaccgcatcccagcatccccagccctcagctgctccactcatcccaaggacacccaccagccccatcgccactaacccccccaacccacacccaccctccgcaccgtagcgcctcaccccacggccccacactcacggcacgccgcgccccaccggcaggcccgcaccacccccactgcgcaccacgcccctcgccgacacccccgccctcacgcacacaggcggcaccccacacccaaccccg

SEQ ID NO: 638193 - DNA, 1497 bp, Homo sapiens
  misc_feature (1140)..(1140): n is a, c, g, or t
aagccaagagaatagtacagggaccagactcgtcttcagggccatatttgccttgctccaaacctccaacggcctaaaagctcagatacaatgcgtaatatacatccacatactcatgtagaaatagcatactgattcagcttctcgccatccttaatggactttcacacggttgactataacgcacgcttagcacagtgcatgatggctcggcaaactagcgtgacggatataagctagatcttacgcacagaaacattagccacacgtaggtgctcgtcgggtctacgcatcgtggtcttaacaacgtctctagcaaccgcagtcgtcaatgataagcaaaggcaaataactccggctgagtccgcacactagcaaattgctattgtggtaacttacatgtaaatgacaaaatccaagaagggaagctatctaaacacataagcagatcccttaagcacagagataggagatcacgagataggaagaggcactaatagaacaccaaccaagtgcgagtaggaatactgtgcatcgcataagacattgtataggcaccaagccattgggacaaccacttagatcggcaaaccaggtggcaagttgaaccttcactaatttggcaacatcagaggatctagcaatcttgctcgaacgggtactgtttatagagtcggaatcacgtagacttgaagtatcagttaccagccaagctttattgcattagaggaataatgctacggcactatcttgaataaagaaatctcatgcattgcaagcaggaatcaccagggcttaggtgagcacaatagagaagttcatgacaccggtgagaaagcgcgagaagattacgatacaagccacacaaggataggatagcattcagaccaagccagacaagtcattattgcatgtcgcgcagaaggatagatttcgctcgtctgggccttccacttgagcggacatttgagagcgcgttcaactatcacactattagagtcaaaggttggtcccacgacatgaacgcgatgatacacattcgacatgtctatgggaattaaagtagtaatacgacagacgagaagtgaaaggttactaatcgtaaccaacaactagaggacgaagcgaatagaactaggntagtagagacgctcgacatcactaatagacaacggaaggaagggaacgaggaacatgaacagaagacgtgcgggatttaggaggacgcagagtaggagaggacaagacacaatgacgaggatgagagagcagacaatagagagtgtacactacagacagagagacacatatataggaggagatagaaggagagacgaaaaacagtagaggagagaacgagatagacagagcgtacataagagatatgaacaaaaaatagaataaaaacagagcacagaaagagtaagaaaaggaggagaagacacatacgaaaaagaagagagaggaagcagagaaaacacagaaagaagtaagaaa

SEQ ID NO: 638194 - DNA, 343 bp, Homo sapiens
ttttttgtggatggagggaggtgaggaagagtttcactcattgcccaggctggagtggagaggaggaagtggggagagagggtaaaagtaagggaggggtgaagtaaagctgcgggcgcaggcgcaggaggagcaggcaggagaggtgacgccaccatgcgcagcgaagttttgtattgttagtaaagacagggttccactatgtcggtcaggctgatctcgaacttctgacctcaggtgatccaaccgcctcggcctcccaaagtgctgggattacaggtgtgagccaccatgcccagccagcaaacagttttaatttcactgtagtcttggtcctctttga

SEQ ID NO: 638195 - DNA, 324 bp, Homo sapiens
  misc_feature (70)..(70): n is a, c, g, or t
tccctttctctttttccggagtctcgctctgttgcccaggctggacctgactggtgtgatctcagctcantgcaagctcttgttcccaggttcacgccattctcctgcctaagcctcccaagtagctgagactacaggcgccgcaccacgcccagctaatttttttgtatttttagtagagacggggtttcaccatgtctagcaggatggtctccatctcctgaccttgtgatctgcccaccttggcctcccaaaatgctgggattacaggtgtgagtcttgcgcccggcctacttgagtcattctaaagccagtaatagttca

SEQ ID NO: 638196 - DNA, 101 bp, Homo sapiens
tgcaccacagctcctgagtcagtatggattacgggcatgcgcaccaaccctgctaatatctgtgttactagtagagacagggttcctccatgtaggtcagg

SEQ ID NO: 638197 - DNA, 1095 bp, Homo sapiens
gccagagcgagaggaacaggaacagcaggcagaggtttcaaacgccaacccccacccctggaaggcaccagccaggatgtgaccacagtgacactcctgctgcgagaccccacctgggagacacatccagctcagctgcctcactccagctaggttcgaccccacccctgccgtcatcctgagcctccaagttggagcctgccgaggcccagtgtccttacagtctgaggttccaggcaggcccagagccaccgcgccctagtactcgaccctaagaccgaccaggccctgatgcctttcagggagtttctaccaacggctacacgcgcaagtcgaatctgacgtggcacaacggtagaggtccaacaatgtcttcttgatcgtagggcgcccaatagcagacacaccggcttgcccgagagtctcgccagccagagggccctactgagcagcaacgaaagcatacgtaggctaggcacacctcgacgcgctagcgcaagagagcttccacttgtctcggtggcgtcaacttccaccctgcacgaaaccatgcccccaggaaacccgcaaggagttcgcattccccattctttggcccatcgggcaactaacaattctatctcctagcgggccttggcatctggagtggctggtcgcacttcgaagttttcaagctaaatgtttccgaaccaattcggtgaattctccgtgcacatgtagtgcgccttgcctttggtggcatccccaacgtgcactaggtccaccaactctcctcaagtgggcttgcctcctcgtaagaggctacgcacgcgttgaaccacttccagggagaagggatcttacacctagggggcgttccgcagcgcagcctgtacaaatctggagagatggctaccacttcttaagcccatcgcagtctcttctacccgggggggctttcacattcacttccaggctcgcggtcggactgcaataactagagggttatacgtcttcgtcccatgggagcggtccaatctttatggggaaggggtacttctaacggtttaacaatgacggtccattatgccccttgcgttggagacccccaaagag

SEQ ID NO: 638198 - DNA, 86 bp, Homo sapiens
ctgagtttggggggccccttttttgtgacttttcaaaacagtgaattactgtccccttgatggccaagtttcaataaaactttgta

SEQ ID NO: 638199 - DNA, 851 bp, Homo sapiens
ccccgcgaatttgggggcgctgatttattccccaccaggtattggtccgccagacaagttttccgccccagggggttccgcccccataataattggggttatctcgctgggccctcccccccaatagtccgacaaatcctaagtgtgccgctggcaagacactttatgtgtacctatggctggtccacgcccgcggccaaaagagactaaatctttgggcggcccacgcctctatgaccaaggatgcgcatactcttctggcggagcccttctcaccagaggaacatcgatggtggaccctcctcctgtgcacacagaggaaagtatcattaatcacccgacgcgccgactaactccacctagctcggccgtttcttctcagcaattccgccccccactatgaggaacaaatagacatatatttaagtactgtgggaaaaacatttctccccacccaccctctagcgggaaaaaaagaagagtccttcttctgctcactctcgactaactaaattaacaagaatcctagacttactagaaacagcacccactccgcgccatttcaccatgtcctccaaaatattatttcacccctatggaaccaaccacatgtcgccgccacagttgttgtggcaagccgtgatgccacagcgggggcgtaatatgcggtgagtcccagacccattctacgggctctagcccgtctttctccccaaaaatattctgtccccctcgtagatcgtcttggtaagtgagggcaagagtgagagataggacggttcttcaggtagtccgccggccttatcatattctctctaggcaaattagatatacacacaacccacatgcac

SEQ ID NO: 638200 - DNA, 1042 bp, Homo sapiens
ggggtggtgcacagagctgtcgtgcgaggtacgggcgcgtgtccgaatggtttctgtaggtctccatcatctcggagacatctgtcccgcgagtggtgacgaattcatagtgttgactctagcaatcacgcggctatcgcgccagagttgagctctgaggctacgagttgatggaaaggaccgggatgccattgaacagtgcagtgtcgaggtgacagcgagcctggagtgctgtcattggctatccggcgacaagatgcctcgagtgagaacctagtgtcacggacccatgcctggcccgaattgcaggacagtctgttcaacagcattgcggtgagggcctcgagcggagtgcgcacgcggcagcacagtatgtgatggcactcaagacaaggggcacttcgcatggatgaatatgccgttccgggtttgcatagtcaacggatcatggacacgtgctgacgcatggagtgcaggaatgccaggagaatgactccgaggacctagaccctctaatgatggctggcacgtggtggcaagaacatgcacgtcactgatccccatggatggcgaccatggatgagctaagggggatgagctcgctttgggtgggctcgatcgcgtggatcgcctggataggttgcttggagattcctgacagccagtagttcctcgggagccacgtcatacgagggttgcgacgagagacctggcacgccttggcccagtagacagcacgggcatgggacgtaggatcgaaggcgagctagcgtgcgagggggaacgcccagggacgggggcggtgcgaaacacccattatctcctccttcccggatgggaataacgcttggccctccgtcgcggagacgttggcagtgcatggcggctgaagcagattgggcggtagcccttggccggggaacgagccgagacatgcggttggatatggaaggttccctggttctggattcctttcgtagaccggattaacccgagaggccattgattacggctccgtggcagccaaactgcggtggaaggc

SEQ ID NO: 638201 - DNA, 147 bp, Homo sapiens
caatgtttcatgtgtagaaattgaattcaagggctgcgcgcggtggctcatgcctgtaatcccagcactttgtttattagcctatctcgccccttaggaattctttttctttacctcactccttagaaattctttttaaacattcag

SEQ ID NO: 638202 - DNA, 1578 bp, Homo sapiens
  misc_feature (289)..(289): n is a, c, g, or t
  misc_feature (316)..(316): n is a, c, g, or t
  misc_feature (672)..(672): n is a, c, g, or t
ggaagcagtccgcgacggagagtgcgaagagacgctaccggcaggtcaacttcatggatctgggtacccctagcggtccgggaaattggtgtacacacttcttcctgtggtgatgcgaagtccgtccaactgagccccacagtgtgctttctgatcctagagcaggacagtgaaggagtgcataaaccgcgagactgaccacacacgattccaactgtccgagcctgcagacccaatgttctgctctctaagacacttgcttcagtctgcgaggggtgcgagctatgtntcgctgagagttcccgaggtgttctcntccacgttccctaccttcgcgttgtcagttatagctccgccgcgtgttcgcggaggaggacgcatgccgcgaaagagctggcctgcccctagtatttggccacactctttcgatcgcccaagcaccccgccgttgaaaaggtaatcctcacaaagagtttgcgcgtcggtagggagaacactccacgatacgagggagggggaaggattgccaacttcaccttcgatagtatctagcgccttaacagcttgtcaattgccttaatcgtaccgagggattttagatccggggactttgacccattgggtcaatcgcattgaacggtcacaaacggtacattgtgggttgcgaaagcncgaaccaaagggaaccggaaagggcaaatttctgtggaccacgcgctctctaaaaggtacccatcggtccgtcagcggaatagtgttcgccaaagaattgcgcactccataagacgtgtgcgccttgcaacaatagagggtcgccttacgggagtttggttcggggagggtgaaggcgctttttcgtcacaaagtcgggcacgccatactcgcggggcgttccgggacaagccgcgcatagacccgcttgtgatgtgtggtgcatgcgcattatgggccacctatgacattgtggttagattcagcgcttactttctctcttgaaggtaaatttttccagggcattgagaagcagaggagagttccaagtttctagttccggaaagcggcgggaaccgcgaggttagttgcggtttacccatttcttatggctttggtgcccctaggtgaagagagcaaaacggcgtgctggaagcgtgtagacgacttggaggggcgcaacggtcggtgtagtcggtcccgggcaaatgccgtaatgcttatcgcaattggtcttgtgtggagcgcgtttttaggacgtgaatctcatgttgggaggaaatccctgggcgggacgatttccccctccatattgagtgttcgcagccagaggggaagggaacctccccagaattcagcgcgttatatgcctttgtcgattggagccctcgttaggccatcggataaacgggcagtaggggaaagcaagattatcttttcccggggggcacgaaggtgaaaccgtggaggcgggcagggtaagaaagtgttcccggggcactcgcgtagcggtgacatcacgttggcacggttccttcgtggaggacccgttgtggtgggagtatatgaaaacccccacatttctgg

SEQ ID NO: 638203 - DNA, 932 bp, Homo sapiens
  misc_feature (823)..(823): n is a, c, g, or t
cgaagaaaggggctccgcgattacagtgaggatggctgttgtatcctctgtctgattgtatggcagaggatttgtgtgcgcgctgtgcgagcgtccaactttggcggtgcttcggttactgggcggtgcatccgaggagtggctagacgtatcggcatagtaacgcgcgctagcgaagcgatccagactgtcagtactacaacgaattctgctgctattgggctcaggttctgggtctcgcgagtcagtgatcgtgtggtcagcctctgtgaggggtagatatggcgaactgtatactgggacgtgattacagcgggtggaaagtaggtgtccactgctgcttgtgaccgagtgcggtaaacctctccagtcataaggtggtgcgtcgctgactcgctattcacaggtgctagaagtacgactagtgtacacgactggggcacgttttgccttaccgataagcttggcgcgggatgacttgatatccggctacttggctgggagagccaagcgtaggaaagtaggttggcattttaggataggagtgacagcgtagttataaggagaccatattcttggtaagttgaaccgtggtcaccgtgggcacgttgtaaaatgggacctctacagtgatgtttggagaacaatgtgtgactggtgcggctctcagaaacgaagtacgtatctcgaaatgacgtgttcactagactgatctgttaccaggtggtgaatactcccagttgtcggtacggactcgtcttccctgttgaggtgttcaaggatggttgacaatggtcatggttgccagatctaaagtcccaanagcacacttagcatgggagtttgccatggaaggtcattctgcctttgggcccgtgggggggctagtgccaatgttaaaaaccacaaccagggtccccgcagttggattc

SEQ ID NO: 638204 - DNA, 148 bp, Homo sapiens
  misc_feature (107)..(107): n is a, c, g, or t
gtggaccaagggcttcagtaaccacccgagggtgcacctgacgaagaggttctacgagtgtggtcactgtgggaaaggcttcaggcagctggggttcttcatgaggnatcagaggattcacagccacggggaggtgtagtggtgcccg

SEQ ID NO: 638205 - DNA, 352 bp, Homo sapiens
taccgtactgcgctggatatggtggccacaacccggcatgctgggttcactgctgcgtgactttgttcttggttttcttatccataggatggggctgtgaacactgcctctacctggggcagcaggtgagccattctgaggccattcctagagtgggggctttgggatgatcgtgcactctctgtggaaggaggtgcaagggcactggaggaggtggggctggttttcattctgaccctgccatttcccagctgtggtccctgtgtgtgtcacttgacccctccagcaccaagaaatggatgaaaagtagcgtctcctttgtgggttgttgtgggttcaagtgtcagcctag

SEQ ID NO: 638206 - DNA, 417 bp, Homo sapiens
ttatgcagaaggaatccttgaatgccgcacatatcgatcttgaatacacgtgtcctatacttcccttcggtactctaaggagcttatgtgtttgtatgtctgtaacgctgcagtcttgaagaagcaagtaaacaatccgctcttcgcagtagggtgaagtgacttagtcttggctccataagcatgcactcagtgtaatatcaccttcataatactaattcaaaaaaggttaactcctaataactttgtcatacaaccgcaagagataacttcagtgacagtcccaaagcatgtgttcagcaacgtggtgtccatgctgtcgcagcagggcgctcctttcaactaaggagctccgggtgtctgtgtagaaccatcctcaccctagaaaggggcaaactccatcgcgcggcccccgcg

SEQ ID NO: 638207 - DNA, 423 bp, Homo sapiens
  misc_feature (218)..(218): n is a, c, g, or t
accatagaaattcaggcttctattctctggcccacagcctgtagctgtttctagtctcacaagctcccatccttttagacctttttaggtgtgactttcgatttgaggggtgattattttgctaataataatgaaacataattgtcgtaacagtaacattaatactcattagtctccattgagtacttggttggagaaagcactttagaggtatggantcacgcttagcacctcctaggagataagttaactgttgccatcactgttttacaaagcactcggaaactcggaattttcctttcccaagatccactagcctttggtaaagccagaagactgacttgaaaactcaagctctttcctatgctgaactgctgcttctatggaattttgtatcattcgattagaacataatttcatttt

SEQ ID NO: 638208 - DNA, 410 bp, Homo sapiens
ctggtatccccacccaactcttttaaagtcgtgctgcgggatgggatatggcgtgcgtggggtaagggtgattaggtttaatgagacggtaaggggtgcatgatcggtcgccaaggagggagtagaggtatcttatacttgtgggttaaggtggggggatacaagaggaggatgcaaaggaggcttgggatagggaagaagggcggcaatgagatatagctgtagtccaggaatagtcagggaagcagataatttagttaaagtgtctcagcctaataagggaactgggcaggtggggataactaaaaaggagtgctgaagactgatgctgcccgatcgcctcagaagccacgtagaccatcacggatgccgagctgtttcccccccccccccacaacagcacacgcgga

SEQ ID NO: 638209 - DNA, 946 bp, Homo sapiens
  misc_feature (28)..(28): n is a, c, g, or t
  misc_feature (62)..(62): n is a, c, g, or t
  misc_feature (66)..(66): n is a, c, g, or t
  misc_feature (96)..(96): n is a, c, g, or t
  misc_feature (99)..(99): n is a, c, g, or t
  misc_feature (108)..(113): n is a, c, g, or t
  misc_feature (195)..(195): n is a, c, g, or t
  misc_feature (260)..(260): n is a, c, g, or t
  misc_feature (324)..(324): n is a, c, g, or t
  misc_feature (389)..(391): n is a, c, g, or t
  misc_feature (400)..(400): n is a, c, g, or t
  misc_feature (730)..(730): n is a, c, g, or t
  misc_feature (760)..(760): n is a, c, g, or t
  misc_feature (767)..(767): n is a, c, g, or t
  misc_feature (769)..(769): n is a, c, g, or t
  misc_feature (779)..(779): n is a, c, g, or t
  misc_feature (790)..(790): n is a, c, g, or t
  misc_feature (795)..(795): n is a, c, g, or t
  misc_feature (798)..(799): n is a, c, g, or t
  misc_feature (829)..(829): n is a, c, g, or t
  misc_feature (922)..(922): n is a, c, g, or t
taaaacactgcttcttaaagttcaatgngcatacaaatcacctgaggattttgttaaactgnagantgatttagtaaatctggggcagggcctaangtnttgcatttnnnnnntttttctttttttttgacgcaggatccaaagcagtagagattttgcatttcaaatataagattcccgggatgatgctgatgntttcttgtaaggttctaaagggtgttaaattagccgatgactcgaattagcagaaaaagggatgngccaactgtacacataatccaaaagcccatggggtagacctcatgtgcatggctggatccaganggccacataatgttatctagtgtaatgatatttggtcatttctcaggttggactttctttgtgtnnntttcattcncaagcaggctctccccaggtggtggcaaagatgatcgccattagctccaggcttacatcctaccagctcaacaggagactcattctcaaagtgctagtaagctggcttgcatcacatgaccaattactgtggccaggggagagactactttgactggccaggcctgggtcatgtgaccatctctggagccaggggatggatgagtgactaggggagggtcatccacgtccttggtccagcagtggtcacagaacccatagggaatggaggagaggctggagggaagctggggttccagttcttcaccttgtgaatcccctctcccgatangggggccttctcggaagtgatcctggcaanaaaaaanangaagcaaaanctggtggccancaaangcnntgccaaggaggcccgcttgggcccagccancataaggtccccacaggctccgggaaaaagtttcccagttccttgttggtcctgggggctcggtcccttcgcctgggacgtggtagggtgcanctgtagtcacgttgggcaatgtgc

SEQ ID NO: 638210 - DNA, 422 bp, Homo sapiens
  misc_feature (47)..(47): n is a, c, g, or t
  misc_feature (64)..(64): n is a, c, g, or t
  misc_feature (415)..(415): n is a, c, g, or t
aaagaagcttgaaaagtccttactaaagtttatttagcaaatctggnacacttgactaaaaaancctttaactcacttgttaaggggcgataagacttggcaatttgattacgcacaaatatgttatccaacgagtatttattgctggtctgaggcttgccttgtttacacttaagtagatttacgttgtttccacaaatggcagatatcaacatttaaaggaatttaatagtgacctattcaataaggcaatcatcttggtagcaaacttttatttaatcttactaactcaagctttataaaagccaacataattgaaaattgggttctccctctaagccttaagtattcaagctcaaaacagttaatttaaaaatagcaaacaataaaacaaaaaaacctgccgcagatctgntgaatat

SEQ ID NO: 638211 - DNA, 190 bp, Homo sapiens
caggtgtatcacagacgtctcgctcgtctgcacgtggacttgcctggcgcttgacgtgtgtgcctcccgtttctgggcctccccagtgtgacggcctggcccttgcccaccatgacctgggtgctctgagcccacggttcccacggcgctgacttctccggggtgcctgtgccctacattcaacccggct

SEQ ID NO: 638212 - DNA, 770 bp, Homo sapiens
ggtaaacccagcccatgacccctaacaggggccctctcagctcgctcctaatgacctcgcggcctatgccatgtgatttcacttccactccataacgctcctcatactaggccgtactaaccaacagactaaccatataccaggtgatggcgcgactgtaacacgagaaagcacatagcaaggccaccacagaccacctgtccaaaaaggccttcgatacgggataatcctattgtattaccgtcagaagtttgtttcttctgctaggatttttcgtgagccattttaccactccagccttagccgcctagcccccgaattaggagggcactggccccggaacaggcatcaccccgctaaatcccctagaagtcccactcctaaacagcatcgcgtgattgactcgcgtcaggagtatcaattcacgctgagctcaccatagtctaatagaaaacaagccgagaaccgaaataatgcaatgcactgctcattagcaattttactgggtctctattttaccctcctacaagcctcagagtacttcgagtctcccattgagcatttccgacggcatctacggctcaacattgttagtagccacaggcttccacggacttcacgtcattattgggctcaactttcctcactatctgtttcatccggcaactaatatttcactttacatccaagagatcactttggcttcgaagccgccgcctgatactgacatttggtagatgtggttggacgtatatctggtatgtctccat

SEQ ID NO: 638213 - DNA, 186 bp, Homo sapiens
tcctcacctccctgtcgggctagtggggccgactagccgagagggatggtctgacccataccggagcccaagagaaggggcatcttccgtcagattgacagtggcagctcctcaccattcatcaccagcccccagcatagtcccagtacatgacaggggctagtgctggtggggctaggtcggggg

SEQ ID NO: 638214 - DNA, 136 bp, Homo sapiens
tctcacgactccccgtacgcgcctgggaacgacgggcgccagcttgacgggcaggatcctgctcaacccccaggacaaggatggctcattcagtgtggtgctcacaggcctgaggaaggaggatgcagggcgctga

SEQ ID NO: 638215 - DNA, 439 bp, Homo sapiens
gagctgcatcaatcatcttgtgaccttaaagagacaagcctgaggataagaagacatggaggagggcagagcgaaggccaggaggaagcctggatcctgaccatacggctgagctacagatcagtttctaaggccagacttctggctatgttagggattgattgagttatcacccaaaccaggatccttttcagaatggaagtgggtactatcagaaatagcacaataccaacatggcacagtgggacatgtggtcagccctatgtgaggtctcggagtgttattattgctgtcacaaatattctactacttgcaacccaaatcagtcctagcttatatatatataatatataaattatatattttaattatctatttatagcatacatatggctaaaatatgtataataaatatgcaataaaatgtatataataacat

SEQ ID NO: 638216 - DNA, 431 bp, Homo sapiens
  misc_feature (1)..(1): n is a, c, g, or t
  misc_feature (41)..(41): n is a, c, g, or t
  misc_feature (76)..(76): n is a, c, g, or t
ncgaattaatggcattcaacagcaaccctggatggaaatgnagactattaattcctaaagtgaaagtaactcaggnagagaaaacccaaacatgtttggtatgttctcactcataaatgggagctaagctatgaggatacaaaggcataagaatgacaagaatgtctgggcacaagtgcacgcctataatcccaccattttgggaggcgaggcaggtggatcacctgaggtcaggagtttgagaccagtctgggcaacatggtgaaaccctgtctctacttaaaatacaaaaattagccaggtgtggtggcgtgtgcctgtagtcccagctacttgggaggctgaggcaggaaaatcacttgaacccaggaggtggaggttgcagtgagccgagatcacaccattgcactccagtctgggtgacagagtcg

SEQ ID NO: 638217 - DNA, 108 bp, Homo sapiens
agcagcagtagccaccactccgccgaggccgcaaccccggctcggcctcccaggccccggcccttgccgcagttaattggcttccttattgggttgaacggaacgctt

SEQ ID NO: 638218 - DNA, 221 bp, Homo sapiens
actatcccataaacatagtatgataatgcagccgcagggttgacaaggactaacatatttgaaatcagttctactgtgcataaactactatcaaacagcctctcatgtccaaagaaatctttagtaaaaggacgagtcaattgatatgagaaacttcagtattgtcttattttaataaactgtcacagccacaccagtctacagaaaactccatcctgacc

SEQ ID NO: 638219 - DNA, 137 bp, Homo sapiens
  misc_feature (36)..(36): n is a, c, g, or t
ggtcgaagcccccatcgctgggtcaatagtacttgncgcaggtctgtgaactaggcggctattgtacaatacgccctacagtcattctctaaccccctgacaaaacacatatgcctaccccttccttgtactctccc

SEQ ID NO: 638220 - DNA, 849 bp, Homo sapiens
agcgggccgccgccgtcgccgacttaaacttggagggggaaaaagagctactggcgcctggcgacctccctgccatagcggggaatgggtgggtgaatcacggcatcgcacgaacagaatcacaacatgtgatactactgcagattgcggtgagagacccttatataccccacatacaagaactcgagggaccggagaatgaggaataaaacgggacggtcgagggtaacagaagataacacacaatgaacactatggacatcaaacaaaggaacaggcatgaacacatgagcattacaggctcgaactcagcaagagagctgcatagacgaggaggacaaaatgacacaaaaacagaaaattaaatagtacaagacaagaaaaagaaaaaaaaacacaaaggcaacacaacaagaaacaaggcaacaaaataagaggcacacaaaagcagcagacagagagaaagaagtacagatgttagaaaagaaaacaagaaacaaaaaaattaacaccaccaaacagaacaactcagagaaagaacaaaaaacaagaacaagataaactcacagaaacacacgaagaacaacgaggcacaaacaaagaagccaaaaaacaagagaacagacgtacaaagaacaaccataatcataacaccgaacaagaaaacaaaaaagaaaaagaaacaaagaaacaacaagagaaaacacaagaggaaaaaagtaaaacaaacaacacagaacgaaactaaacacaacagtaacacacacaaatacaggacgaaggaacacaccaacagagaactgagacgacaagaagacacaacgaccagacaccacaagcaaaaacaga

SEQ ID NO: 638221 - DNA, 218 bp, Homo sapiens
ggtggagtgcacttaattgaacgctgagcttctctgtgtggcctgcaagctgattccccaagcttcagcatcctctactggctgggcaatgaaaaccttcattgagcacctcccaggccgactgtgggaggggagcaccagccgggaacgtgggagcacaggtacgcagctgtgcaaggccttggtgctggagcagctgacccctgccctgaacagca

SEQ ID NO: 638222 - DNA, 175 bp, Homo sapiens
tctagaggatcccgagatttatctatagatgcatcacttttccttttatagatgtactgttccatctggcatcaagattggtgcacctaagtgggttcctgctgcaatgaacttaaggacatcctcctccttcatttctgctacatctcaggtactcctattacgtgtccggcca

SEQ ID NO: 638223 - DNA, 163 bp, Homo sapiens
tgcttgccgtccccttggcctgccgattgaatatgcctccacggcaggggctgccttgtggccgaacgtaggaagttcaaaacagtcatcgttcctttccccacctgccaatcacaccctcctccacctcctcagcctggcgtctccccttgggcctccctct

SEQ ID NO: 638224 - DNA, 585 bp, Homo sapiens
  misc_feature (54)..(54): n is a, c, g, or t
  misc_feature (97)..(97): n is a, c, g, or t
  misc_feature (156)..(156): n is a, c, g, or t
  misc_feature (173)..(173): n is a, c, g, or t
  misc_feature (177)..(177): n is a, c, g, or t
  misc_feature (181)..(181): n is a, c, g, or t
  misc_feature (192)..(192): n is a, c, g, or t
  misc_feature (232)..(232): n is a, c, g, or t
  misc_feature (240)..(240): n is a, c, g, or t
  misc_feature (253)..(253): n is a, c, g, or t
  misc_feature (259)..(259): n is a, c, g, or t
  misc_feature (295)..(295): n is a, c, g, or t
  misc_feature (373)..(373): n is a, c, g, or t
  misc_feature (397)..(397): n is a, c, g, or t
  misc_feature (450)..(450): n is a, c, g, or t
  misc_feature (534)..(534): n is a, c, g, or t
  misc_feature (571)..(571): n is a, c, g, or t
  misc_feature (581)..(581): n is a, c, g, or t
ccatgcgtgagtgcatcatccatccacgttggccaggcatggtgtccagattgncaatgcgtgctgggagctctactgcctggaacacggcatccanccgatggcagatacaagtgacaagaccattgggggaggagatgattccttcaacacctncttcagtgagacggggnctgncaanatgtgcccggnagtgtttgtagacttggaacccacagtcattgatgaagtncgcactgncacctaccgccanctcttncaccctgagcaactttatcacaggccaaagaagatnctgccaataactatgcccggagggacctacaccattggcaaggagatcattgacctcgtgttggaccgaattcgcaanttggccgaccagtgcacgggtctncagggcttcttggttttccacagctttggtggggaactggttctgggttcacntcgctgctcatggacgtctctcagttgattatgcaagaagtccaactggagtctctattacccggcgcccaggttcacagctgngtgagcctaaactcatcttacaccaacacctgagatntattgtcctnatgt

SEQ ID NO: 638225 - DNA, 503 bp, Homo sapiens
  misc_feature (263)..(263): n is a, c, g, or t
  misc_feature (267)..(267): n is a, c, g, or t
aattcggcacgggggaattgacctgcctgcctcttttaatgggcttgttgacttggtgagctctgcatttcaccgggactctccaggggaactttgcattacaccagagcacagcttccaaatgttggaggtgactgaatgaagttttaccgtttatttggtttaccttggtagaagtactgacagaatgacctgcagtgattgaaacaagttgcttccatgtttcctaaagtacttccaattcaataacaggccttgtacangggntcacgctgtcatcccagcactttgggaggccaaggtgggcagatcacaaggtcaggagtttgagaccagcctggccaacatggtgaaaccccgtttctactaaaaatacaaaaattagctggccttctggcgcatgcctataatcctagctgctcaggaggctgaggcaggagaatcacttgaacctgggagatggaggttgcagtgaatggagattgcgccattgcactccaacc

SEQ ID NO: 638226 - DNA, 342 bp, Homo sapiens
gtaactatgagtcctgcctagtatgacagtctgagataggctctccaaatgaatgcagaagctgagattgcactgcctaccttcaaagagaagtagttcttcccactctcctatttttgtggcccaaaatgtgcgcactcttagggcgtaagcataaattcgggttctgctggttttctggtggtacacagggtcttcgtgtgtagcacagattcaggagcctgaaatttgactacccacaaatggtgaaactcattctgagatgctatcattagacctgttttgcgagctgtgcattgtgtcggtcccagaattgtaaaacctggataactccctgcacta

SEQ ID NO: 638227 - DNA, 1165 bp, Homo sapiens
  misc_feature (565)..(565): n is a, c, g, or t
  misc_feature (734)..(734): n is a, c, g, or t
ggggggcctccccttggggtggtcgagagcaggtgtgcagccgtgtcgtacgccgggtgtggtggtcgttgtctcacggtacgccgtgccccactcgtgttggctaggttgtttcttcgtgtgttgtgagcgcgccatgtatgttgtacgcgctcggggggtcctttccttgcattggagggcgcatctctccttccccctgcgcagattatttttctcggggccagtccatcgcgtcttgtgggtggggttacgtaatctgttcgcctgcccctgttcgcgcgggatagtgtgtcttttccgcatgggggggtgcatacccccgcccccgcgcgtttttttttattcgcgtcgttcgggggggggcgcccccaagacagcgcccacccaactgtgggggggggggcagcttcgcggtctctcgccatcactagtgtccagctgcagcgcgcgtccgctccatattgttgaccatcttcgtcgctccgctgctacggtgtgttgtttctgtccgctcccaacgcataggatgcagcgttacacctctcgtcgttggtggtaggcntctgcgcatcgactccttgcatcgctagctgttgtttgtaatcccagcgggtgtaatctggcctcacgtgtcacgcgatacttgcggcgtgttgtggccactcgaccacacgtcttctctcggtcgcgggaggagagatataactttctcattgcgcgcgcggtcttcncggcaccgcgccagagtctcttctctcgtctctagagtaaaacatcgtctgtggtgcgcgtcaccgcatcccatccattcgccctcgctcctgcgcgtggtggttggtcctacactctttggctcccacgcctctcggcgtctcccaccacccgcgccgcgtcgcagaaccgccgcaccagaacatgaattattgtttgctttgcgcaagccgcacctcccatcatcgtcccgcggggtgatcacccgccctcaggagcattggcgtctctgttctcaccccctccgctcccgccgcctccctgtgtggccgccccccgcccgggcgcgcgtggttgcacatgtcttctcccgccgggcccctttttccccccccccccccccccccccgtgttgtgtcaaacaaaagagtagagttttttttttttttta

SEQ ID NO: 638228 - DNA, 1369 bp, Homo sapiens
ggggttggctaccggggccatcccacgtggtggggttcatttccccgctctgtgtgggactgccccaaacgtgggtgggtaggggcggagggctagactagtagtcatacgccctggtacatgttttctctcgcagctgccttgacttagttgtttctagtcctggggctggtacctgcctggtgctagctagatcgacccccgtctcacatctgcgccgccgccttgtcggcaacttcctcataatacatctggcgcgtgtgtgttgttgcgagtagtttgttcaaactaccgtcgggggtcttcttgttcgtagccaatcatcctctgctctcccggcgggtgggtggtttgtttttgacgactccggtaggtgacgcctgctgcagaaaggtgtttgaccgccctggcgcagttattgttcttcccgcccgcccgcttcttctttccctatgcggctgtgtgggttgttgagcagcgacactggctgggttgtgctgcgacattagttcagctaatgccacacacagctcggtgttgtgcggtgtgtcgttcggcttgtttactcccgcagacgccggcgcgctgctctcaagaagtggtggtgagtccacacaccctttcttttgggttgggcagcacaacaacacgcgtgcttcccaggaagtcagcccacacagttcaacagggggtggcaacaacttctcgaggggcgacggtgttgggtgccgtctcacgaataggtggtttctcacaagacggttgtgctggccaaaggaatgagggttgatttgtggtcttggtgatctcgctcttcatataggtatcttatatagttagcgggaacactgttggggggtgcgactacacccagaagtgagcttctgtttgaccgagggctttttgttttgtccgcgcggtttgtccctcgtggctttctttgctcccgcccgcacatttagtgagccggcggccacatatatgccgcgcctctcggagaataccgcctgcggggcctctttgtccactctccgctctctgacggcttttctctggctacatgggagccaccccttttcggcgcactgctgcattccttgcgctagcgacgcatttttgccccacccaagatggagcttctctcttcccgggggcgccacccctgggatccataccccccgctggagacaccttcccccatgggtgtttttcctttctcttggaactttttttggaggttccatcgtcttttgggttcctcggggcaaaattaacccatagccttttggtgactcccctttttttttttttttttcaagatattggaaggggtggggaaatatataaataaatcatgaccatccaatta

SEQ ID NO: 638229 - DNA, 692 bp, Homo sapiens
  misc_feature (1)..(1): n is a, c, g, or t
  misc_feature (14)..(14): n is a, c, g, or t
  misc_feature (75)..(75): n is a, c, g, or t
  misc_feature (78)..(79): n is a, c, g, or t
  misc_feature (108)..(108): n is a, c, g, or t
nctagcatctacanagggacggtcttgagaatggacagagggaagacccataagctaaactgaagggggagaaanctnnaaacgctgggggggggtacaatacaccanaactcatttttggaccataacagcactaggggaatggagcaacattaaatagcaaacgtgaaacaccacgggaagtcaagagacagaccatggaatggaaaaaaaagctttatattttattactttagggggggggggtttcctggtttttgaacaaggagctaaacattttcattttgcaccgagccctgcaaatgatgtagctggccctgtctttaagtattgagaagctgtcaaggttatagggggggatacacattttcaaacttctgattttaactgaaaagctcaaattttatcattggggcacaaatactggcagttttggtccttgaagtgacaagctcacttcacccttttttgagaaaatggctgccaaattccctagtctgaataacccaggttccttcaagacaaaaaataacatttcatgaaaaaaagggggcagttcagctctcaacatggccacagcctacaactaccctttcaatggacagaaatgctttatggatacttcctacttacacatagtattaaaaagacatgggcccccgaatcaagattgaatagaaattgataattct

SEQ ID NO: 638230 - DNA, 151 bp, Homo sapiens
atgtgagacaagaaacgctgtatttaccgtgcacagacacggtcacttgtcttcctcagaaagtcatccatacccaggatggcaatgatatcctggagggatttgtagtcctgcaggatcttttagcaccccacggagcaacatcagtaat

SEQ ID NO: 638231 - DNA, 613 bp, Homo sapiens
  misc_feature (335)..(335): n is a, c, g, or t
ggggcttgggaaatgctatagcactttatgctggaataaaacagacaatatttaattgtacatatatgtcagaatttctctcatcagattcaatctagattagttagaaggaaggataatcacaggatgattctgcacacaattaacgtgacagtaactggtaattatcaagactatatatgaatgtatgatgataggccaaaaagaaaaaaagccaatacaaaactatctattcatcaaactgctaaccgtggttacctctggcaagggaaagggaggcgggaaactgcatgttttctttatatgcttggagtgttgattttacataggccctnttgtaatttttctaattcaaaagaactaattacatatttgtgtgtcctgtgattatagctatgtaaaaattgtgtatgcatatgaacaacaaataaataggaatatggaaaaatgaaacagtggttatgtggtgagattctaggtctttagtttttttcttgggttaaattcctcaaacgttaaatatgtttaatgttacacaatgttattaatgttaaaacatgtcataatgttatgttacaatatgttactgttacacattaacaaacgttatacc

SEQ ID NO: 638232 - DNA, 464 bp, Homo sapiens
aggtggagaagagagtaaaagatgccgcttacccatttcaattggtgagatgtccttggtgctggcttggtccgacgacccaggtctgctggtgtatctttctcctgtgagcaaagagcagtgaggacaggcgattgatctcccaatgaagggcccccaatctcaatgtcacagcacaccatgtcacgcgcatcaatttgaagagagtccaacaacaggctttgtgtgagcaataaagctgtttatttcacctcagtgcaggtaggctgagtcttgtttgcttgcaggtcctaagacccctccatcccagagagagtcctgccccgtactcagaaggaaggaatgctgcagagaaaggtccagaagaatctacactgacaggacttgctgggtttccccactcaggttattggccttctggtccaatcatatttctttttgcgcggttagcccttttttggaaa

SEQ ID NO: 638233 - DNA, 284 bp, Homo sapiens
gaggatcgtcggaatacacagcgtcatttatcctgtagctaaataagactccaacaccagaaaaaaaaaaaaaaaaggagggaaaaacgggttggtaaggtaaaaacaaaattctatctgtataagtcttaactggtacaagtctggtacacagtcagaacgggttagggcctctggcagaagccaaaacttcagaagagggggattaaatgggtcatcacaggtccccccaacttggcttggggggatatgtacattcacggagaccaacagtgaagagaatt

SEQ ID NO: 638234 - DNA, 518 bp, Homo sapiens
  misc_feature (13)..(13): n is a, c, g, or t
  misc_feature (98)..(98): n is a, c, g, or t
  misc_feature (101)..(101): n is a, c, g, or t
  misc_feature (120)..(120): n is a, c, g, or t
  misc_feature (128)..(128): n is a, c, g, or t
  misc_feature (140)..(141): n is a, c, g, or t
  misc_feature (157)..(158): n is a, c, g, or t
  misc_feature (170)..(170): n is a, c, g, or t
  misc_feature (188)..(188): n is a, c, g, or t
  misc_feature (200)..(200): n is a, c, g, or t
  misc_feature (210)..(210): n is a, c, g, or t
  misc_feature (238)..(238): n is a, c, g, or t
  misc_feature (256)..(256): n is a, c, g, or t
  misc_feature (260)..(260): n is a, c, g, or t
  misc_feature (274)..(274): n is a, c, g, or t
  misc_feature (276)..(276): n is a, c, g, or t
  misc_feature (280)..(280): n is a, c, g, or t
  misc_feature (309)..(310): n is a, c, g, or t
  misc_feature (320)..(320): n is a, c, g, or t
  misc_feature (327)..(327): n is a, c, g, or t
  misc_feature (342)..(342): n is a, c, g, or t
  misc_feature (346)..(346): n is a, c, g, or t
  misc_feature (371)..(371): n is a, c, g, or t
  misc_feature (426)..(427): n is a, c, g, or t
  misc_feature (429)..(429): n is a, c, g, or t
  misc_feature (449)..(449): n is a, c, g, or t
  misc_feature (512)..(512): n is a, c, g, or t
cccagccaccagntcagcgggttccagggccttctcctcttttggtcccttctagttccagaggctaaggggaagactggccaggccccaggccccanccntcaaaaccagcctcatttntggttttnttggggaggtgnntttgcttttagaaaanngggggcaaggtngggggggcgccccccctntccttgctcccngccccctggncccgctccgcgacggcgcccgtgagggnccagggcccaggcccggntgcnggccggcttcactntntctnggggtttggctactgttggcctgggtgcnncgagagggcnctgaggngggccagttggcggnggancaggtgacggcagcatcggggacanaggtggggccactcactggtactggccctttagtgctttgccttgcccttggctnnangggtggcaccaatggcggcncagtggcggcgctggctgtggtggtggcaatgcgcggagaacggcgggttccctgcgagtatnggggga

SEQ ID NO: 638235 - DNA, 1014 bp, Homo sapiens
aagcagtggtatcaacgcagagtgcccattacggccggggagtgcgtacattacctcgacctcattagctatgtcggggacggtaaccgggcaccggatgtcatgctcctgtcgccttcgcctcctaatccctagccacatatgcagtgagtgcatctccatccacgattggcaggcatggatgtacagagtaggcaatgcctgctgggagctctacatgcctggaacacggtatcccagcccgatggccagatgccaagtgcacaagcaccattgggggcaggcagatgacatccattcaaccaccattcttcagcgagcacgggcgctggaaagcacagtgccccgggctgtgtacgtacgaccttggaagccacagtcatccgatgaacgttcgcactggacacctacacgccagcatcttacaccctgagacagctcatcacaggcaaacggacagatgcatgcaataactatgccccgaggagcacatacacccagatggacaaaggagcactcctggaaacgtggctgtgggcaccgaccttcggcaacagactggccggcaccagatgacacacgagatcattcagggccattcaaggacaaacaaaagcatcgcgcgcgcgggcaacgtgggtacatgtggttacaagccttgcgcgtgggctcattgtgaaaggtaatcctcaagcatgaattaatggggatgaacgttccgacagcctaggaagatttttaccatttataaccgtggacgcaccggggttatacacaaggacatggatagctcggagccgccacaaagaagacagtaccacaaaccatcccacacagcccacaaacaccaaacaaaaggggcaggcaaactactgaacttgtgtgcaccattgcaaggggcaagagaacaacagcagggcccaacataaaggacacaaaaaggcagaaaagaaaagcacacaacatagacacacgccaaaacccaccactacagctgtaacagggcagacaaag

SEQ ID NO: 638236 - DNA, 429 bp, Homo sapiens
gactatggcatatcttttagaaagctgtctccttatttaaataaaatagtgcttgtctgtagatcagtgctggttcaatcggggggggtattctgctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaataaaggccctctaaataaggaataaataacctcttagacaggtgggagattatgatcagagtaaaaggtaattacacattttatttccagaaagtcagtggtctataaattgacagtgattagagtaatactttttcacatttccaaagtttgcatgttaactttaaatgcttacaatcttaga

SEQ ID NO: 638237 - DNA, 503 bp, Homo sapiens
  misc_feature (74)..(74): n is a, c, g, or t
  misc_feature (95)..(95): n is a, c, g, or t
  misc_feature (229)..(229): n is a, c, g, or t
  misc_feature (372)..(372): n is a, c, g, or t
  misc_feature (431)..(431): n is a, c, g, or t
ctcgtgccgaattcggcacgagggaacaatacttgatgtgtccttactgtgttccagggttggtgacggcaaanccgagtaccacgggaagtaanaaatataacaactgtgctagtaggcttggtgctagtgtggtcgtttccaaaatgtggtcctggggtcatgaacatcaccgtcactcctctaaaaacatgcattctgaggcttcacctgggacacattggatcanaatgtctcctgggggtgggcctgtcatctctgctgtaacaagccctcccgacgatgccaattcactctaacactgagaacactgggtatatttcccaagtgaatgaagatctcttattgcacttctgttatttcctatttgantaaaatctttgtggtttttactgtatatttaacctgaatgtggctccaggaacaaaatnaccatttctttggggggcaaaagatgaatatttgcctttgaaccctttgaacattcctgcttgttaaaattt

SEQ ID NO: 638238 - DNA, 194 bp, Homo sapiens
agggcagcatcgcccgccccttcccccaaatgttgcttgcagccccccccctaaagccccctccaaatagccatacttagcctcagcaggggcctggcctgtaacttataaagggcccctcgcccccgcaagccccagccccgagggccgtccatggcccttatttttatatgagattaataaagatgtttgca

SEQ ID NO: 638239 - DNA, 472 bp, Homo sapiens
atatagcaagacccatctctaaaagacgaaacaaaacgaccaagacgaagcgaagcattccagcctggaaaccatggcaaagccctgtctactaaggatacaaaaaattagccaggtgaggtggtgcatgattgtaatcccagctactctggaggctgaggtgggagaatcgcctgagcttgggaggttgaggctgctgcgaactgcgattgcaccgctgcactccagcctgggcaatcacagtgagaccttgtctcaaaacaagcaaacaaacaaatgaaaaaccttagccaggcatggtgacacatgcctgtagttctagctacttggaaggcagaggcaggaagatcgcttgagcccaggagttcaaaactgcagtgagctatgatcacaccattgcactccaagtctgggcaacagagggagaccctgtctggaaagaaagagagaaagagagagagagagaaagagg

SEQ ID NO: 638240 - DNA, 413 bp, Homo sapiens
gatcgagctcggtacggaggagcatcctaagcagatctgtatggcttgaaatcgtgcgaggtgggcagaagctcaaagccgtccgatgaaccgaagctagggagaggctctatatgctacaagcagtacctcctcactgcaggtagtctgcgccttaaccctctgcagggagactgactgtagcaccaagtacctggctttttagactctacataggaattccaccataattaagatgtataaacttgacctacagcctaaagcccaatatgcttccctcaagaacataacagtgttcaagcttagcttggttacagaaaatgaggtagggtgcggtggctcacatctgtaatctcagcagtttgggaggccaaggcaggcgcatcagctgaggtcaagagtttgagaccagc

SEQ ID NO: 638241 - DNA, 415 bp, Homo sapiens
actgagccacttaatgcctaaagactctggggagcagatgttacctaaggtagtgaccctgcattgtggtgcctgagccctggcagaagctcttgtaaaatttgttaattgtttaaaccacttcttttggagagcaaggggaaggtcaagaaggcagttttatcaatattgtgtcagtcaccacaaagtaggccagataagttaaaaaaaatttttttttaaataataattgaaacttatctcaaatggagattttggtgggaggaggagataccaagtgcctgtaaaccacacactataacgggtgacgaatgagttgtgcatatctgtacaggtgattctttgactaggattagcctcccaattattgctcatagctgaataaacatcgcgatgttattcatctactttagaa

SEQ ID NO: 638242 - DNA, 264 bp, Homo sapiens
gcctgggggccccccccccccttttttttccccccaaaaaaaacccgggggcgtttccccccccgggttttttctttgggccgggggggggaaacattttttccccgggaaccccttttcccctttgggcctttttgggggcccctttaaaccagtttttgccaaaaaacgggggggggccggggcgggttttcccgggattttttgccccccggggccccccccgggggggttttttccccccttaaaattttttttttccca

SEQ ID NO: 638243 - DNA, 140 bp, Homo sapiens
atacccagtaacgaagtaccagtagactcagcggttcaactttatataattattatataacctgttaatttatctgtacaatgccagcatttggactttttgtataatcaagtaaatttcttattgatggcaactaacat

SEQ ID NO: 638244 - DNA, 438 bp, Homo sapiens
cgggctacggatgtgggaattctgctctccctcaggatccgcttcacccaggtaagatatgactccctcagccctgtgacaggcctgtataggttggactgtaggggctgtaagtgagacacagctaggatttgctgctatgagctcgcatttaaatagggcaataatgtttcagaaacacatgataaagccaagtaacacagcaattcaaggtaaactgagttcattccacacattagtaaaccgctatagatgactgaaaggtccccagttcctcccctaatttctgcaagcactttgcaggcatttctaacacttggaaatactgtgcttctaccatagcttagaaactgacatttgtatgttttaatggggtccctgctgttcatcaggcagacacttgtgggctttaaacaggtcgttgcttggacctttgct

SEQ ID NO: 638245 - DNA, 412 bp, Homo sapiens
gcacgagggcatgtagatctgccttcatgcaagcataaaatttagactatcccaagaaatcaagaagttggacattctttagttaattctcatgaatgttcttgtgaatctgtgcttttattattattttgctgttgttttaaaattaaggtgtaacatacacctagtaaagtgtgtagagaccagctaatttcaagtatatagtttggtaaatatttacatctttaaacacttgtttaaaagtaacacccagatcaaaatttagaactgtgtagcagccattggctccctcatccttattcccaaccgatatctatcacttctctgacttctggcacgactgatcggctgtgcttctaagtgggatgcatatataaattgaaccatacagtatcacttttctttcagtctt

SEQ ID NO: 638246 - DNA, 123 bp, Homo sapiens
aaatgatttactgctgcacggctccacaaatggacaaaacgggtccccgggctggtaaggcatgacatggtgggcacgggtctggggtgcatgaaattacgatacagcctttctgaaccctgt

SEQ ID NO: 638247 - DNA, 226 bp, Homo sapiens
tgtaaaaacagagttgcctttgattaagagttccactatttttataagcaactagactttatggggaaagtagctttaagacatttttgttttctgtgtgtatgtgtgagatggggtctcactctgtcacccaggctagaatgcaggagcacaatcatggctcactgcagcctcaaccttctgggctcaagcaatcctctcacctcagcctcccaagtagaagagg

SEQ ID NO: 638248 - DNA, 191 bp, Homo sapiens
ggttttattttgagcccccattccccccccccagttttttggggcacaagggtttgggcatgtcccccaggaccccccgtggggagccgatggggaggggatggaaaaacaaaacagggtttttttcaggcccaggggccggtcacccaccccagggccccccagccaataaaccgaaagtgttccaccca

SEQ ID NO: 638249 - DNA, 296 bp, Homo sapiens
tgtcagtcccaggaagttattgaacgtgttcaggcatgacacagtgagacccgtgtctctagcattgcagcccaggaggtcgaggctgtagatgatccagtgatggtgccactgcactcgcacctgggtgacagaggaagacccttggcctcattggaactagagcgaagcaaaacatacaccaagagtgtcgcatcaggtcctaggccgtctactatcatcacctcttgccatggactgcaaactctagaaataattgcttataaatatcatacatgaaaaattcttcaatgaaa

SEQ ID NO: 638250 - DNA, 613 bp, Homo sapiens
  misc_feature (45)..(45): n is a, c, g, or t
aagaagacccttcaacttacttggtattaaaatatactggaattngagcaaggatctggagcggttactaattaagctccgatgcgggtagaaccaaatgtctttttatctgagtatcttactgtttagtgtggctgtgatgtaatgagaaatgtgtttggactttgttctctgttcctgacgtagagcttttaaatcccttggaatttacttagtgataagagtgtcttttgttgcaatgacatacttcttgcctggacccttaaatagcttcaggttgggactggccaccagaaaaatcaaggcatgattacaggttaattctgtacctttgaggagttagggtggagtagaattaccagaagccaatgattaaatcaatcatgctgtgaaaataaagcttacattaaaaatactctaaatgatagcattcagagtcttctgttggtatgtgcacctggagaagacacaagaacgtactatcttcttaccctcatgctttcccctatgcatctctcccatttggatttcctaagttgtattcttttatgtaaatcagagattatatgcaaaatgccttcttgagttctaggacagccaggactatacagag

SEQ ID NO: 638251 - DNA, 537 bp, Homo sapiens
  misc_feature (418)..(418): n is a, c, g, or t
  misc_feature (446)..(446): n is a, c, g, or t
  misc_feature (506)..(506): n is a, c, g, or t
ttttagctgattccagacatagtcaagttgaaaaccaacataaggatcacagactataaaagattataaaggtcttttgaagttgggctaaatgcattttgggttatgatttggccatgcaactgtaggagccagggaagggaatgtggtgattaaagtgagaaatgtccctcctagtcttgaattggagcagtcagtgtccagtgtggtgctgtgtgggcgcacattgctagaagtgtgtacttggatttgggctgtgagagctcaaggcctcggctaccttttggtttgtcctctctctccgtgcttgtggttgaggagtgagctgaagtttttttctctggctgcttgcatgttagccttctaacgcgctttcccacctcagggaccattaaccccaataaatgcttccctctcnaagttgccctggtccagggatttatccnggcaatagaaagattataataccccagttttcaggggatatgcctagaagtgatgtagcncgggttatttggtggtgcccggttttagcct

SEQ ID NO: 638252 - DNA, 1098 bp, Homo sapiens
  misc_feature (469)..(469): n is a, c, g, or t
tatttgtaataattaaacttgatgttgagaaatcaaaaaaaaaaaaaaaaaaaaaaaaaaaaaaaaaaaaaaaaaaaaaaggggggggggttaaaaattttcctgaggggggccaattgtgggggcccctttttttggtgaaaggggggccctaaaggggggttttaaaagggggggggggggggaacaaccggtcgtgagtggtgggaaaacgggcgaccggtgggatatcttgggggaagggaccccttatactgggtggggggggcacaatatagttagcaaaacattaccatcagaaattttaaagcgctttaagggataaattattaacattttgacaggtgatattgtggtgttaacacagacgcggtaatatatggcaggcggcagaaaaatttgggcttaggagaattagtatttatggaaaatacttattataaccacgggcggctgcggtgcataaccnagcaggaacagattgtatatcacgtcacgggcaaataaggaacagatagaacgaacggacaggaaacagtcatcgacaagagacatacagagagacatagacagaagacaaaaacgagagacagtaatacacaagaaatagaaacgaaacagataatacaaaaaacgaaacgacaaaagaacactaaacgaacacgccagagacgataacacatacgcagaaaaaagacctgaacaacacgcacaacagacaacagcaacacaaccatacacaacacaaaaacatataactaatatacacaacaataaaaaaaacttcatcagaaaaatactcaaaaggaaagagatgctttgaggagaacagaacaaagacagaaaaaagaaaggtaaagtaaaagagacaaggaatataggacgaaaaaaaaaaccaagcaaagaacaaagagaagaaagggagaacagtagcgtgaagaaagagagatagaaaaagcaagaagagcagaattgatcactacggtgagttaatgaaagagaggggtagggaagcatgatatgagaagaagcactgaagaggcagtgtgaagaggcgaaggagagagtggtagaatagagatagagcaaggactcacc

SEQ ID NO: 638253 - DNA, 1998 bp, Homo sapiens
tgctgtatcctgtggcggattctgctggttccggaagtgctgggttcgtgatattcagcggcctgtggtgctttcgccgaatctcagaagtgccgtgttaagcagatcactgaagtcggatggtctgttagaagaaaatgcatttgatccttcagaaagatcacaaggcagaacagtgttcataacttattgctccaacaactggcaacttgtcaaatgagtctatgtgctgctcccacaagttctgaagagcaaaagcacagaaatggactatcaagatgaaaagagaacaaaattgaatcaccccagtttaactgaaagccccgaatctacaacaaaagacaatgatgaattcatgatgttgctatcaaaagtcgagaaatgtcagacgcacatcactggagatcatgcacacaatcttacagtagtatacaggcttggcagggcagcaagagagcttgacaaatctcctcggaatctcctgtgcatcacatttcttcaaccagacgaacttgcagaagaccaaagaacttatgaccacagtgactaaccacacactgttcgaacagagttcaggacttcctcacaaagcatcacgttcatctcgacagctaataattccttaaggcatttcaacgacggctacgaagcatgatcacatgggacaatcggattgccgagcaattacggaccgacatccgaaccgcggccacatacgtcgtcagcggcggcgtctaacactgacgactacatcagccgcaaccgacacgtcggcgagcacagagagatcaacacgctcgtctttctctcttctctcttatttttatttctcccgggcgcgagcaaggcaggagacaatcagacgacgcagagacgggaagacgggggaggacggaggagagagacgccggcagagggaggagggagagagagagaggaacagaaggggacggaggagagagagagcaagagcgaggcgggacgcgacgaagaagagcagacgacgcaaacgagacgagcgacagagagaggagacgaacagacgaacagcacggaagaagatagagacggcacgacgaaccgcagacgcgcagagagcaacaccgagacgcgagagagcgacgcgagtccgcacgcagggcggcccgcactgcaaaggcgtcacgacagagcgggcagcacggacacgggagtcgcccgccgaagcggcgcgcagaacgcatcggacccagcgaagccgggccgggagcggaaggaggcaacgagcgagaagggcagcgagggacaggacgagcggacacgcgaccaggcggggaacgagagagacagagcgagtcagagacgagcgggaagcggccggcggcaggaagcgctcaggcggcggcggcagggtgcacgggacacgacagcccacgcgacgcactgaggccaccggagcgacagagaaccacacgacgcaagagacacacagcgcacgcgacccgcgagacgacaaaagcgaccagcaaaacacaaaccagcgaggacgacacaagagacaccacacgcgacaaacggcacaaaccacacgctcaagagacacacaacacgcgaagcacacacccgaccaccgacacgacaacgacccaaagctcgccagacccagccggggcgaaccagacaccggcaacaacagcagggtgacgagaagacgtggagaaaagacgaggaacgagccaacgcacgagccgcgacacggcactacagacacaccgaccaggagagcccagccacgacacgacgcagccagtgcacgagagcagaccgacagagccagccggacgagcaagccaggacggccacgcgacgacgcagacgacgacagagacacgacgacggaggagccagaacgagcagaagcagaagcaaccgagcggcgaaacaagaacacgcgacagagatgggcacaccgacgtcgcctccacgcgacacgacacagacagaaccccgcgcgcgcaa

SEQ ID NO: 638254 - DNA, 120 bp, Homo sapiens
ccctggttgtcattgctctgcttgtcctgctctgcttgtactgtctctgcttttatctagcccaacttccacatgttagggattatgattaccacagcccagaggcaggacaagcaggga

SEQ ID NO: 638255 - DNA, 441 bp, Homo sapiens
  misc_feature (434)..(434): n is a, c, g, or t
tgatgcagagaaccaaatttctacatttaatttttttttcaggcggggagtgatggctcacatctgtaattccagcactttgggaggccgaggcaggaggactgcttgcagccagaagatcaaaaccagcttggacaacatagtgagaccacatctctagaaaaaaattttttaaattaccaagcatggctaggcatggtggctcacgcctgtaatcccagaacttggggaggctgaggcaggcggatcacaaggtcaggagttcaagaccagcctggccaacatggtgaaacccagtctctaaaaatacaaaaattacttgggcatggtggcgcatgcctataatcacagctactccagaggctgaagcaggagagttgcttgaaccagacccaggaggcagaggttgcagtgagccaagatcatgccactgnaccccaa

SEQ ID NO: 638256 - DNA, 408 bp, Homo sapiens
  misc_feature (27)..(27): n is a, c, g, or t
  misc_feature (30)..(30): n is a, c, g, or t
  misc_feature (38)..(38): n is a, c, g, or t
  misc_feature (50)..(50): n is a, c, g, or t
ctaggcgggtctgaactgcagagcatncancggttggntagcggctggangcaagccggacaggtcccgcagcgcgtcccgtagacccgtcccagacacgtcttttcattccagtccaattcaggctgccgtgcactttgtcggatataaaataaaccacgggcccgccatggcgttagccctttcttttgcagatgcgtctgggaaggggccccggacttcctcgagagaatgtgctatagacaaacccctgtcttctttggcgggggttatattgtccgggatctggataagaattttgggggcttcaaaaaaccgacgttggatttgggcctacttgggggggtaggagtttccaacaatttatttttccaaaaggacctttccccccaagggcttggttttggg

SEQ ID NO: 638257 - DNA, 1163 bp, Homo sapiens
  misc_feature (533)..(533): n is a, c, g, or t
ttgatgaatgcgcagacccaattttgcagattgacaatgccaggctggcagccgtgtgacttcaggtaccaagtatgagacatgagcgtgtgcggcctgacgatcaaactgtgtgagtgccagacgtctagatgagtcctgcgactcggagtgttggatgagctgaccctggccagtgactgacctgcgattaagtgttcgatatctgaaggcctgagagggaggatctggctctaccgtgtaggcaagaaccacgatggaggagattgcttgcttctgcacgtaggtcagagccggcggagatgctgaacgtggatgatggatgctgtcacctggcggtggatcctgtaggtccgcactcctgacatgtgagatgcgtgatccagatacgagcaggatggctaggatgaagagatcgcagaagtacgctgatgaccttggttcctgaggtcgaggacccgatggagactgatacctagataggaaggtggcctccagatcatgcgaatcgtgggttaacgagcaggctaggnccagctaggttgatcggtgacggggagcttccgcgcacgtgggtgcgtccagggccatggtaagattcgtagtctgcagtcgccatcgtcagtatgaaaaggcgagtcccctggacgaacagcgcttggcagagagaccctaagagggcctgggtacttgagattgctagcttgtccccagatccaggcacctagacttaggtcacgtcgtaggaaggcatccatgcttggcccaaggtacggctgctggagatcggatgcaagctggagcccagcgagtacccacgaatctttgctgggaatcgtgggaagaccgctgggttttggaggcaaggaaagatttgctcattcctaacggtcggccttgtttcgtaatggcctgagggattggacctactcttttctgtccgcaagcaaggctatcatgggccgcagtctcgtaattcgttccccggcgaagggctcatttcaccctttccttccttccggtccttactttcgagaaggctcgggtcaggacacccgggccccatcccttccagggtaggcacgaacgtgcattccaaagtttccatgccatgtggcccagagcttccgtagaaactggaggttggcttcttattcataggc

SEQ ID NO: 638258 - DNA, 110 bp, Homo sapiens
tcggccataaccgtcagaaacactggggctggcacaaactctggattcttcaacaggagaatcttactgtgtctctttcggttccatagtgtggagacattcctgggcac

SEQ ID NO: 638259 - DNA, 341 bp, Homo sapiens
agcatgctcatagcagcttcttctaccgtttctgcagcttcacatctgccttcctgtctgtcaagtgccccaaggttctttcgagtggtcgtaacagtaggactatcaactttgcaggctctgtaccggccgccatactctccaaccgatgtcccatcctttggcttacctttgcatacttctctttcttcagcatgcatccagatgggttcattttcatcgtctacagaaccaaactccctttcatgtgcacgagtgcgaatctcttagtacagcgtttctgctcgcttgaactttccttgtttcccctagcaggatgccaggttatctaccgtcttacc

SEQ ID NO: 638260 - DNA, 161 bp, Homo sapiens
tttagcatgcgaattcacatctttatcaggctgatgggtcttgcacgtcatctgccacctcagttcagttggagaggattcttttgcattgatatacacttccagcccatcgaagggcggctgctggctaccgtagctcgatattctcttatcgttcgatc

SEQ ID NO: 638261 - DNA, 235 bp, Homo sapiens
tacccagggtaagacctttcatttatttgtgtatattattatatattgtgtgtatatatatttatatttatgtatagattttgtgtacatatttatatatttatatacatatttatgtatatatatatttatatattatatgtatatatatttatgaatatttatgtatattatgtatatatgtatatatatttatattcttccatctatattcacttaagtgggtagtcacaga

SEQ ID NO: 638262 - DNA, 309 bp, Homo sapiens
  misc_feature (138)..(138): n is a, c, g, or t
  misc_feature (259)..(259): n is a, c, g, or t
gcacagctcagtaattttgtatattactagagatggggtttcgcatattggcaggctggtctcgaactcctgacttgtgatccaaccaacttggctcccaaagtgctgggattacaggcatgagccaccgcgcccggncaattttttagtgtatatacctagaggtggaattgctggatcaaacagtaattccacatttagttttttgaggaaccaccacactgtttttcacagcagctgcaccattttacgttcccgncaggaatgcacgagtgtttcagtttctccacatgcatgcacccagggggt

SEQ ID NO: 638263 - DNA, 116 bp, Homo sapiens
gccgactatcactggtagatgccttgacttacgtgtgccgacccatggtgacgatgacacaccctggtggcatgcccgtgtatataaggtcttagcgttgtctgcattgttctaga

SEQ ID NO: 638264 - DNA, 187 bp, Homo sapiens
cttgtggagatatcattgtgtatcattgcaatagtattacattgtgagagtgtgtgtgtgtcattgtgacaacatggatgaacctaaaggacattatattatgcaaagtaagctaagcacagagagacaaatactgcatttctcactagtgtggaatctaagaaagttgaccccacagagagagcgt

SEQ ID NO: 638265 - DNA, 319 bp, Homo sapiens
gctaaataagatgcaaaagcttagatctgaatcccaatcaatatgacttctcagctaaagcctgtatggtttgttttgtttgaggttaagtctcactctgtcgcccaggctggagttcggtggcatgatcataactcactgcaacctcaaacttctggcctcaagaagttcctcccacctcagcctcccaaatagctgggactacaggtgtatgacaccatgcctggctaatttttatttttaagttttcagtagagacaaggttttgctaagttgcccgccaatcgaagcgatccgcgccccactcaccaaccatggg

SEQ ID NO: 638266 - DNA, 89 bp, Homo sapiens
agaaggagcgcttgaagccaggagttggaagctgcagtaatccgtgatcggaccgttgcactctagcctgggcaacataacgtcctttg

SEQ ID NO: 638267 - DNA, 554 bp, Homo sapiens
ggcctggcagggtggttcatggttgtaatctcagtacttccggatggccagggtgtggggcttcatgatgaccgtggtccaagaggccttctgtagaggcgcatggttcctggacagcccgcaggcttgtctgtgggacaggggccgtgccgtcactttctcatcattccatggggtgtgtctgccttgggccaactctgcgatggacaggcctggctggggacagtccgtgactctgtccatccctcctgcccctttcaccagacccagctctagtgtctgtgtctgaattgtggatcgtgcagtccatggtcaattgtgcgcacatgtggaatcttgcacggcatagttaatattggccctatatcttgacgcgaggggcttgcacgtgcacaagggcaggccagtgttgcgcattttccttacagatataaagggatcatttaaacaaactcaacgacgtcttatatgaacacacacatctgtggggatggcaacctccccaggagcaccccatcgggtcacacatctctacggtcacttggtgaccgaac

SEQ ID NO: 638268 - DNA, 1179 bp, Homo sapiens
  misc_feature (175)..(175): n is a, c, g, or t
agcggaggggatgccgaattgtgcgggcgcggggaattatgggggtgggggctgggagggtctctcacagtggggctccgatgcccggagtaggatctaggcagggccgaattcctgtccctccgagttagtcatgtgccactcggtgctggcgtgagaccctctgcagccctcntggcccaggtgcccggcgttggtcccaccggtcgaggcaccttctggaggtctacgtgggatgggcgttgcagcgcatgccgctagggctgagcgagggaagcatcgcggcaggaacgaagggagtgaatcaggactgaccatgacgtgagctgcctagccagctggtagtgacagtggtgactaactcgccccgtgccgtgagcgagggcttgatgcagccgtggcgcgtccgctgggggcgcgcagaagattaacctttggcgttggcccactggcacgtcccccggaggtccccgctctctcatgccgtccagggctccgcgactgagagagagcgttggcgcttcggagtactttgcgtgaggggtgactctgaggcgttgtgacgagcggagccgagaccgagcctgctttgcgtacgctatgtgcgccagtcgttgccgatttccgggaggccgcggacccccgggtccggaggagggcccaaggcgttgggttgcaaaccactggtcaaccaattccttgggctaggtaatccgcgtttcgggacgttgggggaaagccaaaataggggccggtccagaggagaggttggacaccagttgccttgtggtaggactcccgagcacgacactaaggtttcgattgctaccttgcatcgacagggttgggacacggaagtaagaaacagcttactaattcccaagagggccacaccctagaggatatgcgtacaacgtgtggatacctccctataatactatctaggagaaacagcttgaagtgcggtaaacgtatcggcggacgcaggaatagttcgagtacaaccattggtttggaggaacttctcgcacaaagttataccttgggggtaaaccaggagagcccacacgagtttcgagacagaaacagctcggggattgtcccccgcgagataaggcagttgtgcacctctcccccggaaggccgacaggagagttccccggggtgaccactctcgag

SEQ ID NO: 638269 - DNA, 104 bp, Homo sapiens
ttcgattggcgggaacttatccatctgtttttggccaaccttgatgagacctgattttgaaaaactgacactgctgaatgaatgtttcaacatacagattgatg

SEQ ID NO: 638270 - DNA, 367 bp, Homo sapiens
gcctgctgcccttttccctttgggggtgtgggtaagaagtttccagcttgtgtgcagcatttaaaatcccccttaaggccggggccagtggttcccccctttattcccagccctttgggagggccaaacgggtgggttcccttggggtcgggggttcaaagaccagcctgggccaccatggtgaacccccccttttttttaaaatacgaaatttagccgggggtgggtggtttgtgcctgtattcccagctactgggggggttggggcaaaagatttgttttaacccggggggcaggggttgcagtgagccaagtttgtgcccttgccttccccccttggggggggggtgttttttccttcccccca

SEQ ID NO: 638271 - DNA, 636 bp, Homo sapiens
cggacgccgtgggtcgacccacgcgtccgaaaaaaaaaaaaaaaaaaaaggaaaaggaaaaagattaaaaaaaaaaaaaaaaaaaaaaaaaaaaaaaaaaggggggcccccaaaaaaaaacccacaaggggcccaaaaaaaaacaaaacccacttgggaaaaaagggggcgccccaaaaagagacgcggccagaagtaataaacgaccaagagcacggccacgcgttatcaccacagcgcgacggggagaacacaagtgaccacaggggaagtcctgggcaacaagagccccttcaatccggggggcgagcgacaagtggagacacactaccaacacaacaaagtgaaagcgcccaaggagcaaacacaagagattcaaggggttatagaggggataccacaacagcgtccaatagaacaggagctcacaagcacaaaatgcggccactagcggagaatcaataatcaattgaacgccacttatctttctacccgcgcgcgcactccaccgaaacgaaaccacaccaaccagacgaaggccgagccaacagaccgacagcaaccacagaacagacaaatcaatacggacaacacacagcgaccaacacgacaacacgcgcaccctccaacgtcgac

SEQ ID NO: 638272 - DNA, 123 bp, Homo sapiens
actgctgccttatcttctctggatatctcacgtagctgtctttagctcgtgatgtgtcgtggccaaccacatgtcgatgaaagcgcatcctttggtcagatttttctctcacccaaagcaggt

SEQ ID NO: 638273 - DNA, 81 bp, Homo sapiens
taggtaggcacagaaaaaactcttctagtggtatgattaagaagggtataatcaagtgtttccctctcctcaatattgaca

SEQ ID NO: 638274 - DNA, 1113 bp, Homo sapiens
  misc_feature (1)..(1): n is a, c, g, or t
  misc_feature (993)..(993): n is a, c, g, or t
ntcgcagttgttgtctcctgcagcggttcttcttgtctgtcggtcgttcctgttttgtggctctttttcggtgtcctcgtttctcgtgtgattccgggtcgtttcttgtggtgcgttcctcacgtgttgggtgccttaacctgtttctaacacctcctgttgggtgccccaaatttgcccgtgttggtgtgggtacattccccccgccacagtgattctcccctctctaacttcggggactctcttccctctgctgggaaacttctgggctgtctcctgggatggcccctgaggacccctgcctcctcccggccctttacatctcctggccacagattgccctggagcccctgtgcccctgacttgctgctctccaggttcccgatcccgagcccgtgccccagctggacatctgctcccgagtgcacatccgcaagtcgctggactccccgggccacccacaccgaggagcccgaaggcccacagaggcccagtggcatgcccccaaggagactccggagagtcctcaggtgagggctagccccccccaggacccccagccccaggcccccaggaccagcccccaggcccaggctccccaggacccagccgggccagagactgcgccattagggttggaacttgggccacccatgaagcacccagaaggcccacccggccacccccgctttctggccttccacggacacctgaccacacccctgtggggtgtgttctagggaccttatggggaaccctcacttctcacgccgccacggtggagcacccccgttcccccaatgcaccaggctgacccgccacccacccccagggggacccccgccagccaccagccccagcccccaggtgggcccgaaggtgacccccggcccctcttttgcctcccgtccatccggctggtccagctgtggtccccggtgcctccgaggcccagatctctatgggggccagtgcccagatcctgagagccgnctgagacgctttcccggagccgaccgaaggggactcggagctcccagcctgcccgacccctcgccacgcctgtgctttgcccccccctttccatagatggaacttgcttgctctttttta

SEQ ID NO: 638275 - DNA, 176 bp, Homo sapiens
aggttccagacgaaggcaggaggcagcatacttagttttatttcaaacaaacatggctggaggtgctggcaggacaggcctggaggagaatgaaaatggcctagtggagctggtgcccaggaccagggcacaggaggggcactgtggccaacatgttcatctcagaggagcaggag

SEQ ID NO: 638276 - DNA, 100 bp, Homo sapiens
gcggccgcctactactactactgctcgaattcaagcttctaacgatgtacggggacatgttcccttcttcttagcaccacaaataatcaaaacccaaaaa

SEQ ID NO: 638277 - DNA, 314 bp, Homo sapiens
ctagcaggatccttatggctacctgctgaggtgaacgaagaggatagcgggcgagatggagctggggctgaggaagcagacgcacaacaatgccgtggttaaagatgcttgcctccttcgtccgggagaactcccgacggggaccgcagaatggttgacttcttaggccctgggatcttgggagtgaaccaaatttcccggtgtgcttgcttgggtgacaaattccggtaagtggggaaacaacgaagaaacgggtggacaattgcacaaacaaaggatctaacggccatttccctatttggaaactacattgg

SEQ ID NO: 638278 - DNA, 459 bp, Homo sapiens
ggctctgctgtatcccagcacgttgggaagccaaggtgggtggagcacctgaggtcaagagtttgagaccagcctggccaacatggtgaaacctggtctctactaaaaatacaaaaattagccgggtgtggtggcgggtgcctgtaattccagctactagggaggctgaggcaggagaattgcttgaacccaggaggtggaggttgcagtgagccgagatcatgccactgcactccagcttggaggacagagcaagactccatctcagaaaaaaaaaaaaaaaagatttttttaaaaatttggggcaaaaaattttttaactcttgaaggtgaaagggaagggaaaaccagccaagggtcagtgaggtaggaggaaacacacgcatgttgggttcctatcggatgtcaagagaaacacactttgttccaggaaggagggcaccgttgaaccatggggga

SEQ ID NO: 638279 - DNA, 246 bp, Homo sapiens
  misc_feature (103)..(103): n is a, c, g, or t
  misc_feature (114)..(114): n is a, c, g, or t
  misc_feature (119)..(119): n is a, c, g, or t
  misc_feature (123)..(123): n is a, c, g, or t
  misc_feature (132)..(132): n is a, c, g, or t
  misc_feature (143)..(143): n is a, c, g, or t
  misc_feature (162)..(162): n is a, c, g, or t
  misc_feature (189)..(189): n is a, c, g, or t
  misc_feature (202)..(202): n is a, c, g, or t
  misc_feature (206)..(207): n is a, c, g, or t
  misc_feature (218)..(218): n is a, c, g, or t
  misc_feature (225)..(225): n is a, c, g, or t
  misc_feature (243)..(243): n is a, c, g, or t
atttggaatgaacccaaaagatagcggaaagttgggtccattccaaatagttttgtgccattgaaaaacttgaccttcaaaaaaatttgtttttcagaatagnacacaataggncagtnactnacagttgtnaaaaaggaagngaatcattaaaggaaaagnaaaaagattttaagaccgcttgaaatncaattatcaaganacgnncctaaaacacnctatggntttgactttgttattgancca

SEQ ID NO: 638280 - DNA, 750 bp, Homo sapiens
ccgtcctcgtttttatttcattccggggctgcgttccctttaattacctggcgcgtggctgacacattaccaccaggggctcgacagcgactgcaggcccgaaggcagcacacccgcaaaaagtagcctttgtcccctgtccctgtaccccccaccccttccctaaatctaggaccttaggacggtgctcgaaagagcctataggaccctataccagactagcgtagaagcaaaccataccccaggatctactaggctatacagcacgcacagaggggcaggtaggcagaccctagggagccctattaccctatactaggacggcaagcacagagcgctcagaggaacggggaaagcgaagatagcaggagaggaccaaagcccagggacctactagcttagaagcagttaccactaggggagagctggagaactaaaggacctagtacatacgtgtaccgctagccctgacctcccgctatagcgcaccctataggcaaggcgccaccttccaccttatccccgagaagccgacgtacagctaggaggggagacaggataccagcccgaactggatacggaaggtagtagcaacctgatgggatttagggaaatgggttatccctaaagctttatccttgcttaggctaagctagtgagaagtggatacatatcctctggtaccttctggagactctgtaccccatatcttgctgctggtccctcaccggttcttgcaggatccctcct

SEQ ID NO: 638281 - DNA, 407 bp, Homo sapiens
tgggggcctgttccccccctctttccaaaactgggtttggcggggccgtttctccgcgccccctggccctttccccttaacttggaatgctttttgtttgttcggcctgcccccagcccctggccccaaaacccccggggcaacggttttccccgcctgccctggtcaggccctgccccccaacctttttttttcccgaggaaggttgggaggtggaggcccccccttcccccccaattgccccctcccccccccaagttcccaaccccgggttttcttaaagcccccccccccccccgggcccctggggggttgggttccccctttccttttgggcccgggcaaggggggggttttttttagggcggggggggtttttcccttaaaaaaacccccggccccgttga

SEQ ID NO: 638282 - DNA, 1253 bp, Homo sapiens
atgaaggtgctccttccgccgccctcatcgcgtgggtcctgtcttcttcctgctggctgccgggaccttctgtcggccgatgagacagaagaatggggcccaaagtcaccgtcaaggtgtatttatgacctacgcaattggagatgaagatgtaggccgggatgatctttgtgtctcttgcgggagaaggactgttccagatagacagctggagtaagtctatgtgtgagccatttagctaacagagtagcagacacggattttagagctaacatagaaaacacgctaatattccaatcgatgtagatctaagggcacatttgcagtgaatcactacgggactgtgcacggacttcgaaccaagtgggacgcattgtgcaactaagagaagcgagaacgacgccacttcgtaaaccgggtttgacggcagccctttccccccggaattgaacggaatctcttccaataaaagcattgcgataggtcaacccgttaaaccgaggtgtccccgttagggcgttgaggggttggatggccctaacttgtggccccaaaactgggcgaagaggccataagacggtacccagctcaaaagtctggcggcgattcaccccacattcttttgctttgcccatttacacagacggaacaccacggttccggaaatggaaagccagaggtcaccctttgtggggacctttgaggtgcaaacttgagatcaccaacacaggctgggcacacatctttgacttagcgcgcggtggcatttattctgaggtgtgccccaaagacgagatctttctgcatttttagagacacacgtcgagagcccccaacttgcggggccaggcaggtctctgggcgacattggtcccggcgcgtaacacatacgagaggtgacttgcgcgtgcactaggagaaggaagccagactctcccacaaacgacgacgaaagaccgataatggccacagcgccacagggaagatccccaggacggcaggtaaaccttctcacaaattaagcgggcccccaccccgtctgcttcagccaaggccggggagctttgtgtctttgggctaagagtttccgataattctcaagggttgcggaatgatggaacccatttggctccatgtgtgggtcccccaacgatttatggcgtaactttgccccggcaaaaggtcgcggcgttcgggcgcgtcagcagtgcaacacaacaggggtcccacgccccgtattatataatggtggc

SEQ ID NO: 638283 - DNA, 392 bp, Homo sapiens
  misc_feature (199)..(199): n is a, c, g, or t
  misc_feature (333)..(333): n is a, c, g, or t
atgtttactttacggaatgacatctttttcttctgtcatataaatattagtttttaacccctttcatctggctggctcccacttgcaattcaaaggtcaaggtagcctcctcaaaactccgcggcgaggtgcgcgtcccttgagcttccacatctgggcctccctctcccagggctaatcgcgctgtcatgtatttctngagagatgtcgcatgtcgcccctggcgcgctgtgggctcttccaagccaacagcatggtcttggtaccaaccgtgtcctcggtctgctgtactttcaagtgatcggaaagtgatgcgacgatccggggatcccnccaggctcagagatacccctggttagggctccgacaagtcgttcccctcaaaggctctc

SEQ ID NO: 638284 - DNA, 792 bp, Homo sapiens
  misc_feature (120)..(121): n is a, c, g, or t
  misc_feature (129)..(129): n is a, c, g, or t
  misc_feature (133)..(133): n is a, c, g, or t
  misc_feature (138)..(138): n is a, c, g, or t
  misc_feature (140)..(140): n is a, c, g, or t
  misc_feature (145)..(145): n is a, c, g, or t
  misc_feature (152)..(152): n is a, c, g, or t
  misc_feature (165)..(165): n is a, c, g, or t
  misc_feature (374)..(374): n is a, c, g, or t
cggacgcgtgggctccttacaactagacactgacactgtgtggcatgtccattcattagatcttacattcgggaggactataaatggtccccttgataaaaaaaaaaaaaaaaagctttnncagagaantgtntttcncngaaancaaaggntctctgttctaanagctgggcattgagataatttgcctctgcacggactctgggttgagaattatgccatggttacagatacagggggatttccatgcccagcaaatctggctgggcagaagcccgtgagcattttcctcccaagggctggctgtaacggagttgaaagccagttctaagatgtctggcccccaagggccaggtttggggcagtgggcctcnagtccactggctcgtggctcggcgtcaacaacaggtttttgggccccatggaacttatgggcctacctcattccatggcctggagatgtgaacgctcacagcactgggagccccaatctgtgtccacggggaaactgattccacgcaacaagagcacacttctctggcctcgggtttaggagcctcagggaaaagcctaaaccctctcttcagaacacgtgggcgccgtggaaacattcaggaacatagcagccaacgggaaattcgcgaatttcacaatttccacacaggtttattgaactttagccatagcgggccacacgtattaatacagactccttaaaaaggcccatttcagaacacaccatagggtcagaccaatatgtgtgaaactctaacgggaagcactggtttataa

SEQ ID NO: 638285 - DNA, 285 bp, Homo sapiens
gactgtccgggagccttaccctcaaagtgcttagctgtgaacccagcagtgtctgggcctccagtgtggactgcagctgcggaacttcagttggagcctgccttagcccttcctgccatgaaacagaagccaaaccctaccatgctcagaaggcaatagccacgttaagcaatccaacaaccagtgttccagcaacagcatcagcagcccatcaattcatgccatgcacccacattcacagtctctttcgcgcatcatcgtcaggcaggccccttcaacccacct

SEQ ID NO: 638286 - DNA, 115 bp, Homo sapiens
ggatcacttgagcccagttgttcaagaccagcctgggcaacacacgtgaaaccccatcatctacaaaacagaataaagaaaacttagcctatgtgtctgtggcatgatgtgactg

SEQ ID NO: 638287 - DNA, 415 bp, Homo sapiens
  misc_feature (32)..(32): n is a, c, g, or t
  misc_feature (77)..(77): n is a, c, g, or t
  misc_feature (253)..(253): n is a, c, g, or t
  misc_feature (275)..(275): n is a, c, g, or t
  misc_feature (327)..(327): n is a, c, g, or t
  misc_feature (354)..(355): n is a, c, g, or t
  misc_feature (404)..(404): n is a, c, g, or t
ttttcagtagagatgaggtttcaccatcaggngatccacccgcctcggcctcccagtgttaggattacaggcgttanactgcacccggcccaccttaactttacataggacaagagttccaaacatacaaactgatcacgaagttaacatatacacctcagacaggaaactggtagccaacagcctgcaagttatctactagatgtttagatgtttccaaacaagctaggtgtcatcgtgtattaagtgtggntgttagttctgctgctgaggtngcagcatcacctatttccacaccagttacagctccctgggtgccttaatacnggcacccggcagaggcatgttgattanncagattctgacttggtccctgaagctgcttctctggggttgttatggcnatagctgccaa

SEQ ID NO: 638288 - DNA, 341 bp, Homo sapiens
tcatgtatgaaccctctcggtctccatatctctatccaaagcgttcagactctacctgttattcacagtgtgctacttcctatccaataaccatcacatagtgcaagcattcttgtgtaggaaaggccattgatatcaaagtacctgcttcctcatgctgtgcgctctctctgatataccctctacccttcatataccatccaatttcatatctcctcagcatggtgtcgtgcaagcttgtgccgcttactgtggcgacatagcggttcgaggcacttaaggtgactctcctggtgtctcccccagtgcgacttctacatggagctccactgacacctgag

SEQ ID NO: 638289 - DNA, 306 bp, Homo sapiens
tgaggatcccccaagctatctagtgacagcgatatataattaatataaccatattatatgtttggtgatatattgaactatgctcactcactccttatgactctacgtgcgctcaccttctagtatattgggagaaacgcatattcacagcttaacttctgtgatgcagaatactgaacatttctaaaccaagagtctaggacttcatatgcagaatgaatggggggattttataccttttagaagattcaaacagtattttttatatcagtctgaagttagaaactagaaattgttttgttaaaa

SEQ ID NO: 638290 - DNA, 136 bp, Homo sapiens
  misc_feature (66)..(66): n is a, c, g, or t
ttgtgcccagaacaggtgtgtgtgtcgctgtcatcagagcaggcgtgtggtgtgcgctgatactgntactatggaggctaggtgggcatcacttgagccgggagttgaggctgagtgagctatatcatgcactgtg

SEQ ID NO: 638291 - DNA, 726 bp, Homo sapiens
accgggctgtaggaattcggcacgagacgagatattttttgtttttttttacaaaaagtcaccatggctgattacgtggcgagcaatcttggttactgagaatagaagtggcgcggaatactaagctctatactgggcttgtggattaaacctatataacaaaagtgaaaaggggttatggtctaagagactcacaactattttagaggagtccaagttcacatggtggttacctttaagtttatcacactgtaatggctgaacaggcttgcagatacagacatgaacaatgcgccgagaatctggtattatcaaggactgggtgtgaaaggcctcattagtatatgtacagagctttaatgccctatgcttatttaaagaaagtgtgtttgttatttattgcgcaacttacaaataatttctcagagatgtattcgcttttaaataggaacttataccaaactttctaacccttggcgagagaacacatggaaaaaagcccaagctatatttgtcaatcggtttttataaggcccacaaaatcagtaactttttcgtggcaatgtatctcgcgcgcgaatttgggacgaggggacccttagttatgcctgaagtatgtggactaatggatgccgggacacctacactacaccggctcgcacgtaactggagaagtttcatgttgcctgtggaggggggtcttccgttccttgccagggacctagg

SEQ ID NO: 638292 - DNA, 977 bp, Homo sapiens
ggctaggaatgcttcgcccgtgctaactcgcagccatgcactgaggctgagtgtgacactcgcaaaggcctatgccccttgccgagttgccacctcaccaagaagctactggcaccgacgctccgtcagacatgtacacgtagtatgcagcttcggcataaaggtagcctagatggagtgtcctccagcacacgcctcacataggggtgcggtctcgtcgagctgctattcccgtcgatggcttggtctgactgctccggagccctagcatcggcaggtagtccattccatcgccccacctgtcccgcgttgctagttttggaaatgattggcgattttcgttgcccccctatccgatgtccttgatcgactgcttcctatacgtcaggtgctccgtcgtggtgcaagtacggtctcggatggcgagtcggtccagggccctagtccatcgtggcatgctctcatagtcgcacctgagtccaaaacgcacaaggcctcggactaagtcttggacaaactgatcgagaattcctggattgcgcgagtcctacgtcgagttccgtagtaacgaataaaggcttcgtgttacatctcaagaccatgctggggctctggccatgtgctcgcacttcgtcgagggtttcgcccgctcgtgacggcttggggatttcaatatctatcgtaggtgtttagtatttgatacgtccttacttccacgtgatcatcttgatttggtggattaaagaacgttgtctcgaatgggacttgcgatcttgccgtgcacttctgggacgtgggaagcccaggacctggttgcactctgttccgctccatccccctggttccaaatcaacacttgacaacagtttctcttctggatttggctagtctggccaacttctggtccaaatccccaaagcagaaaaacacccgtggatgcgaggagattctggggccaccacgtgacaaaaagtcgg

SEQ ID NO: 638293 - DNA, 294 bp, Homo sapiens
  misc_feature (282)..(282): n is a, c, g, or t
tccttacagctatgcagagaatagccactactcattacctccaaagctagtaacatatcatctcctgccggaatattacaactgtgctaaatgcaattttcaggtattttctgttgcaagcattttgaaaccactactccacccttccttcaatttgtggaagatgacatacaaagatagccaccatcaattcctctctcggtacatgcatgccactctaccaactaaagatggagtctatttccatatctcccctgaatctgagctagcctgatgactggnctcacgaattcc

SEQ ID NO: 638294 - DNA, 163 bp, Homo sapiens
atcagaagagagaaggagagaagtgaggcagaggggagaaaaaatcagtagaaggaaaatggagaattcaggagacaggaggtaagcatgttagagtgaggacagggtgaaaagtaaatccgtgccaaaggtgaaggttatgcttcctgggcaaggaacagcc

SEQ ID NO: 638295 - DNA, 2331 bp, Homo sapiens
caataaccccagcattggagagagtggagcagcccttcaagaagttccaacctctgcccaggactggttttaccaacttcactaggcttagaatcgtaggaagtctatttgggacttgcgagtctcacgtattcctgcctaaatgtttatggatacctgtttagagctgaaatcttttcagctcccataatatgagggaattaggtctcaaagaagatcatgtattttgatcagaccttatagctgagcagtggaaagaaaaaaaatcagtgtgagatctcccagggttccgcagagttggcttccttagtccaactggcagcctatcctgggaatattgcctggggagagaggttagttgcttttcctggtgctaggaactgaatggttttacatattgatcaatgaaaatacttatttggcctacaataggtgcaaaaatactgctaattactaacagtatctcttctttgctgcgtgccagacactccactgggcattatgcagttaatatgtaccatgaatttcccgtggttagcaatgatgtcaggcatagaaaagacatgaaattgtgatgtcaaatgaataaactggaaaaaggaatttcttgaattttctccagctgtcctaagaatgtatctatactttgatcctggcctaccttttcaacatctaaactttattcccccaagcttctagatattcaaagttaagtattaaataaaatcagtaaatatatacaagcttgtttggccattctgaataaggttatatttccaccacacaatctccaaattctctagcagaagggatcagtatgttatagataccccctttccttccctccctggcaagccaccacatctgttatgggtactcaatgcagtggctgcacctgggcctcactcattaagcagttgttgattgagtgactgaattgaatgcctgatgagctcgcaagtaagattcagactgtgcctgcaaactaataggatccctctgctttttattcactactgctgaggtagatctcaggccagcctgaagtttaggtctactgagaaataataagcctcaaaaatcgagctttgcttcacccagtctcccagtaaacactaagaaatgttcacattatttacacatcctagactgcctgtcttatggaccaaatgtttgtgttctccccgcaatttatacattggaatcctaaccctcaatgtaatagcattaggtgctggggtctttgggaggtgattggctaatggacctggagccctcatgatgggatgagtccccttatcagaagagacctgagaaggcttgcttcctctccctgtgctcttcatgatgtgaagacacaagaagacagccatctgtgggccaggaagaggtcctcactggaacccaaccatgctggcaccccaatcttgaatttctagcttcaagaacttgggaaataaatgtaagccagccagcttatggatttgttacagcagcctaagctaagtcagagtctctagaacagctggtctggggcagcggtgaagggaggtgggtgggcatatgaccctgccctgcacatgaatggcaaaggcaactggagagcctctcccttttggtgagatccccagtccacaagggcatgttcatccatagctttacttcccgaagcaaattctggttcctggggcctgtgcctccatagatggcatgatctgcagcctcctgtggtaatttaccctcttcctaaatttctgagtcttcacatttaagcaatcctagttagatatccctcctacctgtatcccatggctgtctttcagtcacattacagactcattgtgatgacccatgtagggacaatgtgatttcagaaacatggcctcatttgattttaatgtaaatataaatcagtgaagcagaaaaggagaatctccagaaaaacaagggatgaggctgtacagcaagttaaagtggaatcagaacccaactgtagtccattatttgtttcaatcctgctcttttctaccatatcacccagtttccaaatcgttcagcaaattgccatggtcaatgggattaacctttcccttttattctcaggaaatctcccttgtccattttgcaagactgtgtgattctttctactgttacaaggaataaaagccttcctaaaaaggtctttggtgcctttattattttacggatcatttctgagggaattattgaacttcattatgtaccaccccttggttcaccttgccactgcctagacagagccatttatccagacaggagattgcaatggagaagagaattcatgcagactgg

SEQ ID NO: 638296 - DNA, 302 bp, Homo sapiens
gcgcagtgtggtggattcagacacactccacctccagcacgcgacttctcaggacgacgaatcttctcaatgggaaaacggctgagctccagccaccccgtcagtcactgatctaggtcgacatcttccatgagctgacatcgacaactgcacacagggtctataacgtgttccatacattacactaggtgggctcatggtggtattagttcgaaacaaagcacctgtcctctgacaatggtcgaacttgacgtaagcattaaggtgactctgtcatgctgcgtccccaccagggaggtgca

SEQ ID NO: 638297 - DNA, 273 bp, Homo sapiens
  misc_feature (52)..(52): n is a, c, g, or t
  misc_feature (72)..(72): n is a, c, g, or t
  misc_feature (90)..(90): n is a, c, g, or t
  misc_feature (93)..(93): n is a, c, g, or t
  misc_feature (115)..(115): n is a, c, g, or t
  misc_feature (127)..(127): n is a, c, g, or t
  misc_feature (148)..(148): n is a, c, g, or t
  misc_feature (183)..(183): n is a, c, g, or t
  misc_feature (196)..(196): n is a, c, g, or t
  misc_feature (228)..(228): n is a, c, g, or t
  misc_feature (232)..(232): n is a, c, g, or t
aattttttaaccatcagccatgtgctgctatttatccggcttccaggctttntcccttacctgagagattanggactccacagctgcctngcngtagggcctggctgagagacancggtagcagcangcggcaggctgttaaacgacnggctgcccccggagcctggagcaggtggaaacacngtggaagaaaccngccacagccctgctttacccggctcacctctncggnattccagcacgcggctgatgcaggagaatctccagcaccaa

SEQ ID NO: 638298 - DNA, 271 bp, Homo sapiens
  misc_feature (42)..(42): n is a, c, g, or t
tgggttctgctgagcaaaaaacagaaaaacaaactttgtggntagcagtgcgtgcaggcaaaagaatcagctcataagctggcagcagagatctatatatgcaagtacagacatttgtaagactctcatgctactggggagccaggttatgtgccccaaagacacccagttcagggggaaaggggacaggccagatagaatgtgcagtgtgagttggctactgttgactgcattttggaatgctatcacagtaaggaggaaagaactggct

SEQ ID NO: 638299 - DNA, 2173 bp, Homo sapiens
caataaccccagcattggagagagtggagcagcccttcaagaagttccaacctctgcccaggactggttttaccaacttcactaggcttagaatcgtaggaagtctatttgggacttgcgagtctcacgtattcctgcctaaatgtttatggatacctgtttagagctgaaatcttttcagctcccataatatgagggaattaggtctcaaagaagatcatgtattttgatcagaccttatagctgagcagtggaaagaaaaaaaatcagtgtgagatctcccagggttccgcagagttggcttccttagtccaactggcagcctatcctgggaatattgcctggggagagaggttagttgcttttcctggtgctaggaactgaatggttttacatattgatcaatgaaaatacttatttggcctacaataggtgcaaaaatactgctaattactaacagtatctcttctttgctgcgtgccagacactccactgggcattatgcagttaatatgtaccatgaatttcccgtggttagcaatgatgtcaggcatagaaaagacatgaaattgtgatgtcaaatgaataaactggaaaaaggaatttcttgaattttctccagctgtcctaagaatgtatctatactttgatcctggcctaccttttcaacatctaaactttattcccccaagcttctagatattcaaagttaagtattaaataaaatcagtaaatatatacaagcttgtttggccattctgaataaggttatatttccaccacacaatctccaaattctctagcagaagggatcagtatgttatagataccccctttccttccctccctggcaagccaccacatctgttatgggtactcaatgcagtggctgcacctgggcctcactcattaagcagttgttgattgagtgactgaattgaatgcctgatgagctcgcaagtaagattcagactgtgcctgcaaactaataggatccctctgctttttattcactactgctgaggtagatctcaggccagcctgaagtttaggtctactgagaaataataagcctcaaaaatcgagctttgcttcacccagtctcccagtaaacactaagaaatgttcacattatttacacatcctagactgcctgtcttatggaccaaatgtttgtgttctccccgcaatttatacattggaatcctaaccctcaatgtaatagcattaggtgctggggtctttgggaggtgattggctaatggacctggagccctcatgatgggatgagtccccttatcagaagagacctgagaaggcttgcttcctctccctgtgctcttcatgatgtgaagacacaagaagacagccatctgtgggccaggaagaggtcctcactggaacccaaccatgctggcaccccaatcttgaatttctagcttcaagaacttgggaaataaatgtaagccagccagcttatggatttgttacagcagcctaagctaagtcagagtctctagaacagctggtctggggcagcggtgaagggaggtgggtgggcatatgaccctgccctgcacatgaatggcaaaggcaactggagagcctctcccttttggtgagatccccagtccacaagggcatgttcatccatagctttacttcccgaagcaaattctggttcctggggcctgtgcctccatagatggcatgatctgcagcctcctgtggtaatttaccctcttcctaaatttctgagtcttcacatttaagcaatcctagttagatatccctcctacctgtatcccatggctgtctttcagtcacattacagactcattgtgatgacccatgtagggacaatgtgatttcagaaacatggcctcatttgattttaatgtaaatataaatcagtgaagcagaaaaggagaatctccagaaaaacaagggatgaggctgtacagcaagttaaagtggaatcagaacccaactgtagtccattatttgtttcaatcctgctcttttctaccatatcacccagtttccaaatcgttcagcaaattgccatggtcaatgggattaacctttcccttttattctcaggaaatctcccttgtccattttgcaagactgtgtgattctttctactgttacaaggaataaaagccttcct

SEQ ID NO: 638300 - DNA, 582 bp, Homo sapiens
  misc_feature (176)..(176): n is a, c, g, or t
cgggaatattataaaacgtaaacggccaagctgtgccgtcaagcgaagatgtctgccgtaggtcagagttataccattcaccgtggaacacgagatacacgccaggctacgcagcagcccaagtcaggagtaacgcttcatccccgaaagtcgaggaagcagtcatccaaagtagngccatgcattccagctgggacaacaagagcgaaactccatctcaaaacaaaccaaagcaaaataaaccaaaccaaaaaaaaaaacccaactaaaatgtctaaagaagtcctaaagcttcgttggggctggacgcagtggctcacgcctgtaatcccagcactttggcaggccgaggtgggtggatcacctgaggtcaggagtttgagaccagcctggccaacatggtgaaaccccatctctactaaaaatacaaaaattagccaggcatagtggcatgtacctgtaatcccagctactctggaggctcaggcaggagaatctcctgaacccggaaggtggaggttgcagttaactgagatcacgccactgcactccagcctgggcgacagatcgagattccatctc

SEQ ID NO: 638301 - DNA, 250 bp, Homo sapiens
atcagatattaagtctatcgattaggtatacagcacagagactttcttcacctattgtgttaacacattaggctcactctcactgaagagaggatcaatcatgacattaccttaccagcgacaggcaggcaacctgaatgtgcatcgatatggtacaacgtctgtagcgggattacaatacctgaatctttacttagctggttcaagtaaagccagcagaggacgtcaccattgcaactcttaccggtcg

SEQ ID NO: 638302 - DNA, 103 bp, Homo sapiens
  misc_feature (28)..(28): n is a, c, g, or t
  misc_feature (66)..(66): n is a, c, g, or t
  misc_feature (85)..(85): n is a, c, g, or t
ttctttctggagtaatgtaaatgttctnaaattaattgtgatgactgcataaatctgaatatactnaaaatcattaaactgtacnctttaaatgggaaaaaaa

SEQ ID NO: 638303 - DNA, 417 bp, Homo sapiens
  misc_feature (16)..(16): n is a, c, g, or t
  misc_feature (42)..(42): n is a, c, g, or t
tcaaggaaggggatanccagacataaggcttgttgcaccccngccttggcattcacgttgtgtctgcatctgtcagaccccaggaccccagagctcctgtacccctggagagtgagcatctcagagccgtggtctcagccttgtcacaggtgggcacgtctgggtcttgggatgtcagaaggcattggtagggaacttggcctggttgcccctgaattcctcctccacctcctggtccatgacgcaagccctgcctgatagggccgccatcttttttcgggaagctcccgagctgtgggggaccaaagccctcagaggaccggcaggaaagccaggggatggatcagggtgaggccgggagggagagcgagggccttgtgtgcctgatctgtgtgaggggttgggggccgcacccac

SEQ ID NO: 638304 - DNA, 748 bp, Homo sapiens
attcggcacgatgggggaggtgcaagatgagcctgcactaccttttgtcacggttgctatggaaaagattaagagcccggatagcccttcctcctctgggggcctgggcatcagcaagtcggatggcagtggaaggtggagaaatggaatcctgctgggggctcaggaggcctgcccccgtgatgctgccgtgcactgcagatgtccttgatgaagagaatgaatggaagctgtctttctcaatggcaaaagggcatactgctgttattgtcagtgaggggtcagtagtttaaatgatgaaactctggggatcagcgtaaagtaaaccaacatactgcatgtaaattcctcattcttactgctgtgagaacaattgttaggagccaaaaacttcagagctttcaaagaactgtaatgagatagcacaatgcaggcaaaaagccagtgttaacggagcaagaaacttcccagttctgacattcacagcatgacctagagcatgcggattcccctctctgagtcactggtttctcacctgcaaaagaaagcggggacagggaaggaggaagaagcttcgagaggctggaacagttgagggagcgctgacacggtaaaggccactttgctcatcatcaccaggcgtgctgccgaaaatttccactctgtttactcccaagaccttactcctactatgtggagacacatttgaataaaaaattggcctcttttcaaagtcaaaattctgaaa

SEQ ID NO: 638305 - DNA, 368 bp, Homo sapiens
gattccttgaggtatcccctctgttagggagattagttattttgaaatggagtttcactcttgtttagcctggctgtaggtactgtgtcacgatctcgactcactagaatcctccacctcctgggttcagagtgattctcctgtcctcagacctccctagtaactgggattacccgcacctgccaccacacctggctaatttttatatttttattagagacagggtttcaccatgttggtgaggctggtctcgaactcctgacctcaggtgatccgcctgccttggccttccaaagtgttgggattacaggtgtgagctaccgtgcctggcctatttttttttagtataagaagtctttttagcaggt

SEQ ID NO: 638306 - DNA, 950 bp, Homo sapiens
  misc_feature (496)..(497): n is a, c, g, or t
  misc_feature (596)..(596): n is a, c, g, or t
  misc_feature (634)..(634): n is a, c, g, or t
  misc_feature (769)..(769): n is a, c, g, or t
  misc_feature (884)..(884): n is a, c, g, or t
  misc_feature (940)..(940): n is a, c, g, or t
cggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggagtggcggccgggctggtgccgctagtggtgcgggcgctggagctcttggaacaggctgccgtggggcccgccccggactcgctgcaggtgtcggcgcacgcggagcaggagctgcggcggctgcgggaggagaacgagcgcctccgcaggagctgcgcgcggggccacaggaggagcgcgcgctgctgcggcagctcaaggaggtcacggaccgacagcgggacgaactccgggcgcacaaccgcgacctgcggcaggcggcnnggagaccgaggcgttgcaggagcagctgcagcgcctcctgctggtgaacgctgagctgcggcacaagctggcggcatgcagacccagctgcgcgccgcnagggacccgcgagagggagcgccacagccctggcgaangccgactccgcaggctaaagagcgagcgcgggggcaggccgggcggcccgggcaccagcacggacaggagcccgaatggcgacccgccggcgcaggcgccccagggaaccctgaggacccggcggaggcgcgcanaggctcggggcgcccctcggaggcagggcagtgccgcttcagtcgggaggagtttgagcagatccttcaggagcggaatgaactcaaagccaaagtgttcctgctcaaggagganttggcctacttccagcgggagtgctcacagacaccgggtccccggccttctgctcnaggcatgaag

SEQ ID NO: 638307 - DNA, 1009 bp, Homo sapiens
attcggcacgatgggggaggtgcaagatgagcctgcactaccttttgtcacggttgctatggaaaagattaagagcccggatagcccttcctcctctgggggcctgggcatcagcaagtcggatggcagtggaaggtggagaaatggaatcctgctgggggctcaggaggcctgcccccgtgatgctgccgtgcactgcagatgtccttgatgaagagaatgaatggaagctgtctttctcaatggcaaaagggcatactgctgttattgtcagtgaggggtcagtagtttaaatgatgaaactctggggatcagcgtaaagtaaaccaacatactgcatgtaaattcctcattcttactgctgtgagaacaattgttaggagccaaaaacttcagagctttcaaagaactgtaatgagatagcacaatgcaggcaaaaagccagtgttaacggagcaagaaacttcccagttctgacattcacagcatgacctagagcatgcggattcccctctctgagtcactggtttctcacctgcaaaagaaagcggggtgcgtgtatttatgggagtagggtgggttttggctaagcacaggagtcatctgggtggcttcatacacagataaagggctcatcccaccaggtcgggcttttgaacccgaaatgtttggcgtgacggtgggggcacctattctgagaaactacctctccaggggttgcagtcacacagcccttgccaatcagtgtctgggaaccagggacctgatcatctctaaggtgcctccaagatccagcacttaattccattttaggacagggaaggaggaagaagcttcgagaggctggaacagttgagggagcgctgacacggtaaaggccactttgctcatcatcaccaggcgtgctgccgaaaatttccactctgtttactcccaagaccttactcctactatgtggagacacatttgaataaaaaattggcctcttttcaaagtcaaaattctgaaa

SEQ ID NO: 638308 - DNA, 715 bp, Homo sapiens
cggacgcgtgggtcgacccacgctgtcgccgtagagtcgtcggggtttcctgcttcatcagtgcttggacggaacccggcgctcgttccccaccccgagtccggccagcccatagaccaggcccatccgatcacctcattcaccgcaccctcggactgccccaagggcccccgccgccgctccagcgccagcgcagccacctgttctgccgccgccggacctctccttagtcagccgccatgacgaccgtgtccacctcgcaggtgcgccagaactaccaccacggacatcacgaggcctgccatcaaccgccagatcaacctggagctctacgccatacctacgtttacctcgtccatgtcttacatactttgaccgcgcacgatagtgagatacacagcacagaacttagccacaatacatattcttcaccaatctcatgaggagacgggaacccatagctgacacacacctgactgacctcctgcccacacccaaccgaccgtgagacccgcactctacccttcaggcatatccaagaacaccatacctgatcatgcacctcgccccacaaccgcacatgacctcgcactgcactcatgcactacaaatttgcccaaaacaaacgatgaactacaaccaaccccccgcacctcccaccaacctggccacttgcacccaacacaccccacaaacgatctaactaacaacgccc

SEQ ID NO: 638309 - DNA, 378 bp, Homo sapiens
ctactactactaaataaacggccgctcgacgccagcgacagatctcgggaatatccacgcgccgctggtacacccgcagcggttcgctgatgttgatccgatcatcaatgttctggtccagcagcagttgaatccgttcgcgactcaggctcatggcctcctccccggccggcacccagacaaactcgcaggccgcaaagatggcgtcatccgccacgtccatgccgaagtccgtcactgaagcggacgatgtactgggcggccttgtgattgaagccgacaaaacccttgagttggtcggcggcctggcagataagctcggatgtgatcgacatggtaaaccccgctttagagccacaaggctcagtcgacgcggcc

SEQ ID NO: 638310 - DNA, 337 bp, Homo sapiens
cgtgtaggggaactaagaagccacagaccatagagatagagtacaaggcgtggtaactagcatacacttagttaaccttggcaagacctaaccctctatgagtctcagcttatactcatctttaaatgggataatatttatcacatggaataactttgaagatagcctaattcagcattccatgacacagtcgtcactctacaacatgttgcgctgttattttccaccctaatgctaggcttaatgctgtgatctgtgtgctgcggggataagagaaaaatagcagaggtcctgctctctctgtcctcattcaggactacggaagtttgctaaggaa

SEQ ID NO: 638311 - DNA, 183 bp, Homo sapiens
gttaattgacccttagaaaattatatttttctgcttgcaaagtcttcatttaaaagagggaatttttaaaataattttattagtataattgctattccaaactccattttttaaaaaccaattttcatttatgggagatttttcacaaaatcgcacaaacagggattaagcaagatgaaagct

SEQ ID NO: 638312 - DNA, 757 bp, Homo sapiens
ccgctcctcccgggggggtgtaatcaagggcctttttgtgccgctagtctcctgtggaggcgcacaaccccgtgttggtgcgcccactcagtgaaccgcgggggggttaaccccctctggggtgtttttcttaccccggcgggggggatatatttttctccccgcggaagcaggctagtcgaccagtatggtggcctcttttttgggtgcaccacatgtaagaccacgtggttgtgtggcgcacaacagaacgggggggtggttgctccttgcgcgcgtagtattctccggcgcggttatttttcgctggccccgcgccggcgcgtttgcttgtctgcccccccccaaagtgtgggtttccccgccccgatcaaaccacagctgactggattggtgtgtgctttcgaccaccccctctcgtctgttttatccgtcggttgcgtcagttttatttttgtggggcgcgcggcgacgcgggggacaaggttgtgtcgccacttttctcctcccttctgagggggttcttctcccccccgggcggccctgctatgaacgaacccattttcttctttgtcaccccaccagccggtggtgtctccttctttttttgggcgcgcacacattttttttccgcccaccgagtttgatgatttgatcccccccccctccccccccccccccccctcttttttttttccccctttttccccccccttttttttcctcttttttcccctttttttttttatttttttta

SEQ ID NO: 638313 - DNA, 243 bp, Homo sapiens
caggtactccaggaaggacgaggtgtagagcatctaccactggtatgactttaccagctcgttgtatatcctggtcaacctctcagcgacctggagagattcgtcgagctcccgccgaagcttagcctgggaggggaagtaggtggaacagtccacagacaagatctcccggcacttgtcacactggtccttcatccgcaggcatgccgtggagttgtggcggatctcccggtacacagtcct

SEQ ID NO: 638314 - DNA, 354 bp, Homo sapiens
atccgcgctgatgatgcatggtgaaaccgggaaacatggcgaagccggtttcgccattgtttccctccaatctacctcccttcatgctgttgagccattgagttaatccacagaagatttctgtccagcaatagatgatgaccagactgcaattccctgtatagcttcaggacgttgaagttcacatagtgcttctaccaccattataatggttacttccaattcattcccctgtacaacgcattcagaatagttagtcagcctataccattatcacattattccctataaaatttaccactgatcacagtctgtgcctgcttaaagccaaatgtatttaactattattttcac

SEQ ID NO: 638315 - DNA, 181 bp, Homo sapiens
atgtatttgttacaacacacgtatctttgtaactagaaaataaagatttaaggccgtacgcagtggctcaagcctgtaatcccagcactttgggagcctgaggcgagcagatcacctgaggtcaggagtttgagaccagcctggccaacatggtgaaacccattctctactaaaaatacaa

SEQ ID NO: 638316 - DNA, 170 bp, Homo sapiens
  misc_feature (101)..(101): n is a, c, g, or t
ggcacgatgtgctgcgacttcatcgattgtccccctgatgatgagaagcaccacctcccacagagccgtgactcctaggccatcttctgcaccccactctntgtttccaataaagttatgtccttaaaaaaaaatgtgggttttttgttttttttttttttttttttttt

SEQ ID NO: 638317 - DNA, 942 bp, Homo sapiens
ggcccctgggctgggacagcccactgttccatgctgcccaagaaggctcagcacaggcacaaaccattgcccggcactggcccgtgctgcctgagaaggattggctacgggtcacatgaccatctgcccccacctgctcctgacgccatctacccactggaaggctcggctatcgggcaccaaccacagtctccaactgcaccccatgctgccgtgagaaggcactgcacggacaccccacaagatggccagactgtcccttacccggaggcagcatgcgaggcggctggaactctgctggccgttctgctgccctggtcttgagcaccactgggggcccttccccagtaatacttgatcccgcaggaccttaactcacgtgtgaagccaggagttccctaaaactcataaagaccattgatcccacggagtcctccaatgcaggcacataccgtgttgcatatcagtctcgacaactgcacgagcgaacattgtgcttgttcaaggagtcccggatcacacagggccctagtttccagatagtgaaaggcctgaaatatgatgctggaggtggaacattggcgaactaacccagagacaaacagaactgcgtctggatgactgtggagtaccaacccaaccgcacatgaagcagactctgagctgtactctgaagcactgggtcgtgcctggctccagcactacgaggtgccagtactccgaagtcattgacccgcctcttcagagaaccggcatgaacacacggggagcatgtccttgccgtaccgcgaggcaaaacagacagagacgcgcagggctaagaggaaggtgacgaccggtcagacgcagagatgaaggaccgaagtgagcgatgtcaagaagaaaacgtgagcccaaagacacggggcaaagagagcaagagagcaagacggcagtgcaggc

SEQ ID NO: 638318 - DNA, 848 bp, Homo sapiens
agcggaaagagcgaacctgtgtcgcaggttctgcgtggtgagaagacataatgtatgctgagcgtaagttggtcagtactcactacgaaacagtctcccatgaatcctgaacacttctgttagactgaatcctatactctgtcggagatcttcccagggaaatttagccctgagtccgaggaggacgcacctatgcaccagtacggagctctgcgctcaacccagtatctgtaggcccaaggtcgcctgatctctgctgaagtgcccactgcccgacgttcgatcagcccgtgccatatccctttctatgtagttctgttgtatatctctagagactgtgagtgctgtgcatcatgtcgggcgccagggctggacgtgctagtggcgaccagtcgtttggcgtcaacttcaatcatccgggctccaagggttcaaggtgatttcctcctgccgtccttgtcctcccggatgtttagctggggattacatgtgcgacccgttcagcgttaccgtggcgtaggtgtgtgttgatacgtttcgtcagtagaggcaccggggattcgaccgatgttcggcctagggccttggtgtcgccagcgtcctgaacctcaggttgaatctcatacttcgggccattcaggccggtccccaaaacgttgcgttgggcagtttaacagacgttgttgaagccctgcacggctgcaccctggagcgcccgttaatgtcgttagtcataacagtgcgagacaggtaagcaatcggaatggagaaaaaatttaccaagaaaaagcacatcggccatttttagcttaaagcaaccagcgggcaaggaggcatggttctcccgg

SEQ ID NO: 638319 - DNA, 118 bp, Homo sapiens
aaggacatacggctaagactgtacgaccaggtaaggcagcactagagaaccgcagaaacggctgtaagtaacaaaaaggagatagactacagactagccctatagtagcatactagac

SEQ ID NO: 638320 - DNA, 839 bp, Homo sapiens
  misc_feature (26)..(26): n is a, c, g, or t
  misc_feature (87)..(87): n is a, c, g, or t
  misc_feature (98)..(98): n is a, c, g, or t
  misc_feature (104)..(104): n is a, c, g, or t
  misc_feature (118)..(118): n is a, c, g, or t
  misc_feature (120)..(120): n is a, c, g, or t
  misc_feature (122)..(125): n is a, c, g, or t
  misc_feature (131)..(131): n is a, c, g, or t
  misc_feature (140)..(141): n is a, c, g, or t
  misc_feature (157)..(157): n is a, c, g, or t
  misc_feature (174)..(174): n is a, c, g, or t
  misc_feature (216)..(216): n is a, c, g, or t
  misc_feature (218)..(218): n is a, c, g, or t
  misc_feature (227)..(227): n is a, c, g, or t
  misc_feature (230)..(230): n is a, c, g, or t
  misc_feature (234)..(234): n is a, c, g, or t
  misc_feature (259)..(259): n is a, c, g, or t
  misc_feature (272)..(272): n is a, c, g, or t
  misc_feature (292)..(292): n is a, c, g, or t
  misc_feature (310)..(310): n is a, c, g, or t
  misc_feature (353)..(353): n is a, c, g, or t
  misc_feature (390)..(390): n is a, c, g, or t
  misc_feature (443)..(443): n is a, c, g, or t
  misc_feature (518)..(518): n is a, c, g, or t
  misc_feature (592)..(592): n is a, c, g, or t
  misc_feature (612)..(612): n is a, c, g, or t
  misc_feature (666)..(666): n is a, c, g, or t
  misc_feature (682)..(682): n is a, c, g, or t
  misc_feature (751)..(751): n is a, c, g, or t
  misc_feature (837)..(837): n is a, c, g, or t
cccatccctttccctctgtccttgtnccaggactgcaccagaagtagaggatggaacaatgatcttcccaccttctgaaggcaactntctcatatggnacaganctggtaccagcctngngnnnnggaggngtcccatgnntcagtcatcatctgtntcactagggcccatgtnctggcagatggcatcgtagtgaagctccaccacctgattttntnttggcagtngcnccanagcccggctccgtgctctgtcccgnctcagcaaatttnccaaacatatccagtttgtnggcccagcaccaccatcncacggtcaccctctgccttgggaaccagggtctccagcatgtntttcctcaggcctcccaggactcggccttcatctgtncgacaaacacaggtatctgggcttaggacaccttcaattattatcttggtgtngtaatattggcctcctttgtacatgtggtccacaaaccgcacacgcaggtccctgtgcaaccagtgctgacttcngggggctgctttctcactcttggctgcaggccatcctgtcggtctggaaggtgtttccgcttcctctctgagtngtcctgctggatgtagagtncttgattccagagggtcttccgtgatgaggcagttccgttctgttgcctgaganccaaggtgttcttgtnaaactcctgctgggagacaggccgcagtagtactcactaacagttaccacccggctcccacagccagangaaccatggcccgaacattgttaggatcaaggccttccaccttcccatagaggcctcggtgagggccagaaagaaccaccacagcncc

SEQ ID NO: 638321 - DNA, 216 bp, Homo sapiens
cccccccccggggggggggtttttttggaaaaaccccctttccgggtccgggggggcccccccccccccctttttgggggttcccccccgtttttttttaaaagtttggggggggggggggggttcccccctggggggggtttttccccttttgggggtttttttgggttttgcccccttttggggggggtttttttttttaccccccccccctta

SEQ ID NO: 638322 - DNA, 441 bp, Homo sapiens
aagcgcctccagggtctttggagtgtacatattgccactgttggaggaggtggatgcggctatgaatgcgaagctcacacaatgtgggtggaagagttgtgcgacacgcaaaggagagctgtctccagataagattctcaaagaccacgtgcccacttgactgtgaaaaagatattctgttggtggcattaaagaagacactgaagaacatcacctaagagattatttcgaacagtatggaagaattgaagtgagttgaaatcatgactgaccgaggcagcggcacgacaaaggggctttgcctttgtaacctttgactaccatgactccgtgaactagattgtcattctgaaataccatactgtgaatggccagcaactgtgaagttagaaaagccctgtcaaaacaatatatggctagtgcttcatccagccaaagagg

SEQ ID NO: 638323 - DNA, 228 bp, Homo sapiens
gttgcagtgagctgtgactcacgccactgcactctagcctgggtgacagagtgacactccatctcaaaaaaaacaagaaaagaaacgttttctgtaaccaaatttattttgtttttttttaaaagacagggtctggttctgtgccccaggctgaattgcccgggatgggatcatagctcacggcagcctcacgtttcctggcctcaagcgatcctcctgcctcactgt

SEQ ID NO: 638324 - DNA, 150 bp, Homo sapiens
acatagagtcattttagaggctgataccaaatgtccaaaggcttctgcctcctcctctcttcttccccttcaaatacaatgtaaatttatatatttcctgcagttaacatgcagaagcaatcatttgctcttgttatgacatatttatta

SEQ ID NO: 638325 - DNA, 277 bp, Homo sapiens
gaagtatattatattaatagtttactgcattatttatgaaaactgtgagtcatcatgtaaagttatttccctgtcaaccattttatagcctgtgaatttcagatatttaggtgagtagaaaccttaagattaaatatatggttattttactaaataattcaatatttaactgttttcattaaaacaggtattaacgtgcttatttatccaaaaattacacaaagcaggaaaacttacccaaggcaaggatcattctggtgttgggcgataaacataa

SEQ ID NO: 638326 - DNA, 81 bp, Homo sapiens
caggaaatacattccgttaaaaatccccttaaatgtaggtaataaaaggtcagaaatgcctggtacccaaaacaagtgctt

SEQ ID NO: 638327 - DNA, 903 bp, Homo sapiens
gctggaagaaagcctgccagctggttcctggactaagtccggctcgttcaagaacataagctaccaccttctccctcccccacccactccagtgccctggggcatgaaacagccctgaggacagacaccagggtgctggacttcaccagctgcagggtctgcttttactctggaggtgggaggggctgtgtgtgctgacacctgaaccctcccacacccgcacagtgctcgtgggaggggtcccactcactcaaagtgcactctaaatgcaaaccagacttttttgcactacagccaaaccacaccgaatgtcacccttagccccaagggcccctgaggtgtaccagaactacccttccacggccatagtccggcccagtagatattatcaaaggcgttgtaattgtgagacacaagatctatagagaagtaggcacagtccctgatgcacttctgagaggggttgttgagagcatgggcggactcgccacccaactcgcacctttcacctccaaacatgtggcgtcctacgggcgcacctttgcgtgtgccatcgtcacttaacacaatgataacagatataatcaggaaatgcttcaagcgttgtactacacaagatacttgggtggcttgccacaccaagggcccggcacaatgcaacgcaccgtacgacagtctcaacaacggcaacttctttggcacgcggcttatgtgatcacccaactacacttacgacatacctacaatgagacccacaccatctaactgtataggtgctggcgccccagacacactaacaacacagtaccacccccccacacacatgtgcggaccccacaaccacgtcttctcctggcgtatacaaccaggatgccgattaccttggatacacaacaagtgttg

SEQ ID NO: 638328 - DNA, 362 bp, Homo sapiens
cgaccgaagagtctacaggcgtgtaacggcatgggatccaaccggaagggatgaaaaatgtgtagccctgcttcagctcaagttctttggcatcgttccacacggtctcccccgaaagatttcactcttgtttggccctgacagcacccactcctacgtacagcgccaaattgtgcagcgttggaggaatcagccaaaaaatcttcccacccccggaaaacatggtaccaaaacggaagtgcctccaaagtcgatgtggaagtcggtgaaacaacctttcacgctcatcagacagtactttttcactttcgggtacttcattctctgccaatgggcggtttcgtggggcctttcctggtctt

SEQ ID NO: 638329 - DNA, 829 bp, Homo sapiens
caaattggatgagagcaagtttggtgtcctcagggaggaactgctatccttcccctcacccctcagccaggagggaaagggcattctttcatcttgaaaggcattgtgggctctgctctttgaaaagctgctttacaataaaaaaattatataataaggaaagaaaacaaaaacaaaaaagaaaaaaccaaaaaaaaaaaaaaagagcgaggcgcgcgaggcgcccccaaagaagacacccccggggggcccaaaataatcaggacaccccagggttctgttgtgaaccaaaggggcgccaccaaatagaagaagagactccaactattataacaacaaccggaaaacagagccaccagcagtttacacagacgatgaatcagatacaggcgaaaacacaggcgacaacgacgatgcgagaacatttacgaacgaaaggaaccccaaaaaactagcaggagagcagaagacacaaaaaaagagggcaccaacacacgaccccacacccaggagaagatctctaacaacacaccctcctacctaggaggcgcgaacaatacatactgcacgagagaagtccgcggtcaagagagaggggagtacatcagacagtacggcggtgggtatacaccacgaacagcgccggcggaccaagatctactgacgacgctgcgacaggaggcacagtagagggaacgaagcagtatagagagacagcacaacacaccagagtcaggtaccgtaacgaacgaaggacagccgacggaaccaaccagtactaagtaaacgcaagcaccgcgcgtgcgcacctcgttcgcggaagacagat

SEQ ID NO: 638330 - DNA, 306 bp, Homo sapiens
tccatacatagcgtgagctcccccatgacttgagagaacacatcctaaccagtcggcacaagtatgggcctcgccagtaccttcatagaacacatcttacgtcttgtcacaataccagtctttatagacactcaggtcggctctcaggcttcgcaagcacgtgaagagtgcttcggcatcagcgtctgcagcgtttggatcagaggtataccagtcgttgcacgatagttagtgctgtggagtataatgccttggagaagcagttcacgactcatgctgtcttgatatgtatgctctcggtccggg

SEQ ID NO: 638331 - DNA, 162 bp, Homo sapiens
aagtatgatatgagtcggagtaggaagtcatattcaatggtagactcctgagaagaaatacgtagtatatcgtatatagagtagaagactgcatcaatgaaaggcccgattcctgagaagttctgggtaatcagttagggataaccagggtccatcatctgt

SEQ ID NO: 638332 - DNA, 826 bp, Homo sapiens
ggtggcgccccccctttcattaattgcgcggaagttatgtatgagtcttatgacaggagagaggtcccttccattctgtagcacagggcgaggtattaaataatatgcatatcattacagagaggctcttgccgttgggcacaaatagatgcagacactcgtatggagttgtcattctcatcgtgtacagagagggggggttccacacccttccgtagagagcccacaaaatatgcaacaacacaattgtatctaccctctcgcgctgtttcgttgtaaagactgcgccaaaaacgccatccatctgtccccacacagtaagcatacaagaccaatcttgaggataggtcgcgtatatatagatggcccagttcgtcttctctacagtcgttcgatactgtcccagaaacgcttgtagtcgcaaccctgttgtgcgccgtaatatatctcgctttgatactcgccccgggacactctctctgggaacggcaggactccccatgtggtacccgcacacggaagttcattggagggcgagctccacgctcctcgtgtgccgcttccacagtatctatatatttggagccccgctctcgttcgctctccccacaggtcaacttgcgtatagcaacggttgacgcacctaagagtctcactcgcgactctttaggagagagccattgcgacgccagagtgatgtcctctccggacgtccaccccagagagggggtcagtcgcgccgcaggcagaccacgtggaacaaagacgggtgggcccccccttcgagcgccaccaaggagcgagagcccctggcccaccatagcag

SEQ ID NO: 638333 - DNA, 890 bp, Homo sapiens
  misc_feature (890)..(890): n is a, c, g, or t
tgattcttcctgcctcagcctcctgagtagctgggactgcaagtgcgtgagaccacgcccagctaatttttgtatttttagtgaaaccccgtctctgcaaaaataaaaaaattagctggacatggttgcgtgtgcctgtggttccagctactcgggaggctgaggcgggaggatgacttgggcatggggggttgaggctgcagtgagccatgatggaaccactgcgctccagtctgagtgacagagcgagaccccatctcaaaaaaaaaaaagaaagtgactaagtaggtatatcagataatgtggtagggaatgctgctctgaagaacatgacatttaagcagagacttgattgacaagagggatccaaccaggcaaagaacagagagtgtctagtgccgcggagacagctagagcaaagcctgtgtagatgggacagtctccaccatagcaagaatcaagaaggcctgcgtggctagacacgttaatgaccagggatagcagaagtccagggtgtacgcacagggatgtaggcagaggcccaacaatgggcttggcctctacctgtgttcctcttggttgcctcctgctactacaaagacgtatatcttgctcctccctactgtggggtagctttagccatttcagttcaggtccagtcatggggacttattacgcacgtgggaccaaagaagacaaaatctttgcccttggtggaacggtgtactcctaattagggacgcacgactgtgcacacatgtccttactaaactacgtagtgttcgacacacacacagggttgtaatctggcacaacacaaaaacaaaggcgcgccgcatataaataacacagggggccaaataatccagtccacgttctgacaaatgggn

SEQ ID NO: 638334 - DNA, 422 bp, Homo sapiens
ggccaaatagctttctgggaagtggagacactcaagacaattgacttgtacttagcaccacagccctgcatttatgaagcaaggaataggaaaaagatggcaaactgaaacttaagccagccatgggcaaagggaggtggctatgcagcagggtggccacagtgctggatctgctctgctctctccagagggcctggggctggagctcacatcatattttgggccttcatgggcaactcagtcaggaagcttcagggaaaaagattctcccagaaatgccacagacctttcagagccctgtctagaaactccaaaaccaggcactctccaatgctactctgctaataacattatggtccagcagaacccaggactgatgaaaaggtacacagctgagctgcccatagcacaggccactgctc

SEQ ID NO: 638335 - DNA, 548 bp, Homo sapiens
  misc_feature (222)..(222): n is a, c, g, or t
  misc_feature (279)..(279): n is a, c, g, or t
  misc_feature (334)..(335): n is a, c, g, or t
gcattcccggactttgtctacaagaggatcaaagctcgcaacaggctggcggagatccacggtgtgccccgtgggctgtatgacggggcccgtccacgaggtgatggtgcctgccaatgccagggagtggctgctccgggcccgtcgcgtcactgctcgcgaggcaacgatcgtccgtaccactacctgtgtcgcaatccctacgatcgagttgctggcggntgtcgagccgtgatcgtgcgggtctgccgaggccgtgaattgaacgcatcaattcgnctcgcgtacgtcagctaggcagcatgcaagtgatcagtgtggcagccagccctgnngcggccgtcgtccaagcgatcacgtctctcgtcattccgtagaacgtcccaagggacctggtcccgcgccatggtgagtcccgtgtcgtggtccctcagcgccgatggcctgtcgaggggcacccgaggggcactgcgctccctccgtcctttaggcatgtttgcttgttaggtaggatagttgatctctggaacggggtctttgggactggg

SEQ ID NO: 638336 - DNA, 180 bp, Homo sapiens
gttatttctgacccagacacttgtttttccaatatattcttatctcatgagaactccaataatgagatatatgaaatcacagtgttctgggtctgctcctctggtatttaatttcttatataataatttcccctttaatacctttctactttcccatgccttcccttctgtcgtcttctc

SEQ ID NO: 638337 - DNA, 1021 bp, Homo sapiens
ggacaatgcgcgagggctaccgagcgtctcctgaagatgcaaaaccatgcgtggcggaccgcgtctctcttccaggtacatcaacgaagccagctgtagagatgagtggggtagaagcccagacgccatgaagagctgccatggtgcctgtgagaaaaagctgaaccatggcccttttggagtcgttcatgcaccatgggttcatgcccgcgagcaggtagcccccatctcgtgtgacttcctggagactcacttcctagtatgaggaagtgaagtcttagtcaagaagatgggtgaccacctgaccaagccgtcctacaggctgggttggcccaggaggctgggctgggcagagtatctcttcgaaaggctcactctcgaagcacgagtaagagccttctgagtcccagctgacttcgtgaagggccccttgcagaagtaagtagggcttctgccgtaagccatctcccatcacaggccaataggcatgctttcttaactatcctaacaagccttggaccaaatggaaataaagcttcatgcaggacaggctgggtaaagaaaagaaaaaggacccacaacgaaacacaaaaaagaagaccaacccacacacatcgccacccaagacaacacacaaaaaaagagcaagcccagacgaaggacccaggaaaaccagacagaagaacggcacacaaacaagagacgcaggcaccaagcacaggagaaccccacatcaaagaaaagacagaaaaacaatgagagggaagaaagagaaagaggaagaagaaagaaacaaagagagcagagaagaagagagtacaaaagaaagaaaaggcgaaaagagaacaaggaaggagaggagagcaccagaaagcaaacaaaacaagaaaaaaaacacgcagcaaaagagagagagagagaccaaagtgagaggaaaagacaggaaaggccacaagggaagaagaaagagaggaggagaaagaaaaaaaaaaaagggaagagagaaaagacaacaaaaaaa

SEQ ID NO: 638338 - DNA, 233 bp, Homo sapiens
gacactagagaagccccacagcagcatacacaacatacccccggcagggatatagacgggattgcatatagtttaccagttaactgcagtcttcctaagacatgcattaaaatcagagcccatactatacatgacagcacgctgtgtgggcacacatgtaaagagtatctattactacaggaatcattgtcgtgaaatcaagggaggcagctgagactccatgagtgagatca

SEQ ID NO: 638339 - DNA, 106 bp, Homo sapiens
taagcaactgacccgcccagctccccaaatcggggaggtgatcatttgacttggggcgatcctgtagggtagggggagaataaaaataaatgcatcgttgcccgta

SEQ ID NO: 638340 - DNA, 181 bp, Homo sapiens
  misc_feature (6)..(6): n is a, c, g, or t
  misc_feature (27)..(27): n is a, c, g, or t
  misc_feature (46)..(46): n is a, c, g, or t
  misc_feature (68)..(68): n is a, c, g, or t
  misc_feature (123)..(123): n is a, c, g, or t
  misc_feature (129)..(129): n is a, c, g, or t
  misc_feature (140)..(140): n is a, c, g, or t
gccccngaaaactttgtggaggggctntgttgtggcaccttggggncctgattctccttcctccgaangggctccttgatggcctggccacaggggcagctccccattggctgttaggacctnaatttnaagaagaagtnaaatataaatatgtatacatatataaatatatttttaatta

SEQ ID NO: 638341 - DNA, 456 bp, Homo sapiens
aggctgtgatgacggttgcatcgcggtgcatgggaaactccagatgccaggttcaagcgattcttctgcctcagcctcctgagtagctgggtttacaggcttgtgctgccacacctggctcatttttgtatttttagtaaagacggggtttcactgtgttggtcaggctggtctcaaaccgctgacctcaagtgatctgcctgcctgtggctcccaaggtgctgggattacaggtgtgagccaccgcgccgggctgtttccagttttctaaaagttattcagacttattttgtggcctactaaaaggtctattctggagaatgttccatatactgatggaacaaatgtatatgcggcaactgttggataaaatgtgctgtaaatgtctgtgaggtccattttgtgtaaattccagtttaaattcaaggttgttttcttgacttccggtctaggagc

SEQ ID NO: 638342 - DNA, 230 bp, Homo sapiens
aggggggtcagcggctcactaggagaacaaccatatcaggacaccacgcacatgaagtgcgatccttcaactaaacagcaccagatatatacactctccagcagagacactctcgacaggatactcagcgctactcctgggtagtgtgatgacagatggctcttccttctcttattttattttttaagagacggcgtctgactatgtagctcacatgggtctcaaacgcc

SEQ ID NO: 638343 - DNA, 353 bp, Homo sapiens
  misc_feature (280)..(280): n is a, c, g, or t
ggtgggtagtgacgagctggccccgtgtcgtcgcgtcgccgacatgggcggggtggatctagagaatgctgggggtgtcgggcgcggaaaacgacatcggtgtcctgcacagggggggaggacgcacaagatatgaactcttctgtccggtgtgtgacgcatatggatatttatgtgggtgacaatctctccctcatctacgaggtatatgagggtctcggggggggaggtgagaacatcaaggcagcacatctgtgtgagtctctccaacatcatccangtggggggtactatcattgagagctctcgctaaaaggtcttcaccaccagggaggggcgccgagaggcgccta

SEQ ID NO: 638344 - DNA, 83 bp, Homo sapiens
ggcttctcgggggttgcaagactggcgggccaccagtggaactgatgagccgggtttccggggagtaggctgtcatgtggcag

SEQ ID NO: 638345 - DNA, 145 bp, Homo sapiens
tactagccggacagctccatccttaaccaggaccgccctatagggctagttagggccccgatagcccgacaggcttgaggggagtgaggcaggaggatagcataggggcctgtgggagccagagagaagctagaggtcaggaggt

SEQ ID NO: 638346 - DNA, 801 bp, Homo sapiens
  misc_feature (254)..(254): n is a, c, g, or t
  misc_feature (304)..(304): n is a, c, g, or t
  misc_feature (309)..(309): n is a, c, g, or t
  misc_feature (318)..(318): n is a, c, g, or t
  misc_feature (347)..(347): n is a, c, g, or t
gtttcctgtgaatcggtcagttcttctatattcatcggatcattggccgtccttcgcgtaactcttccgccatttaaccgaagaacacgtgggagtgactaagtcgctttgtagaatagctagcatttttgatagcgtcaagagaccgatcacactgttaagattctagattctaaaacactttatgtgaagcttcttgatgtcaatatacggagtcgaggaactgagacagcgattctacgcctaatccgatngtatagaaaccaccatttgattcaggtattatttttcatatttcaggttngactngttcttttnagaaggctaaagtcagaggaatgggggcngggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagttttagtaaagtatgggttattttttcctgctgtgctactgtttcggggtgtcgaaaaggtggttaaaccctgagactaattaaacacttccttgaccttcttgttggctgtcatttttgtgccaggaagtagtgcccagtgtatg

SEQ ID NO: 638347 - DNA, 292 bp, Homo sapiens
gtctctttctaactcccctgtctccaccggactcggggtacccctgggtggtgtggggctggtttcccaacaagctgaccatcctggcaacacggtgaaacaccatctctattaaaaatacaaaaattagccgggcgtggtggcgcgtgcctctaatcccagctacttggggggctgaggcgggagaaggcttaggcgggagaatttctttaacccaggagacgaagttgcagtagttcagatcacgcacttcactccggtcttgtgacatgagagattcctttcaaaaata

SEQ ID NO: 638348 - DNA, 245 bp, Homo sapiens
cagtctcaccactcccaagaaatggactaggaccaacaaaaactaaaactgcaggtccagatcatacagaaattactctagaaggcttcagcacaacagtggagtatgtagatcgtgtctaatactcagaatccaagcggagagagtcagcctctagtttcagactgcagttaccgtacattgaatcgcccttaaggactagcattcactgatgtggatatcgataccatccaaattgcttggga

SEQ ID NO: 638349 - DNA, 118 bp, Homo sapiens
accaggtcagcatcagtacgcagcgaatcggacgtgtaccgcgcagtatggaacaccgtcaaggggtcgatgggcaacctcgtcgagtagttcgacgtgtacacgtacacgacgttcg

SEQ ID NO: 638350 - DNA, 124 bp, Homo sapiens
tagaagacgacagaagggcaactccagaagttctagtgcaggaagagagtttgagaagtaacagattatttctgtgtgaggcacatttcccttctgttgtctaagaaatgggcagctgggaggg

SEQ ID NO: 638351 - DNA, 286 bp, Homo sapiens
  misc_feature (249)..(249): n is a, c, g, or t
tcgcttaggtagaatcagagtgtaggactatctcatggctcctaatgaatgctaaataacaaatggaaattgctgtgagtgtcatgaagcaatcttaggaatatattattatgttgctgcaggaaataattggcagaggcttaagttgaattgaggccaagaaatttggtggtgttgatgggaggttacagggatagagcttatcaacttaatcaacttatctcatgctttgtgatagaagttcattcnagctttttttctttttggttttccttttttttttttt

SEQ ID NO: 638352 - DNA, 626 bp, Homo sapiens
  misc_feature (178)..(179): n is a, c, g, or t
  misc_feature (188)..(188): n is a, c, g, or t
  misc_feature (193)..(193): n is a, c, g, or t
  misc_feature (195)..(196): n is a, c, g, or t
  misc_feature (217)..(217): n is a, c, g, or t
  misc_feature (219)..(219): n is a, c, g, or t
  misc_feature (245)..(246): n is a, c, g, or t
  misc_feature (255)..(255): n is a, c, g, or t
ggcctcagcagcgcgaggtgctgcggcgctgcgtagaagtatcaatcagccggttgctttgtgagaagaattccttggactgcggcgtcgagtcagctgaaagaacactttgcacagttcggccatgtcagaaggtgcattttaccttttgacaaggagactggctttcacagaggtnngggtgggtncagtntnncttcagaagaaggacttcggnantgcactacaacaggaaaaatcatatnntagatggantaaaggtccaggttcacactagaaggccaaaactctccgcaaacactctgatgactgaccaccgacaccgaccacccgacgactgcagcctactaactaacgtctcacactaacctgacgcacccacccccaccaccacacacaccacgacgcacaaccccaacacaccttgcgtgacgcgcgcgcaccggagccgactatgacaacaacgtctcaccaccgacaccactcagcacacatcgcgaccccgcgacccccccagaagacggcaccacccgcagacaccggcgacaacccggcgcacccactaccagacccagcgccaccgaccaaacgcctgccacccccccccccccaaaacaccgcacgag

SEQ ID NO: 638353 - DNA, 929 bp, Homo sapiens
agaggatccggagccgcgtgcatggcccgaggcttgggggccccccactgggtgcgcgtgggcacgtgctgacgcgtgggcgagcttgtggcttctgggtggctggactcggggcgtcatgacgacctgcgactgactgatctgcgggaggacgttccatgtgcctacgtgccgacatgtgcactcacatgtaagatttccaccatggtcatgggcatgcccatggtcatggccatctagctcaccgagagctatctggcatggacatacaccatgatcacgaccatggtgcattcaccattgaggcgatctatcacacagtggccgataggtcagtggcttacctccctattgagtagccgtcttactcaccatgaggacattggacccactgacccatgaatgcactacgtgcaatggacggcctaatggaggagatctgggcgctcctagtgccttccatgcatggaccttggatgctggtctcgtctactggcgcttagatgcgcttgtggtggccacatgtgcttgactctccaggcatgctccattctttggtcctctatccgttatacgcgccgtgggagttcgagacgtctctcccgtgcgattcgactctgcgtactttcgggactctcggcgtctacgttctttgccttccgagtggtgctcctagggacgaagtgctgtccgtgtgacttcatttccttcattgcatctttgaactcatcgatcctttaccacgaatgtctggagcagagcccaggacgattgcacacgtccgcaccatgtgtgaccatttggggccgcatatctggtcatcgctgggacgttgctgggttcctcaagttgcgcgaatctgatggcgcttgcctagtggcggaggaacattgtgtgagacaatgttgacatggagggacaatgggcaa

SEQ ID NO: 638354 - DNA, 316 bp, Homo sapiens
caaatactgatttgtagaggagagtaacataacctaggggctaggacaacgctatgtgtcacactcacacctgtaagcaggcccaggcatgagaggagagtcacatcaagtaagtactgggccatgcgatatatcacaaatccccatatggcaggtcccaggaagaatatcaactattttgctgggcccagacaacttgtgacaaatgtctcttataggcaaacacagggtaggagcgaggaggggctaacatcaaacatctgctgagacaagtgatatgttacaatgccccctgtgggcagggtcccggctgaag

SEQ ID NO: 638355 - DNA, 169 bp, Homo sapiens
caccactataccactacctctattatcccacctcaatctcatgatccattcttttaaacacttttgaaaataactgcacttgtgctaccttatttgtatacccaatctgcctagcaatactctctgatagggttcaacccacatctagtttctttgctctggtggtata

SEQ ID NO: 638356 - DNA, 909 bp, Homo sapiens
aggaggaggaggatgagggaggatgaggaggatgtgggccacgcaggggctggcggtggcgctggctctgatcgtgcgtgccggtgcagactgggccgctagggcccgggcgactgcgaagtttgtattctcttatctgggaagattttaccaggacctcaaagacggagatgtcacattctcaccagccactattgaaaagcgaatcttataaagttctgccgggaagcaatgaggccaacggagaactcggttgtgctactatatcgggggccatagatgtattgcagccaccaaaatctatcaatgaggtatcaagtgcctcttggcccaacctatatccctgtggagaaagatctgtgagaagctataagaagaagggacggccaagatattgtgagccttaattattgacaagcaatgatctgactagagccactaggtggacctagaaagaaaggctccagaagtaaaggagctggaagaagattcgtgggatgacgtgggggggaggaatattgcaaaagggttgttgcaagaaaaaagttcttggaacataacattccgggggaaggtattaaaatttgaaacttggatggccgttaaatttattgcccccaaaagggcaagccagtgcacgggacctgaattgggtaaggtcgtgtctacaacttccttcttgttgtggcacccttagagggggggacaaaaaaacaatgtttcaatcgtggctttatctccccaaaaaaagaggctttttgtggtaaattctcaaactctgctaaacggggtgggggggcttcccctttggagacaaaatacactggttatccacggattgttgaacgcgctgggggctttccttgattgatagttgggcccttaaagtaacccccattgaggggattc

SEQ ID NO: 638357 - DNA, 843 bp, Homo sapiens
tggaaacagattttcactctgtgtggctcaggctggagtgcaatggcatgatcttgcctcacaacaacctctatctcgcaggttcgagtgcttctcctgtctcaacctcccaagtagctgggattgcgggcatgtgccaccacgcccggctaatttggtgttttatagtggagacggggtttctccgtgtgggtcaggctggtctcgaactactgatctcgggttatccatccgcctcggcctcccagggtgctgggattacaggcgtgagccaccacgcccaggcaagaattattttttttggagacgcagtcttgctctgttgcccaggctggagtgcagtggcgcagtctcggctcactgcaacctccaccaccggggttcaagcgattcttctgcctcaggttccggctgctggggaggctgaggcgggagaatggtgtgaacccagggggtgaagcttgcagtggcgtgatctcacaggggcgtgatctcagctcactgcagctctgctcccaggttccaacaattctcgtgcctacagctcctgagtagctgggattacaggggtctaccataacacctggctaattaggtattgcgtagagacgggtttcaccatgttagccaggtggtctcaaatcctgactcgagtgaacaccgcctcagctccaaagggggggattcagggcatagcctgggctcagcctaattggtttctggaaaaccttaaatttttgggggctttggtccacatactacaacaaggttttgggtcaccactcatggctctccccaccactgttggaaggaagagaccacagggccgggctgcgaacacag

SEQ ID NO: 638358 - DNA, 821 bp, Homo sapiens
ggaggcgtaatggtctcccctaaggcttgagcgcggcggtgggctgctgcgtgcggcggtgtggcgtgcgaggctgttgtgctcccggctctcgtgatttcccctcctgatcgcgttgggaggagcgccaagcggtgctggtcgcgctcacccttcctttcctctccgagtgtttctctccctgggcctctcagctgctgcacgtgtctctccgacgcaagactgtcccggcccgtatatggctcgttggacagcataaaattcagtctcagtagaaaagtgccaaaaatgcaagtctggacaaaagcaagaggcacgtggacatgatcataatggcttgcttgccaatagttcgtgtctttgatatataccctgtcacttgtctgtaggcacacaatgtgccagaccctaagagcttcaatgcagcactttggaggagctagatgcattcctattggactccaagttcctccagaatataggtgatgttcagggcataatggttgtgcaacaggtgaatttcattgacatccattttgtagctcttccgtgacttgtcatcagaccttgaggggatttccctagtacctctcgattgtgcctcttgcatagccagatgacctgggtagccaacagtgttcttggcagaacagatggactccttaggcgagggcccgaagtcgtgccctgtgaagaactgggaaaagaatatatgcttgtcagagatttggttaacctcatcaagagcttaaactgcaggtttaacgagggttggcaacacagttactcaagtgaaatataagccctgttattcgtacgaa

SEQ ID NO: 638359 - DNA, 383 bp, Homo sapiens
  misc_feature (13)..(13): n is a, c, g, or t
  misc_feature (46)..(46): n is a, c, g, or t
  misc_feature (65)..(65): n is a, c, g, or t
  misc_feature (195)..(195): n is a, c, g, or t
  misc_feature (301)..(301): n is a, c, g, or t
atctcgagctcgngtaccctctctcaatctatccaggaagatcttntaaaaaagagaagcccacnaatggcaccagataaaaaaggaaaactgtttgccactgagggaataagatgcttatttggagaacctgtggttaataatgaaggaaaagaaatgatcatgctagcttttaaagatcagaaacacttaacnctttgcctttgttagaagggaagttaggattcacttagagtagcattaatagagttatgtgttatgaaaggtcttagtgtctgttactgaaaggttcaggattctntcctgaccttcatgtattcatacagaggtgttgataataatggaggtcagttacgtgaaaaaccgttagaggtcactcattt

SEQ ID NO: 638360 - DNA, 178 bp, Homo sapiens
taccagatctaatccccggatctgggtactaccccatgcgttacagtcactgcacctccatcctaccctcctaccagctattcctctacacagccgactagttatgatcagagcagttactctcagcagaacaactattaggcaaaccgaagcagctattggacaggaggagtagcta

SEQ ID NO: 638361 - DNA, 310 bp, Homo sapiens
  misc_feature (26)..(26): n is a, c, g, or t
tacatagcaaagcattcaaacagtgnaaaagtaaatgcttaaaagtttgttttccagcccaggtgtggtggctcacttctgtaattccaatgctttgggaggccgagggaggtcaggcatttgagaccagcctgggcaacatggtaaaaccctgtctctacttaaaatacaaagattagccaggcatggtggtgtgtgactgtagtcccagctacttgggaggtggaggcaggagaatcacttgaccctgggaggcagaggttgcagtgagcagaagtcacaccactgcactggtgtgacaggctgggtg

SEQ ID NO: 638362 - DNA, 126 bp, Homo sapiens
attctgctacaccaaacaggtactgcagcgctttcgggtagtcgcccttagtgtcttgctggatataatagtacagggacttgccgtactttctcattgaattcagaccgtaattttcaacactgt

SEQ ID NO: 638363 - DNA, 4271 bp, Homo sapiens
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaa

SEQ ID NO: 638364 - DNA, 101 bp, Homo sapiens
cagtattaattctaccaaatagtagagcataccacttgaagacggaaagaaccgaagagcaacaaaagttctgcgtaatgagactacaccttttctcgctg

SEQ ID NO: 638365 - DNA, 1250 bp, Homo sapiens
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggtaagcgggcccgaggccgccgcgttgggtgtgtccgggcccccgaggcctacgccggcctctgcctcccgagtgccggctctttgcagccacggggccgcagccccccgctcccgtgcccggctcgcgggcctccctcaccggcgaccgcgccccaggccgccaccccctcgtcgggggacccacgggaccctactcccgttcccgccgcttctttcgccgaggcttaccagcctcagacggtgccctccgcaccccaccccctattccaggggcaaagttccttggatccaggggccttcttcccgagatttgcagaaccgctgcttgcccccggcccttcc

SEQ ID NO: 638366 - DNA, 787 bp, Homo sapiens
  misc_feature (217)..(217): n is a, c, g, or t
  misc_feature (219)..(219): n is a, c, g, or t
  misc_feature (223)..(224): n is a, c, g, or t
ggagtctcatgatgttacccaggctggtctcaaactcctggtcttaggtgattctcctgcctaaacctcccaagtagctgggattacaggcatgcaccactatacccagctactatactgtttttgtctctgttcacccagtatttatcccacatatgtgagacgtactattgcgtattaggagaccaaatgctgtagtaagtgctcagtaactgtntncttnngagtacatgcagctttagctgtgagtacatttgtttagaatgaagaggtttcctttcctttctgctgagaatcaatggtgtaagttagaagcaatgcaagagatgatattgctgcctgggggtatatcaggtctttggggaagccaggttactgctgtggagaggaacgatggaaggcttaccttgctctgtgtgtcttcagctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggtaaatccaggtttcttttttctcaccttgttgaaacagggggagaataattactgtaatgaaaatctccagagggaataggtaggataccagggaagttatgagttgcttctgtttttctagggacaggatgaggatatttaactcacagccagtatagccatattactgcagcacgataggaactaatatgaagtataaagcgttgag

SEQ ID NO: 638367 - DNA, 1125 bp, Homo sapiens
tggggcctgcagggcactgccccatggtgtttcgcatttcccccgggggtgtcccccttggagaaaaatgtgtgtcaatgcaaggggcccccttggagtttttgacagaatttaccctgctggggtttgtgttcagagcaacaccttttgcctacaccctattcggtactagtcctccgccgacattctatgacacgaagttattgatctacagatggctatcattgctttactataagggatatcctcctctacaatactttctattggccccccaaatttgcttaaagtattgggtgtccccttggggggaactgacacgggggacctagggcgtttcaacctccatgatattgggaactatggaagcgcgattctttgcggggaaaccttgctgttggtgtgtccccacggtgtaatttctccggtgttttccccggtgtaaaaactgggacgttgctagggaataagactagtgtttctccgcacaaattcggctcttttgtaaattctcccaatgtccatattggtgcccttatgtcccatctctcaggggcttcccccatgtgacaagagggtggtccacataggctcatttcgtgagccttgactagacgatttcggctttctggtaacacttttccgaagcagtacccttagtgatgttccctatcttggcctgcactttttaagaagtggccttgttccactggcgagaacatgtatgtatgttctagtctagtgttcttctatgggtgtgtttatctagctttttttttgttttcattaaagaaattttcaaaatcaaattccagaatgattattacggagatatcgccaggaaaattaaggcttctcattaaacagctaaaagaggcaatgtaaattgcattgttacgcaaaagtggaatatgagcatattgctctgatagcttattttcattattggcttgggctgagcagtcacgagagacactggtcgtcgtcttgactttggcaaatgagccggagccccttgggcaggtcacacaacctgtcccagacgagggaacaccgagatggcccattcatgtacatccatggtgtgactggcttaaaatgtaattaatccttgggatatactcc

SEQ ID NO: 638368 - DNA, 277 bp, Homo sapiens
  misc_feature (203)..(203): n is a, c, g, or t
cttagagatcaccgcattgtgtctcagaagcaaatgtcagacagaccgcgaaaatgacatgtctgcaagcaacaatgtggttgctattcatgttccaccaaccacctgaaaacaagcacaaaggtgcatgtgctatcaagaacatcctaagcgcattttcttcttcttcccctagtaagggctgtcgtatacgtgacattttnccagctgtcggcagactttaaaatatgatttggcacgttgctctgttgtcacaataaaccacaacccacaaaag

SEQ ID NO: 638369 - DNA, 230 bp, Homo sapiens
actctgcacacgccgagtacccaaaccttaaagaactagaaaggcaacaacaaaccaaaccaaaaattaatagaagaaagaaacaataaagatcagagcagaggctgggctcagatggcacacgcctaaaatcccagcactttgggaggccgaagtcacagtggacgaagttgttgcgcaacaacttcgtccactgagattttaagaagtgtatggttactcggcgtgtg

SEQ ID NO: 638370 - DNA, 4218 bp, Homo sapiens
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaa

SEQ ID NO: 638371 - DNA, 4120 bp, Homo sapiens
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaa

SEQ ID NO: 638372 - DNA, 948 bp, Homo sapiens
  misc_feature (46)..(46): n is a, c, g, or t
  misc_feature (70)..(70): n is a, c, g, or t
  misc_feature (117)..(117): n is a, c, g, or t
  misc_feature (128)..(128): n is a, c, g, or t
  misc_feature (161)..(161): n is a, c, g, or t
  misc_feature (181)..(181): n is a, c, g, or t
  misc_feature (183)..(183): n is a, c, g, or t
  misc_feature (188)..(188): n is a, c, g, or t
  misc_feature (191)..(192): n is a, c, g, or t
  misc_feature (201)..(201): n is a, c, g, or t
  misc_feature (216)..(216): n is a, c, g, or t
  misc_feature (272)..(272): n is a, c, g, or t
  misc_feature (279)..(279): n is a, c, g, or t
  misc_feature (329)..(330): n is a, c, g, or t
  misc_feature (332)..(332): n is a, c, g, or t
  misc_feature (368)..(368): n is a, c, g, or t
  misc_feature (375)..(375): n is a, c, g, or t
  misc_feature (394)..(394): n is a, c, g, or t
  misc_feature (570)..(570): n is a, c, g, or t
  misc_feature (620)..(620): n is a, c, g, or t
  misc_feature (762)..(762): n is a, c, g, or t
  misc_feature (823)..(823): n is a, c, g, or t
  misc_feature (882)..(882): n is a, c, g, or t
  misc_feature (945)..(945): n is a, c, g, or t
cattccccatcgtctccacatacactcagacaggcttacagaagantttcaaatatcaaatagagaagcngtcaattcacgcacctcatgactccagtcaattcttccagtctttanacttcagaccngccaataacactaaactcaataccgtgtttgtngaatctgtcaatcaactttntnttggnaanncccgccccncgcgtcaagaccccncccgcctcaggcagacgacaagcatcactcagaagactcatggctgcctgacccanagccatnggggtagccacacagccagcctctggtcctttcacctgagtccaaatctnnanatttggtttgttctcatctgtcccagtccctcggcngtctccntgaccaaagaatgtcagcntgaatcaggcagcatcaatctgtttttgtgtcgggcctcgtcttgaaaaatagccaaaggagaagaaccatgggaatcttatgagaagttgccttccaattccaaacctcacaaagaacaaaaagaaaagtcctgcaaacatcagcttaataacagaggtgatgcctcccacagtnacatacgcagcatactgaactggtgattcctctaaattttcatacaagtnacgttgagtcctccttacaacagacacatcagatcccataaaaggaatggaataacctttgagttcccgacaataagaaattggccaccttctcttcaattttggaccaatgagcgggacaggtttcagatttgatacattncttagttttctcaaattactctgatctccaaaaccataaattgctgacttccaggtaccancatgaatgctcaacccctcaggtcctgaatgtatagtcaggaaactttccacagcagtnaaagtaccattcattttatttctggtatatattactcccagaactgctggaatggagttaaancgc

SEQ ID NO: 638373 - DNA, 4194 bp, Homo sapiens
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaa

SEQ ID NO: 638374 - DNA, 4155 bp, Homo sapiens
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccgccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaa

SEQ ID NO: 638375 - DNA, 772 bp, Homo sapiens
tgccctttagctgccatcttgcgtccccgcgtgtgtgcgcctaattctcaggtggtccacccgagaccccttgagcaccaaccctagttcccccgcagcggtctccttattcggcgtccgagcaagatgacacacgaacacaagtcatgaaccaggaaaaactcgcgcaaactgcaggcacgaagtgcgcattggtgggaacaggcaacgtgctcgccgaatgaagaaggtggttcatagaacagccacgagcgagatgacgaaataaacttcagttctccttaaagaagttaggcggtaaacacatatctctggtattgaccgaggtgaatatgttgacaaaccaaggaacagtgatccactttaagaaccctaaagctcaggcatctctggcagtgaacactttcaccattaactggccatgctgagacaaagcagctgacagaaatgctacccagcatcttaaaccagcttggtgcggactagtctgactagtctaaggagactggccgaggctccttgcccatacaatctgtggatggaaaaagcacgcattgctactggacagggatgatgcatcgatgaagttccagatcttgtgaggacttttgatgaggcttccaagaatgaggcaaactgaattgagtcaacttctgaagataaacctgaagaagttactgggaagctgctatttatattatgacttgttttaagaaaatcttgttatggatctgataaaatctagatctctaatattttaaagcccaagcgc

SEQ ID NO: 638376 - DNA, 2646 bp, Homo sapiens
  misc_feature (217)..(217): n is a, c, g, or t
  misc_feature (219)..(219): n is a, c, g, or t
  misc_feature (223)..(224): n is a, c, g, or t
ggagtctcatgatgttacccaggctggtctcaaactcctggtcttaggtgattctcctgcctaaacctcccaagtagctgggattacaggcatgcaccactatacccagctactatactgtttttgtctctgttcacccagtatttatcccacatatgtgagacgtactattgcgtattaggagaccaaatgctgtagtaagtgctcagtaactgtntncttnngagtacatgcagctttagctgtgagtacatttgtttagaatgaagaggtttcctttcctttctgctgagaatcaatggtgtaagttagaagcaatgcaagagatgatattgctgcctgggggtatatcaggtctttggggaagccaggttactgctgtggagaggaacgatggaaggcttaccttgctctgtgtgtcttcagctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaa

SEQ ID NO: 638377 - DNA, 4738 bp, Homo sapiens
  misc_feature (4287)..(4289): n is a, c, g, or t
  misc_feature (4295)..(4297): n is a, c, g, or t
  misc_feature (4299)..(4301): n is a, c, g, or t
  misc_feature (4304)..(4316): n is a, c, g, or t
  misc_feature (4319)..(4320): n is a, c, g, or t
  misc_feature (4328)..(4328): n is a, c, g, or t
  misc_feature (4330)..(4333): n is a, c, g, or t
  misc_feature (4358)..(4358): n is a, c, g, or t
  misc_feature (4368)..(4368): n is a, c, g, or t
  misc_feature (4379)..(4379): n is a, c, g, or t
  misc_feature (4387)..(4387): n is a, c, g, or t
  misc_feature (4390)..(4390): n is a, c, g, or t
  misc_feature (4395)..(4395): n is a, c, g, or t
  misc_feature (4400)..(4400): n is a, c, g, or t
  misc_feature (4406)..(4407): n is a, c, g, or t
  misc_feature (4417)..(4418): n is a, c, g, or t
  misc_feature (4424)..(4424): n is a, c, g, or t
  misc_feature (4445)..(4445): n is a, c, g, or t
  misc_feature (4448)..(4448): n is a, c, g, or t
  misc_feature (4450)..(4450): n is a, c, g, or t
  misc_feature (4455)..(4455): n is a, c, g, or t
  misc_feature (4481)..(4481): n is a, c, g, or t
  misc_feature (4483)..(4483): n is a, c, g, or t
  misc_feature (4493)..(4493): n is a, c, g, or t
  misc_feature (4499)..(4499): n is a, c, g, or t
  misc_feature (4503)..(4503): n is a, c, g, or t
  misc_feature (4522)..(4522): n is a, c, g, or t
  misc_feature (4524)..(4525): n is a, c, g, or t
  misc_feature (4562)..(4562): n is a, c, g, or t
  misc_feature (4578)..(4578): n is a, c, g, or t
  misc_feature (4591)..(4592): n is a, c, g, or t
  misc_feature (4594)..(4594): n is a, c, g, or t
  misc_feature (4606)..(4606): n is a, c, g, or t
  misc_feature (4608)..(4608): n is a, c, g, or t
  misc_feature (4610)..(4610): n is a, c, g, or t
  misc_feature (4614)..(4614): n is a, c, g, or t
  misc_feature (4622)..(4623): n is a, c, g, or t
  misc_feature (4626)..(4626): n is a, c, g, or t
  misc_feature (4633)..(4633): n is a, c, g, or t
  misc_feature (4639)..(4639): n is a, c, g, or t
  misc_feature (4650)..(4650): n is a, c, g, or t
  misc_feature (4660)..(4660): n is a, c, g, or t
  misc_feature (4666)..(4666): n is a, c, g, or t
  misc_feature (4668)..(4668): n is a, c, g, or t
  misc_feature (4724)..(4724): n is a, c, g, or t
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactgggtgggttctgtgtcaataaaaagcttcaccccctggctgagtgaggtggtcccctgcaatcactgtttgtcccctacccacccaacctgtccctgcctgctcccagcccactcatccttatgtgctagggataaatcaagagtcctcagcactccacattcccaaaaaatcccaggaactcctaaaccttcccctgtgacagaagatgaggttggcagctgatcagacctcaataattttatactgtaataagctctttgaatgtgtatattattattttttacaatcatttcattttgtatttaatatcaatggactgagtctgattcagaaaataattgtaatgttcatattcaatatcttacagtgatacagttttgtatttacatataaatataccgacatgatcaaaaaaaaaaaaaaaaaaannncccccnnngnnnggnnnnnnnnnnnnnggnnggttattntnnnntttttttatttattgttgggaaaantttttttttnttttttttttntttttttnttnttttntattntaaganntgtttatatnntttttntttttttaaagtttttatttngtngnggttntagtttttttgttgttgggttttttnangttttatttnattttnattnaagtttttttttttttttngnntatatttatttttttttttttttttttttttattttnattttttttttttttngatttagagattnngnaaaaaattgggntngntatnttttgagnnatntaagatnttgtgnttttttttttnttttgttttntgttangnttttttttttttttttgttttattttttatttttttttgttttatttttttaaaanttttttatttattg

SEQ ID NO: 638378 - DNA, 153 bp, Homo sapiens
aaatattggcccttttgcccccccctccccctttttttttcccccccttttaattttttaagggtttttttttcccccggggttggttgggcccccccgggttttccttttccctttcttttgccccctttttttaaagttccccccctttta

SEQ ID NO: 638379 - DNA, 3242 bp, Homo sapiens
agcggcaagttaaccccaggagaggtgccagtcagcagataatctgcaaacgaacgtattctcctcctcctacgaggatatgagcctcacgaaataatcttttcatcctgaatctccctgccgcagtcgagctgccttccgtccaggtagggtcccctccccgcccgggtcccctccccctcccggtcccctcccccgcccgggctcatctctgtctccccctcccggactgcgtcctcgctccgccgggccctcctagccgccagcttgtgaatgagacgctcagtttctcaatggagccgcggggggctcgggcggccgcccgagcggagcccggctgaggcagccgcgcaggtcgcagggccagcgtccgcgaggacggcccggctgggcggccccgagctctgtggcgctgtggaggagcgggagcgcggccgaggaagcggggcgccgagggggtcggcggccttcgggaaatttccgccgacccttcgctcccggctctaaaagttcctgatttcctatttccttttaaatcccgagtggctgttagctcttcgcctgcactttttcttccccaggagataagggggagtgtgaggaacggagcgaataatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagaaactcgaaggaaggaaggcattgtaaagctgaaacctcatgaggaacctcttcgttctgagatcctcagtggaaaattcaccatcttaaatgttcgggacccaacaggagcctccattgccctctttactgccaggttgcatcatccccacaagtcagtccaacatgtggtacttcaggctctgttttacttgctagacagagctgtggatagctttgaaactcagaggaatggactggtgtttatctatgacatgtgtggttctaattatgccaactttgagctggatcttggcaagaaagtcctaaacctgctgaagggagcatttccagctcgtttgaagaaggtgctgattgtgggggcacccatatggttccgagtgccctattccatcatcagtctcctcctgaaggacaaagtccgggagaggattcaaatattaaagacatctgaggtcacgcagcatctgcccagggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtctccaggaaacctagagaaaaaccgttatggggatgtaccctgcctggaccaaactagagtgaagctaacaaagcgaagtggccatactcagacagattacatcaatgccagtttcatggatggctacaagcagaagaatgcttacattggcacacaaggtcctttggagaatacctatcgtgatttctggctcatggtatgggagcaaaaagtcttggtgattgtcatgaccacccgctttgaggaaggcggcaggagaaagtgtggccagtactggcctttagaaaaagactctcggatccgatttggcttcctcacagtgaccaatctaggcgtggagaacatgaatcattataagaaaacaacgctagaaattcacaacacagaggaacggcagaaacgccaggtgacccacttccagttcttgagctggccagactatggtgtcccttcctcagcagcttccctcattgacttcttgagagtggtcagaaaccagcagagtctggctgtgagcaacatgggagcacgctccaaagggcagtgccctgagccacccattgtggtccattgcagtgcaggcattggcaggacaggtaccttctgctcactggacatctgcctggcacagctggaggagcttggcacccttaatgtgttccagacggtgtcacgcatgaggacccagagggccttcagcatccagacccctgagcagtactatttttgctacaaggccatcctggagttcgcagagaaggagggcatggtatcctctggccaaaacctgctggccgtggagagtcagtaactctcctacgaacctcctacctgttggccagccttccttaaactaccctggacaccgctgagcctataggttgccatcagttacgctgaagccatggatcaacttctttcttgtgtctcccagcacacgtgtgcacgcaaggcagcctttccctttggctagataaatgtggtgaaattgccactagaaagggccagtagcaatgtgttcttaattcctagcatctgctatcaaactgtgccttattaaaaccaaattgtggctattgatttttgctagggtccccgaggtaagtggggaaggaacctccctcctcctttctcccgccattctttttctgaggtctcctgtctcccactccttccctttcctaggattttatggggaggtttgatgagcatttgcctttctccccagagagcttgaccaagttacatattctagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacg

SEQ ID NO: 638380 - DNA, 440 bp, Homo sapiens
tggcccggatgcactgcaacatagccacatcacccaatgtttggactgtttgaacaggtacaataagagagtttctacagcaggctgagtatctgtccatattcgttcacagaaataaagaagtgatgtatttcctctcctcaagaaagcccatcttggccaggcacagtggctcacacctgtaatccctgcactttgggaggccgaggtgggcagatcacttgaggccaggagttcgagatcagcctggccatcatggcgaaaccccgtctctactaaaaatacaaaaattaattgggcatagtagtgggcacctgtaatcccagctactctggaggctgaggcaggagaattgcctgagcccaggaggtcaacgctgcagtgagccatgttcacatcactgcactccagcctgggcatcagaacaagaccgtacctca

SEQ ID NO: 638381 - DNA, 146 bp, Homo sapiens
aaaagccattactactaaagatgcacggatggccgggcatggtggcgcgtgcctgtgaaaatcgcttgaacccaggaggcagagatgcggtgagccgggatgcgccagtgcactccagctgggcgacagagcgagattccatctcg

SEQ ID NO: 638382 - DNA, 294 bp, Homo sapiens
tgaaagagaaacagacacactaaataaaatacgaaatatattaaaaaataattttctttttcttttttttggagacggagtcttgctctgtcaccaggctggagtgcagtgacacaatctcggctcactgcaaactacacctcccagattcaagcgattctcctgtctcagcctcctgagtagctaggattacaggcctgtgccaccatgcccagctaatttttatatttttagtagagatggggtttcaccatgttggccggggtggtctcgatctcttggaatcatgatcca

SEQ ID NO: 638383 - DNA, 949 bp, Homo sapiens
gatttcccagaagttggtaaccccggaagtggtccttcggaacgggagcgttttacaaaggccaactaaatctttcttcaagaaggggtgtcttcctactttgtgtacacccgtgtggtcccccccctggcaacatggggttggcccccgcgtgaccacacgggctctggtcacaccgccacagaagttaacgtggcttagaaaaaaataacccacaatcttcaggggcctttgacaacccgcctttgcgtgtgcagtaatcccccaatttgggcgtacctgcactttggcaatatcgagtaatgccgtagtacacgtcaccccttatgccccccaaaatatcggggtccaaataacaggcagtaccaccggaaccagaccattgtttgcctaaatatcattgttcttcgagtgccccgcctttccccacttctttgagaggcaatattttagcacaggggcctgcagtcccacccacgcacgggcatctatcaggagggcattccgtccacactccatataggtggggggaacccccacaaagtttcttctatgaccacacaagtcacacacacctgttgtgtgcccacaagattggaacttcttcatacaattcttccacccccaaacaagttgcttctaaaacattcaaccagcgctcacctaaatctttagctctccccgtattacacatcctctccccattacacattaggcgaggaacaaagtttaaaaaaaaatattccagcaccgagtgtcatttgagtgaaaactttgatgtataaacagtgaaatttcactccgttttagtcacacatagaaaaactctaaccagttaccattcttataaagaccacgttagactaagatcacaggccttggtgtttcggcgtaaatttgcttatttttttgcccccaacaaaaacaaacataaaacatccccaaaaca

SEQ ID NO: 638384 - DNA, 523 bp, Homo sapiens
ggctggaagagaaggttcaaggcttgggtgcctctgtgagaaggttccagcaattggtgcagccggcaggcaccctggacggcgtggcaggcctccttctgcagctgtcccaggcggggcgggaggccatgcagggcccctggccacactgaaggatgcctacctggaggtgacactgcggcccctggaggaggtgtggcgggagcgagcagaggaggccatgcggcggctgcaggcctgggtgcccgggatgccaggcaatgggggtccaaggcccatcagggcggccctgggggccatgaaaggagccctggagctggccgcccaccagatgctgtcttgggctgaggccacgttctcacgggcactgaagaggctctgcaaaccactgctggacctgtacagcctgtcggccaggaaccgctcagtggtggtgatgctgccactgttgcctgcgggggacgagcccctggacgtggcccgggtgaccagctacctcatggaggagaagctgctgcggccg

SEQ ID NO: 638385 - DNA, 599 bp, Homo sapiens
ggctggaagagaaggttcaaggcttgggtgcctctgtgagaaggttccagcaattggtgcagccggcaggcaccctggacggcgtggcaggcctccttctgcagctgtcccaggcggggcgggaggccatgcagggcccctggccacactgaaggatgcctacctggaggtgacactgcggcccctggaggaggtgtggcgggagcgagcagaggaggccatgcggcggctgcaggcctgggtgcccgggatgccaggcaatgggggtccaaggcccatcagggcggccctgggggccatgaaaggagccctggagctggtgagtgagcaaggatggggcgtagttggcaggtgaggatgactgagccagctctcactgtcccctccctctccaggccgcccaccagatgctgtcttgggctgaggccacgttctcacgggcactgaagaggctctgcaaaccactgctggacctgtacagcctgtcggccaggaaccgctcagtggtggtgatgctgccactgttgcctgcgggggacgagcccctggacgtggcccgggtgaccagctacctcatggaggagaagctgctgcggccg

SEQ ID NO: 638386 - DNA, 765 bp, Homo sapiens
gaggtcttttcccttgtcgcgaaagaattgcccgtagccagaggaactggacccaacagccttgtggtgcttggtcaccctggcctgctgtaggagggaaactctccgacggacctgagcatctaggggcttgcgatgtctctcccaaagggatccttcagctaggaccaccctaaggaacacctgggaagtttcagaatcgcattgttgggtgggccgtgcctagcctgggcaaggctacgtgtacaagtgttggcgcctctatttggagtcataccctgccttcccgacgccctgccccatagcccagccccagtcactgtccagggtagggccaggccccttgcaatggcctcgcagagtggccgtgggctaggtacagctcgcacctactgctgctgcgatcagtggtacccacgcgccttagagtccgcctaagggcactggaagggtgggaggtatgtactagggggcagtgtctcttccagggggaattcctcagctcttgggaaccccctatgactgcccaggggagagggaaacctttttcattcaacatatgtagggggcaagctttggtgcgccccctgctgaggagcagccccaggaggggaccagaggggatgcatgcgtcgctgcctgggatcttggggttggcctttgcatgggaggcaggtggggcttggaatcagtaagtctggttcccgcctccctgtctgagagaggaggcaggagccaatacgcccgggttgtgtttgtacaatt

SEQ ID NO: 638387 - DNA, 366 bp, Homo sapiens
  misc_feature (43)..(43): n is a, c, g, or t
  misc_feature (142)..(142): n is a, c, g, or t
  misc_feature (228)..(228): n is a, c, g, or t
  misc_feature (242)..(242): n is a, c, g, or t
  misc_feature (279)..(279): n is a, c, g, or t
  misc_feature (340)..(340): n is a, c, g, or t
agagcaaccaacagacaggtgaccttcttgggttgtgcttcanaatggactgggaaaaacatctttgaaatcaggaaatcaggccgggcgcagtggctcatgcctgtaagcccagcactttgggaggcggaggcgggtgganccatcgaggtcaggagctcaagaccagcctggtcaacatggtgaaaccccgtctctactaaaaatacaaaaaaaaaattagctggncgtgttggcgggancctgtagtcccagctacacgggaggctaaggtggganaattgcttgaacccgggaggcggaggttgcagtgagctgagattgcaccattgcactccancctgggcgacagagcaagactctctc

SEQ ID NO: 638388 - DNA, 118 bp, Homo sapiens
aaatcaagtgggtagaagacgaaaaccaagtatttcccacgtataatcagttaacttcatgctccttaaatttctccatacgctcacagtctagttccttcccagttaggtgcgctga

SEQ ID NO: 638389 - DNA, 957 bp, Homo sapiens
  misc_feature (205)..(205): n is a, c, g, or t
gcgaagcatgggtgggcctacccctactagtgtcagtctaccaacacatatggcctagactacgtacataacctagacctactccaatgctaagactagtcgtcccaacaattatattactaccactggacatgatcgttttgccaaataggacacataattggaatcagcatcaagcagcccacagcctacattagtttgagcntactctatccgctcgtactattttattaaacccatacattcaatcatagcaaaccttatcttagactgttccctccaaatgctctttgcgtctcgaaccgccgcataatgaagccccctctcgcgtagagtactgagagctaaccgtgcacatccttaccgcctcacaatctataggctaaggagcgaaacgacctagactagtccgaagttgaagcccacgttatcatcggataacaaatactcatattctcctgcgtaatatctacaatcgtcgcctagaagatcgtcctgaatctcataagatgcaggagaccacagaaataatcatattttatatctttcttcgagacctacacattataacccaactttggcatatctatcacctcgattgaggctcagccatgacatgaacgcctgaatgcatggcacgatacttccctagtctacaccgctaggtagagatgcccttcccgcttaggtcatcgcactagagtttacactcacaaaccctaggctcactaaacattctactactcactctcactgccaagaactatcaaactccttgagccaacaacttaatattgactagcttacacaatagctttatagtaaagatacctcttaagggactccacttatgaatccctaaaagcccatgtcgaaagcccccatcgctgggtcaaagttactgccgcagatcttaaacaaggcgggataggaaaaaaggctcaaggattttaaccg

SEQ ID NO: 638390 - DNA, 1771 bp, Homo sapiens
  misc_feature (935)..(935): n is a, c, g, or t
tgtggatcaatgtggggtgtgttcccccgcggacgacgctgtgttacgtctctcggctgtggcgtgagtagcttctgttgcagcgacggggctgtggtttgtctgtgatacggcatgcgtggcaccacgctttcttgcggggaagatgtctcgtggtgtgcccgcactgagtttcgcgtggccgacgcagcgtgtggtacgccgcgcacccccccggggtgtctgctcgcgcgcgagggtggttcccccccgcccttggtggtgtggaaatgtgcccccgccgtgagatattgttgtgggcgtttgtggccccttggggggaggcgcccgcacctcggggggtgtctgttgacgttgtccgacccccgcgcgtgtggtgtgtggttggtccgcggtggccgcactcggccgcttctggagggtgcgccactggggggttttgcaattctgtgtcgaccaagagcgccacgtgtgcgtgggcccccgcggtggtggtggggtcgcccccccccttcccgacggtggagatgcgttctccgtggtgttgggggcggctcttcgctaccgacgagtaggcgtctgtttggttgtagagagcccccttcggtgggcctacggtggaggctcccaccacctgcggcggtgtgtgttaataaggacggggtgagtgtataaaggtagtggttctcctctcttgggggaagtctcctcaggggcccccggggttgattatggctcccaccgcaccgccgcagctttggtgcgtggtatcgtcaaaagagcgattggtgccctgtgtctgcctgctcgtggcgcaccgccagggggtggagacacccacctctttggggggcccgccaccccccgtgtagtgggggccactccgcgtcgggtgttgcgcctcctcgcttctccccccgcggaggatggttgtntgatatacgtgtgtgtggacaagacgcccctcttgggagcccgtctgggagttggtgcctcctctgggtttcgtggagaccgcgctctcctcgcgtggtattatcatgtggctcgcctcttttggagacatctcgagagcgtttttgagagagggagagagagagctgttcgtagaggttgggctagagagagagagggggcgccgcgcgcaaactgtctttggcgtgtagtgtgctgacgccagggaccgtctctcctcgtggtgtgtgtcgacacagtgttgttgctctcttgggagggccatctcccctctatagttctgagatagtctgtggagacatagtggaggccccgcacactctctgcgactggggctcacacacacaggcggcccgacgactctccctcgacgaattgtttcccacagtgtgcgtgtgttcttgagacctctcacaaggggcgttgcgcacacccacgcgcgaagaaaatgggggcccacgcgggagacccacacatacaagaccgtctgttctccctctgtgccggggtttctggtgtcccacccttatacctggccccacactggaaggcatatcgtcacccccaaagtaagaatgttatagaaaacctagaaactatatcgaaccacaactttttacaaatcctaatttttccccacaaccagggccctctgcaagcccacacctttccttccctcctttgggaaacccaccatacccccggccccagccccttactgtcacgccccaactttttgggagaaatatgaaagcctgtggttctaaaatttcataaaacaaaaattataaataaa

SEQ ID NO: 638391 - DNA, 485 bp, Homo sapiens
  misc_feature (5)..(5): n is a, c, g, or t
  misc_feature (44)..(44): n is a, c, g, or t
  misc_feature (72)..(72): n is a, c, g, or t
  misc_feature (307)..(307): n is a, c, g, or t
  misc_feature (314)..(314): n is a, c, g, or t
tccgnaacaatttgagcccccaaaaaagtacctaattggatttngaattcaaagaattaaatacccatgatncccatactgctaataaatgaatcagataagagagaagagacaaatctcccaggcagaagaattccagattatttatttatttatttttatttaattttttttttttacacagggtcttgctctgttgcccaggttggagtgcagtgatgtaatcttggcttactgcaacctccacctcccaggttcaagcgattcttgtgcctcagcctcccgagtagctgggatcacaggcatngctgccnacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaatt

SEQ ID NO: 638392 - DNA, 110 bp, Homo sapiens
ataatatactatatatacattagcaaatgtcggtcgttagtagacactgagcagagaagcttgaagcaacggggatcctctcctgatgggcagagcgagccccagcttcc

SEQ ID NO: 638393 - DNA, 404 bp, Homo sapiens
  misc_feature (289)..(289): n is a, c, g, or t
attgagttaagaatccagtctctgttagtatcgaatcctctggtaataggagacttcactctgagaatccgagatgtcctttgaaacactgcaaaggttcataattctaaaaggggacctgggctgaggcactagccatattaccctgctcaaaggttgacctttgagggttgccacctggggtgtatactacttggccacctgaggtgtatactacttggggatccgtgcacgtaaacgattacaaggactatgcagaaaccagagagtttaagaataccggattggnaaatcaccaacaaaccatcacatccaccacaacacatcttactattacaatatccctcaccctacacaagtacaccacccctccatcacccaacaccccctaactaccaaaaaat

SEQ ID NO: 638394 - DNA, 157 bp, Homo sapiens
tctgtctgagcagtatgtgatttaacaaaaaaccaggtaacatggggtttcacattttagccatttttcctttttctttttatttttttggagactgattttcactcgtgtggcccaggctgcaagtgcaactggcacaactacctggctcagtcca

SEQ ID NO: 638395 - DNA, 784 bp, Homo sapiens
ttggccctacaatgctggatcatgaaggataagaagtcccaggaaagcgaggttacaagctactttggagcagcaaaagatttgcctggtgtttagagagctgtttgaaaaagaacctcttcctcctcccagaaagacacgtggtgagctcatgaaggcaatctgattttgcatgttaactactggttaccgtaagatgaagatgatggtgttattgtgcctttggcaacaggaatatgcaaaagaaactcagcagccgcacgttagtggaaacagtggcacaagcaaagcacgagcaaggctcagtgctggcaacgaggaccaaaaggaagaggaggcgtgaagagggaggaatcatgatccaagattctatgctacctctaccgaagaggagtcaggacgatggcacggcagtccgaggcaccatcaggaggggacgacaggcagcctacttcccttgctcgatcgatcggcatgatatcgatgcagcacgcgaggagattgaggatggcctggtgcgaaggaagaaaatggaactcctccagaagtatgcaagcgagaccctgcaggcccaaagtgaagaaaccagaaggctcctgctgcgtattaggacccagctggggctctccttgagagattcttccatcccccaggtggtacctcaggacccaggggctgctgacagcatggctgtgtgctgcgaagggcttcctggccccatttctcaggcttccttgcctctccttgttctcatgttgaccggagggtaggggtctgtccctgt

SEQ ID NO: 638396 - DNA, 321 bp, Homo sapiens
ggtgtgtgcattgtgtgctgtgtcttagtgtgtgtgtgtgtgtgtgtgtgtgtatgtgtgtgtcttggtcctcctttcttttggggaatcctgtaatgtgacggtagcttattttgtctattaattagggtgctggatgttagagaattttgtcagtcaaactatatacacacagtagatagctgttcttaggcgaaggtaactcttctttatatccgttgtaacattccattatattccattgccaaagacaatcattaagaaactttgtatagctatagtaaagaaagcaaataattttttaaagaataaccattttaa

SEQ ID NO: 638397 - DNA, 412 bp, Homo sapiens
  misc_feature (73)..(73): n is a, c, g, or t
  misc_feature (97)..(97): n is a, c, g, or t
  misc_feature (103)..(103): n is a, c, g, or t
  misc_feature (105)..(105): n is a, c, g, or t
  misc_feature (184)..(184): n is a, c, g, or t
  misc_feature (203)..(203): n is a, c, g, or t
  misc_feature (297)..(297): n is a, c, g, or t
  misc_feature (337)..(337): n is a, c, g, or t
  misc_feature (389)..(389): n is a, c, g, or t
ctgccgttactggctcactcacctcctccacaccacctatatatctacgctcagcgctcactacttctcccgngactgacgacataaacaccgacantctctntnaacataccctttcactgtcagtcacacaacccaacaaccattcaaatgtcgcgcgagatataccaaatataacacggcncgatgggcggtggcccgcngcgccaatcgccaattccgacaatgtccattgatccatattccgcgtcatcacagcccacaagtatgtcaacgacacccgtcacgatttgcgcncacgtcgacgcgcatattgctatcccggatattactgcgnttttcgtcgagcgtcatccgttattgacccgcacgactcatgcgtgtacgantcactatttcagcgatcggcgcg

SEQ ID NO: 638398 - DNA, 228 bp, Homo sapiens
gtatctattattttatcccctggttccggcagtggctccctatacagccttaatgtccatatatctgtcaaggatatttatcactaagccgcattgatataacagacataatctaccagagtacaaacacaaatatgcctatcatctggagaagctactgtgggatagggataggtttaccgaagccactaggatgggcgccgtggctcatcacctgtaatctcagca

SEQ ID NO: 638399 - DNA, 188 bp, Homo sapiens
aattaccgagtattggagttcagcacggtgctcacgtgatcgacggaacttgtacagggaggcatgcaccgtatgttgtgaatacacgtcgaccaggctccagcttaacgatatttggaggtcagcacggtgctcacgtgtcgatggaacttgtccagtggatgcatgcaccgcagtggtgaatacac

SEQ ID NO: 638400 - DNA, 116 bp, Homo sapiens
cgctttatacttcctcaagttatacttcctcaacgctttatactttctcaacgctttatacttcattagctctagaggtccaggcatacttaatattagaagtataaagcgtggag

SEQ ID NO: 638401 - DNA, 386 bp, Homo sapiens
gggttcatagaattcatatttgcttgctcccagactgtgcggctgggcagaggcgctccccacatcccagacgatgggcggccaggcagatacgctcctcacttcctagacaggatggcagccgggaagaggcgctcctcacttcccagactgggcggccaggccgagggtctcctcacatcccagacgatgggtggccaggcagagacgctcctcacttcctagacggggtggtggccgggcagaggctgcaatctcagcactttgggaggccaaggcaggtggttgggaggtggagattgtagcgagcagagatcacgccactgcactccagcctgggcaacattgagcactgagtgagcaagactccctctgcaatcccggca

SEQ ID NO: 638402 - DNA, 875 bp, Homo sapiens
gtagccgcttgtggattgctgggtgtgtgttgtgtgtgtgtgcgctgacgtgcagtgctgtgtggtagtctcattgctaggatgacctcgtggtgcacccccctgaatagctgtcatcagtggggcctgtctatgcgcacatggttgctgggtcatatcgtaaatcatctccagactcttgtgtctaggagaggacgtcctgtgtgggtggagtgatgatgctaggagattctgaagtggaattccctctggactctctggagttgctctcgctcttcattcgtgagcaccagttcgtgttggcgtcggcgggcgtgtagaggccctgaatattctcgcgtgtgtagtattacacggtgacttgccaattaggtcgcccattcgggtcaactctgggatcgaatcatgcggtggtaggccgcagagagaggggttgggtgcttgccaagaggaaatggtatgatagtttcctctcttgcattctttgttcccataatggtagagatttagtgtgattgcacctgcttagtgttcaatagcagtaactggtttgtgtatattcatcaataatcagaccagatatttctgccggtaatgtagaaatctagcggtgtctatgaagaagagtgaagtctcccacatagcgctacgtagctaatgtcccggctttgtcaaccatgattactagggcagcgcgggtactgttgcctatggggaacgtcttgactactattctgaactcggggaaggacaatctgcttcggatagagttgccgtactttgtttcctatgtccggggcataatcctttaccctagggaccgccggggcctaaaagggaaggggctcccggaaacaatttcacggggcccatgc

SEQ ID NO: 638403 - DNA, 397 bp, Homo sapiens
tgaggaatttgatcatttatatcagaatggccatattctgaggccagtttagcgttcattcaatgacgatttactcctcttttccattgaaggtcatattgaggttaaatcaatgactgaagtttttcattgataaaaacaaatgactattgaaagtgcaagtcggtatcgtgcataaatttactggtctctgtggtgattttagaagggtgtgcctatttctacttttaccccatactctttaacccgatacccaagtactgtgctgtagtcaggatggccgagcggtctaaggcgctgccttcaggtcgcagtctcccatggaggcgtgggttcaaatcccacttctgacagatgtttagttcctctcaggagtcatgctgcgaagcgtcgacgc

SEQ ID NO: 638404 - DNA, 324 bp, Homo sapiens
ttcgatttgggctacagtcagcacaattggtgtcaggtggcgtaagctctcaaagacgggccaagatatttgtctggaaagtgagaagacctaagagcagctgaattgtgttgccaagggaagatctgcctgccgctaggagatgttaagaatagatggagagctctcctgtagggcatggctaagtgacaggcttccctgggggaagatcgatgtagccatatgacctgtggagatccctcctagttctcaggaccataaatttgaagaatatagaagaatctcaaactttccagtattcacacacagttggccttatccgag

SEQ ID NO: 638405 - DNA, 137 bp, Homo sapiens
ctggaagtcttgtaggtcgtagtgtgggtggtgtagttgacagtgtagttgtacccagggcgcaagtccacgagctggttgccctggcacctgctgctccagatagtcacagatgctggcttcatacggcagtccag

SEQ ID NO: 638406 - DNA, 142 bp, Homo sapiens
gtgacaaacgtcgcacgagccccagacaccaccaccccgaggagcaggcccgacagtcctctcaaggagggagtcttccctctgaggaaaagggactcccccaggaggaatctgaggagtcaaactcagcatggccatttag

SEQ ID NO: 638407 - DNA, 336 bp, Homo sapiens
  misc_feature (288)..(288): n is a, c, g, or t
  misc_feature (297)..(297): n is a, c, g, or t
gagaggtggccgccatgcttctgtgccgaccacgccccaggacctccggagcgccctgcagggccgggcagggggacagcagggaccgggcacagccttcccccttcgcccgcggcacagtgcacgcggcttgttgacttgcaagcccgggcggagcccttccgggcgggcgtggaggaagggaggcggcctccatgcactttatgtggagactactggccccgcccgtgccttcgtgctccgcagggcgccccagcgccgtccgcggccccgccgcagaccagctgncgggtgtgnagaccaggctcctgacccagccatgcatgcagcgccacc

SEQ ID NO: 638408 - DNA, 130 bp, Homo sapiens
tgcactccagcttaggtgacaaagtgactctgtctcaaaaaaaaaaaaaaaaaaaaagttaagggataggggttgagagaatggcaaagaggcagggatgatttctgataatttgtgacaacctggagct

SEQ ID NO: 638409 - DNA, 104 bp, Homo sapiens
acgtgctcccacctcagaaagaggttacaaacgttctctttgctttttgagaacccattttgtagttcattgttgcagattgtaattctaataccaggattaga

SEQ ID NO: 638410 - DNA, 1296 bp, Homo sapiens
  misc_feature (141)..(141): n is a, c, g, or t
  misc_feature (560)..(560): n is a, c, g, or t
cacaaccagctggaaacaatatgaaatgatctgcgtgacatgtgctcttgaatgccctaggattcatcctgatcattctcaccgtagggtgaggcgctgacatgagcagcttgtaattatgcaaacttcattcactagacnatcgtagctacacgagcacgtactagcgttggtaagctcactaccaggctatgtccctaatcatgtagcgacgcttgtatctggccaatcaatagtgcgaagggcttcagtgtcaccttgcatttatcccacgtacttctcatggcgtacaccacgtgagatccaaaagctaacgacagaaaactccatgttcgagctattcatagtacgatctggcagtaaatctaatctctttcgttcccacaactgattctctcgtgcctatccggaatggaccggacagtagggcgtcaggaactacccacgatgctatcacaccaacaatgacatacatcgctatctatcttggagcgctcgatctcatttcatctacacagccagtaaattgttcactaagtactttcatgattgtgatgaangctcttctgcattcaggaatgcctgaaataaggtcccttaaatatgttaaaatagaagcacacttcaccattgaaaacgcatagtgaatgtgaacttagttattgggaattgcccgcactctcaaccatatcacagcaactagtttcctgaaattgaagccccaggttagtaacctaattgataactcgtaagaaccagaaaacattatgggaaggggattccgaaacccccctcgcaaagatagaccttggctgtttcttaaacgccggatacccccccactgggtgccttcccaggtagtacttgttttccgagccaaatggcgattaaggtaaattggtatcaaacgttttaccacaaaacatgtatttgcggtcaacgtcgctcaggtcccttcaaaaaaaaataccttgggaggaaaacagaggtttcgaataagtgctacgacgcctggcgcccctccaaccagggattgacggccgcaaccacggtgtccaaacacacaggtggccgaaaaaagaaagagacagccggggcggaacacgaaaaaaaagatcgcgcaggggagatattccccccgaatggtaaaaaaggcggccccggggggggcaaaccctggccggcgtcttcggacgaggccaacagccgccgagagaggggaagtacgtgaagagcgagaacaagacggggggaccgacacacacggggggcatcccaacggacaggcgatatgaa

SEQ ID NO: 638411 - DNA, 1026 bp, Homo sapiens
tcccctgcccccccccccgggggggggggaaaaaaccccccctcttaaaaaggggggaaaagaggggccccaaaaaaagaggggtgtggcgccctcctttcttatatcaaaaaaatgttgtgtgattatgttgtgtatgaaacccccgggtctattgtgttccataataataaaaattttgtggaacaaccccctctccccctgggaccccgagaggacacccaaaattcgcctctttgtggtgctttccagagggcgtcggttgtttatacaacgagtgatcttgtggcgacatctacgacagaagaagagaagaaagagtggcgcctatttaaaaaaaaacacaccagcgcgcgtgactatccaccggaaagaaagtgtatcccgagggcgtaacaagacaggccggccgagaactaaacactctccgcgggggagcggggtctttctcctcgcccgcgaggaacacacagagtgtgggtcgctccccgggcgccaccaaaaaaggtggacgcacaacagagatgtgtgagaccccccccgcttgtgtgtgtgtctcacacaaactcaccccgcgagatggagtataacactcgcgtcgacgcgcacgagcgactcatcgcgtgggtgtggtgtgttcctactctacaaaaacagccgcaccaccatcctagatatacgatggggagaaaactcctcttttttgtgtctcgtctcccccaagagggggtcgccccaacactcgcgcgagcaaaagacacatagatgtatggggaaaacaatctaatccccccccggagtgagggtttgcccaaactaatttgtgttctgctcagacacacgcaggttgtcgtcccaaaattgttgctcgcccgaatcgtctggttgtgcaaacacaccattagtaaagagggtcggcgccaccatttattattccccctcccagagggtctgtctctggtaaaaaaattgataattgttgtagaaccccccttttgttttgtggcaccctctctagccccttga

SEQ ID NO: 638412 - DNA, 122 bp, Homo sapiens
  misc_feature (72)..(72): n is a, c, g, or t
  misc_feature (83)..(83): n is a, c, g, or t
  misc_feature (93)..(93): n is a, c, g, or t
atcatctacttcccagtcgctcggtacctcagaaagcggcagcgcccaggctggtgtggacctgctggcctntggtgatcctnctaccccggnttcccaaagtgctgggattataggcatga

SEQ ID NO: 638413 - DNA, 331 bp, Homo sapiens
ctgtcatatggagaaggcagctacaggcaatatgaaaatgaatgaatatggtagttttcccatttatgcacactgaaatttggatatcgtataatttttattgtcatgaaacataagcctccttttgattcttttcccagtcatttaaaaaacatgaaaatgtattcttagccaatgggccctaaatgaacagatggccagacagatttggcccactagccattgtttaattgctcttcctccatggtggtagatcccttatcttggccgcacatcagaatcaccatcccaggtaaatctaattatacttcttgtgattgagatccctgaa

SEQ ID NO: 638414 - DNA, 108 bp, Homo sapiens
cgtgaaggagatgccccatctcgctcgggctcagtcaccgtgtactcccgggtggaggaggaagtgatcactgaggtggagtagtggtacagctccgtgtagggctca

SEQ ID NO: 638415 - DNA, 198 bp, Homo sapiens
ggggacagcatcttgtgtagagaatcggcgcccgacaaagcatatgcgctgactttggctcataggcgagctcgctttagccgaacttgagcctcaagtgggagccgtaatgccttgacactttcgtcccaagccagagccttcccgacagcccatggactgcagcatcttgttgccaattgttacttgtgtgtcaag

SEQ ID NO: 638416 - DNA, 470 bp, Homo sapiens
catctgccggcgccggtcaatcgtagaatgatgggtacagtgtaaatgtcaggtctcttacttggactctggcatataccatcaggagcattttaccttgattctgacttaactgccttttcccttatctcctttgtcaagcctcaaaaattctaccggttcttactgcggctgggtataacttactagtaatatgcatttacgtctcctttatgtctgggcatggtatgatacctcatttctttctttcttccttccttccttccttccttccttccttcctttctttctttcttttctttcttttctttttttgatagtgagaaagcccaggcgggcgtgcagtgcgagcatcggatcacggcaacctcggcctccggggatcaagtaattctccggactcaggaccccaagtagctaagactacaggcccacaccatctggcccggctaatagttggtatagaaaga

SEQ ID NO: 638417 - DNA, 115 bp, Homo sapiens
ggatcccccaagtaaacagctatactatagaggttaaaattattcccataacggtcatctgactagagaataatctatttgatataagaacacagaagtgccacggtttaaaaaa

SEQ ID NO: 638418 - DNA, 421 bp, Homo sapiens
cgcgtcgaccatgaactcatcatttttttatggctgcatagtattccgtggtatatatgcgccacattttctttatcaagtctatcattgatggacatttgggttggttccaagtctttgctattgtgaatagtgccgcaataaacatatgtgtgcatgtgtctttatagcagcattatttataatcctttgggtatatacccagtaatgggattgctgggtcaaatggtatttctagttctagatccctgaggaatcaccacactgacttccacaatggttgaactagtttacagtcccaccgcatctagcctgatatagtaacattgtagtacttatgttaggaagtgaatctttattcgataattggattcaccataaaatttttctgaaatgttctaagtcaattcttcgtcgacgc

SEQ ID NO: 638419 - DNA, 900 bp, Homo sapiens
cggcgcccttttgtttttttttttaaatttacacagaagttgaatatagcttaatttacacgagcagggatttttttctattcagtctccagtggtgcctagataacttccttgagtgcaagatatgcccttttaaaagaaatctatgcgaacatcctaagattaacagatgttggtgctcctcaatgaagaggcaagcttgaatatatcagcagctctctaatgcctcagttactcagaagcaattcttgtggcagtctctacatcccatgattttagaagacaaggccagtatagactggcattcctatcaaagcccatagcacataggtttcctatcttggggggtatcctgggactagaaacggggggctccagcaatagcactatgtgcccaaatgtcgagctgtctgttggaacatttcgggatttgtgtttggacggatttggctactaaacagcatccggtggatcatctgggctctgcaagttgccaatagtgctttgccgtgacaataataccgtgcggagagtcattgcagctgcccattggatcttacaggaatatccaaaaaatagcccctgtgacggacgtaatattaggatgcataatttagttgattaaacgcggaccttagggggatacacatgggaatgtgctggaataataaatctcaagggggattatccctcctacaaatgggtgcatgaggccggataatcctctaatctggaaattcattagcagatctatttatgagatggcgcttccggatttagactcttgagaccgagacgtgccgaaatgatattgccgattattaaccgctcgtcgaaaacgaacagcttttacggcctgtatggaaagtaaacggggttgaagccaaggacagaacttat

SEQ ID NO: 638420 - DNA, 332 bp, Homo sapiens
  misc_feature (257)..(257): n is a, c, g, or t
cgtcgacggcagcttacttgggaacaacatcttttgtggtttaagaaaatgtggggttggctgggtgcggtggctcatgcctgtaaccccagcactttgggaggccgaggcgggtggatcacctgaggttggaagttcaagatcagcctgaccaaccctgtctctactaaaaatacaaaattagccgggcatggtggtgcacgcctgtaatcccagctactcgggaggctgaggcaggagaatcacttgaacctggnaggcggaggttgcggtgagccgagattgcaccattgcactccagcctgggcagcaagagcgaaactctgtcttta

SEQ ID NO: 638421 - DNA, 510 bp, Homo sapiens
cttcctttgtcccggtactcagccttgggtgatggtgggccttgggctcagggtcccaaagacagcaccccttcccccacagagcctggtaccagcccctccttgaagtgggtccttggaagcccctcaagaaggttctccccacactgcaggtcaggaagcaggcacagcagggcccagggcacccccgcaggaagcaggagcagggcctccagcacaggccctggggtcagccgccaactgtgaagccccggctcggcggctgctctgtgcacccggtctcagcgtcaccatctctcagggctggcttggcaccctctccttccctctctctgctaacgtcctgcacccccgagcccccaggtccaccgtccagggtgagcatgaacacccacaaagtctccgaccctcgcccgcacagctcttccgaggcgcccagaatctcagtccaagcctggccctggtcgcctcgcactgcccaccgcactctgctgggcaccttgaggttct

SEQ ID NO: 638422 - DNA, 1393 bp, Homo sapiens
aacagccaatacatatcccaaagtacctacatgggattctgagaactatgccagacatcacctgatcatcgtccaatatcatttcctacaggacagtacatcaatcgaactcaaggaacttatcagacaaagactcatacattaatcaataatccatcacaaacacatgatccaacggagatacaggagaagcacgacaaaatgagaaaaagaaaacgaaatacagagaccacaagatcacagacggaacagaaacacagaaacaacacgaagagaccaacaaccactgcacaacggaacacaacaaacaaaaaccaaaaacacacaggagtcaaaacaaaaaggaaacgaagcctgctgacacaatgaccaaccgggaaacaaataaaatagcaacacagcaccaaaaaacgacaggcaaagcaacatgggcacacacccactgcgcgaggaactaaaaaaaaaaacaacaaccaaaaagctagcacaccacacaccagcaggcacactcaaacaacttcaataatcaaaatgagaaaataaaaaaacaatacgcatacaaaaaacaaaataaaaatataaacctaccagcaataacaacaccacaccacatatctatcaacagtcaatatatcaatatccaacaccatacaaactacttcataaaacagaacatgcgcccataccacacaaccacaactagagagagatgcaatacgaagcgagaggaaataaggggacgagacgtcagcaagtacacagaagaatgaacgagaaagcaacacacacagcaagcgcagagccaccgagataaactaaggcgacgcaacacaagaacagaagaaacaagagagagcaaacaacaaaagacacagagaacaaggagcagaacgggcgcgcagcaaagagcagcacacaggaggctcgcacggacaccaacagccacggcacaggcacacacagaagaaaagaaacagcacagaaccgcccaccaacaggagacgccgcacaaagaagaagaacaacaccagagcagagacgagacgcaaacataatcacaacaagatgtcaacccagaacccaacagagacaaagagaacacaaagagaaatagaatgagatacagaggaagccaaacacgaccggaacactggatacagacaaacacgcccgacaacaccaaaaagcagacccgagcgacgacggaccacaacgaagatgaacagagaccagaggaacaaccaatgcagggagagagacaagcgcagaagcagcacaaaacagcaagaaacgccaaacaaacgagacgacaggcacacgaaaagcagtacaagctcagagacagaagcaagcacacgccgacgacagacagatcaaaaaaactcaaaaaaga

SEQ ID NO: 638423 - DNA, 214 bp, Homo sapiens
cttatttcccttctattgtattggttgcaatgatgtggctgatggtttcgatactactagtatggggagtaggggtgtaggtttgccttgtggtagaagtgggcatcggcattattaagtcttagagcgacagcctatcatcactgcgcccgctcttccggcgatagccatagcttggtctcatcgattgatgggtcgttaggtgtacagtcag

SEQ ID NO: 638424 - DNA, 279 bp, Homo sapiens
  misc_feature (1)..(1): n is a, c, g, or t
nagaggtagcagtctgtctgagtcgtcaggcctccagcagccgccccgtatatgccccggtcactgaagtcgggacacaatcggctttaaccaatggatgacgggcgtggccatcagtgagatggggagaggagtctgaactaaacccctagctttcgtgcacactgcatacgtttcagaactcctggatggtgaccatctctggagtgcagcgcttgctgcaggtggaaatgatcaggaatactggccgtgttttctcttggcctcccgagggttccc

SEQ ID NO: 638425 - DNA, 797 bp, Homo sapiens
ggagaactagtcgcgagtttattttttttttttggcaaattagggcttgtttatttaaagggctgatctatgtaatcacagaggccagttatgtacagacaaatggggaggtatattcctgggtctcttcctccgtgtggataaagtcttgatgatctcctccttctgggcctggaggcgcgtcttcagggtcgctggcgtgcttccctggggtctatagaacctgcgggcctcgagccgggtcgagccaggagcttctttgcgggcctgtatctgcctctcagctcggtgagatgtgtgccagtgagaactccgctggttttctgacacacattcccctatcaccttcgaggtacaggctgtgatcactttgtggggagcgatcttcttagatccagggtatcttctggagcagcgccggcgcaaaatcgtcgatttctcctcgatccagtgtgaccttctcgggcgacttcgggctgtgggctgtacccttccggtttacctatgcccatgtggctgcccttccggggggccaagggtgttttcccgggatcgagcccgggatagggacgcgtcacaggcttgcggatgatcagccatcttgtgatgagctctccggatctgctgacgggagtgggcatgggcggattccatgggtctcattggggtctaaccagaccttcttctttgccccagcggaggacccctagaggggaggcttttttgaagctgagcattatcatggggggggcgccgttccccccatttttttgggacacccaggggatcgggctgat

SEQ ID NO: 638426 - DNA, 111 bp, Homo sapiens
gtctagcaatgcttgcagtggacaggtagcctgggggagttggggagctgcagggcagggtccattgtgtgcaaaatctgtctcgctgacttcctctgggcaaaatgttgc

SEQ ID NO: 638427 - DNA, 243 bp, Homo sapiens
cccgatagcccgacagctgaacaggtcccaccctgtggggtacgaggagacccgctcaggcctggactgctgtgccctcagcccctttgtggccaagtggcctggcgctgggcgtgggcttgggctctcccgtctgtgggcgtgcatcgtgcctgacgggtgacaacaagcttgcgccttagtgctttgacgcgtttccaggtgcccggtgacatgtggcgacatgattgtccgtgatggaca

SEQ ID NO: 638428 - DNA, 305 bp, Homo sapiens
ctaaatgattcttgagagatctggatggggggtcacatctaagaaagtcttgtcctaaggtcaaagtcacaaagattgttgtgatcctgtgtttgcttctagaaattttatgctttcaggttttacatttgtatctatcatccattttgagttaatttttatatatggtacaatatgtagattgaagttatttggttttgttttcacatatggatattcagttgttccagtgactgggaaaaataatcatttctccaatgaactgccctcttgcttttgtcaaaaatcaattgtccacatatgtg

SEQ ID NO: 638429 - DNA, 100 bp, Homo sapiens
ctaccattagcggacagagatgcagagaaagaagactacatctgtgtgcgctgtactgtgaagggacgcaccaagccgaaagtaaaaacacaacacaaca

SEQ ID NO: 638430 - DNA, 593 bp, Homo sapiens
  misc_feature (37)..(37): n is a, c, g, or t
  misc_feature (67)..(67): n is a, c, g, or t
  misc_feature (71)..(71): n is a, c, g, or t
  misc_feature (73)..(73): n is a, c, g, or t
  misc_feature (103)..(103): n is a, c, g, or t
  misc_feature (106)..(106): n is a, c, g, or t
  misc_feature (108)..(108): n is a, c, g, or t
  misc_feature (116)..(116): n is a, c, g, or t
  misc_feature (118)..(118): n is a, c, g, or t
  misc_feature (133)..(133): n is a, c, g, or t
  misc_feature (141)..(141): n is a, c, g, or t
  misc_feature (148)..(148): n is a, c, g, or t
  misc_feature (150)..(150): n is a, c, g, or t
  misc_feature (152)..(152): n is a, c, g, or t
  misc_feature (165)..(165): n is a, c, g, or t
  misc_feature (193)..(193): n is a, c, g, or t
  misc_feature (268)..(268): n is a, c, g, or t
  misc_feature (332)..(332): n is a, c, g, or t
  misc_feature (384)..(384): n is a, c, g, or t
  misc_feature (427)..(427): n is a, c, g, or t
  misc_feature (430)..(430): n is a, c, g, or t
  misc_feature (437)..(437): n is a, c, g, or t
  misc_feature (446)..(446): n is a, c, g, or t
  misc_feature (492)..(492): n is a, c, g, or t
  misc_feature (533)..(533): n is a, c, g, or t
  misc_feature (551)..(551): n is a, c, g, or t
tcttatacctatctgagtattacagaagttgcttatnccttccagagctcatggtggaaagagtgtntaancnattttgataaggagttgaaaaacaatttgntantngttttctnanagagaatcaggtggnagattttncttcatntngnttggtcttcagtnattgttctggaatgctgtttcacttgtntcgatgtcatgttcctggttcaatttcttgaactccaccacttggtagatgacgtgctcaaggatatgtttggcntcctgttggtcctttggtagtttactggttactccaagaatttcaccacacttcctgacataanattccaggtcttcttcagtacacttattggtaatctgagccagccgtgcctnctcagaggagaacgtttcatctaaatcaaatagctccagaggnggnggtggtnactcccggnaactgggaggaaaaaccgccgctgaagggttggcgcggcgtctccnactgaggttgggtgagctggagtggttctgtttcccctttngctgctcgtgagcctcgntgacgctgtggggggggggtggtgtccgcgcgtgggggggtg

SEQ ID NO: 638431 - DNA, 369 bp, Homo sapiens
  misc_feature (1)..(1): n is a, c, g, or t
ncacatggcaaatgcttaataaatggtggttcccctctgaccctgacagtgccaaggtgtggggtgacctgtggatgattcaaatgtcccaactcacacacacaagtcttcctgtatggaggtcttcttatgctctgactttgtctatctgtggcaatatttataagttttcctctaaacttccttctcttctggtctacctgtcttccattacttttctctatcagtatctttaactattcttattatcacaattttgttctctccctttctacctctctttctccctctctgtctgtcgtgtgctcttatgctctctcttctatctcattctctctatatttcatacctttcttctctttatttatc

SEQ ID NO: 638432 - DNA, 423 bp, Homo sapiens
cttggcataggcgatagtcccacttctggcgataggcgatggtcccatctgggtcgccaagatgtgtctggaattggtgggttcttggtctcggtgacttcaagaatgaagctgtggacccttgcggtgagtgttacagttcttaaagatggtgtgtccggagtttgttccttctgatgttcagacatgtccagactttcttcttctggtgggttcatggtctcgctgacttcaagagtgaagccgcagaccttcgcagtgagtgctacagctcttaaaggtggcacatctggaggtgtttcttcctcccagtgggttcatggtctcactgacttcaggagtgatgctgcagaccttcacggtgagtgttacagctcataaaggcagcacggacccaaagagtgagcagcagcaagatttatg

SEQ ID NO: 638433 - DNA, 1724 bp, Homo sapiens
taaaaaaactttataatttttaagggggaaataaattattcccaaaaactttctggggcttaacaattggaataacaatttttttatatcttcaaaaatatggggatttttatattataaaaatacacccttgtgtacgccactggatatgcgccaaagtggtatgggtgttacccatgggcccaaatattcaaaatataaatatcccgctatattaaacacctggctctgggttaggtggctccggaggttagaaacaatgtatctctctccacgctgtgggagaggggagggcgtgcatgtgggagtaaactcacgcgtcgcttttgagaagcgcgatagatatactctcctgtgtgctgtgggtagaaatatggcgctatgtgggatatcctgtggctcagagagacaacaccccacactatcatcaagacactgtgacagcaggcggcctccctgtgagatcttctcacaagagggcttatctcaggatgagacacaggggagcaccccgcggagaatctgtgagatatgtgacacactagttaatatatatctcctctcagaaacagcgcacaaaagacgatacttgtgattttctcccccaccacacacagaggggaaatctccctctcagagtgtgtctctgtctacaagatgtgtgcgtgctgtggggacgccacctctctccccaagagggtgtgttgttagtgtgcgctctctatgtgagagtgtcgctgtgcgccgaggatgtgtgagagagggggattctgtgtgcccccgctgtgtgttgtatacctatcacagtgtctccggggtgttctcccacattctcaccggtgtgtcgcgcggaagaaatgcgtggacaggagaaacaaaggtgcgagagacactgtgcacaacacagaaagtgttccccactgtggggcacaaacatcaaccaaaaggaaaaaaccagtagcaatatttgggtgtggttacccccagaaagatttagaggagggtccccccacacccgtgtgggccccccacatgttgtgcccccacaaaaagaagaggccccgagagaaaaccactctcccgcggagacctccccaagggataaaaccccacccataagacagagggtgtaccccccgcgggggagagaaacaaacacgcgaacgaggatgtctctaatcgaggagaaacccccccgggatgaggaaacactacccttgagggacggaagacgctctgcggaacacaacacacgcgtcgcaaaagatcgttgttggtggtccccccaacaacacacgcgcaggggtgaggccccaataccaagaaatctggagccccctgatttttgtaaggaggacagaatacagagggccgctctgtctcacagaggagagccccccacagggagtagaaaaaaccccccgaaagtagtttaaaaaacggggccacaccccagcggcgtgtgtgaacaccaccagcgaaaaaaaacttctacagagcccccccaaacgcggatggtggggaggcgacctagcagaaccccacgagagaggcgaccccagaaaaagggggcactagatcagcgaggatatagcaaccaccacagaaaagagtatgacttatactgacacggcagagaaacaccaacacaactaggcgtagacgagctgccgcacccacgacggaccacccgcgaactatgataaagacgtatacgataagac

SEQ ID NO: 638434 - DNA, 1097 bp, Homo sapiens
tgccgcgagcgcagctgagggggcggatgactgggtgggttgcatagtgagtcatagactgggtgtcacttatgggtagagtgcggaatagtagtgaccctatgaatgtcaaaaggacgtatggacaataccatctaacccatgtaaagataaccaccaatacgaagacaacaggacaatcgatcaccgaacatgggaacagacaatggaagaaaaatctggacacacaaacacttctacaagtgagctgcgtgtggctcccgaggagcaccccgtgctgctgaccgaggcccccctgaaccccaaggccaaccgcgagaagatgacccagatcatgttgtgagaccgttcaacaccccagccatgtacgttgctagtccaggcatgtgcatatcgcctgatacagccatctggaccgtaccactggcatcgtgactggactccgagtgacaggaggtcacccacactgatgcccatctacgaggggtatgccctcccccatgccatcctgcgtctggacctggctggccgggacctgactgactacctcatgaagatcctcaccgagcgcggctacagcttcaacagcacggacgagcgggaaatcgtgcgtgacattaaggagaagctgtgctacagtcgccctggactacgagcaagagatggccacggatgcttccagatcctccctggagaagagctacgagctgcctgacaggcaggtcatcacattggacatgaggcggtatcagtgccctgagggcactcttccagcactttccttcctgggcaatggagtcctgtgagatcacgaaactaccttaactccatcatgaagtggtgacgtggacatccgcaaagaaccgtacgccaaacacaagcagcatgagaagaccacctgtaccagggacatggcggacggaagcaaaggggagaaaggccggaaccagaacatgagaacaagacatgacacccgaagagagaacacagagacggagagaccaagggacacgagcacctacaaatgatgaaaacggaaagacaacagacacaagccagaaatcggaaaaaaagagcgcatagaaaaacgaacaaag

SEQ ID NO: 638435 - DNA, 104 bp, Homo sapiens
tggaagagctagatcacgggacagaggcctggggtgtgtacagcacccgcagagcttgggcggggcaggcgtgggtgacggctgtgggacggcaggaccacaca

SEQ ID NO: 638436 - DNA, 114 bp, Homo sapiens
ccccatgtctctcctgttatcagcatctctcaagaggatgagtcacttccttaattcgccacagatcgagagaccaagatgcaactggtcacccacaaccactacttgtaatag

SEQ ID NO: 638437 - DNA, 616 bp, Homo sapiens
tggtaaatccattcattgaaatggtttctaaactgtataatgtaattgggagcctatttagtaataaaataaaatgtcctatgtagtgctacaattttggaataaaaagtgatcaattgtaaaaaaaaaatttaaaaattcagcccagaaaaacaaaatagtgtattaaattagtttaaggtaaagggaatttataagatttttttcctcaatatagatacctcattggaaaagaaagcacagcatacttaagagtagttctagtaaacatgtcctagaaaacagttgctaaatgtgaggacatctttggaggaatagtttatgagaaataaaattttactggttttactatcctgtagaagtattggtttatccggataattttaagccaacatagtagtcttaaattactttggaattcctaatctggtgaaggcggtaaatgaaatatctggttctgcacctggtgaaccaaataatgggctacatggaccatatttaacgttcaaacactttggccaatgatgtacagttatagggtaaaagtcgctgtggtgggttgcatacatgaacacagaaaacggtcctctacctccgtgaactacctatctcatag

SEQ ID NO: 638438 - DNA, 128 bp, Homo sapiens
aaaacaagaagtaccaggataggaaactaaggaaactagaacacagaaaaagaaggacatagacagaagtagtaagacataatctagatagaacactaataaatagatacacatactagtaataacct

SEQ ID NO: 638439 - DNA, 211 bp, Homo sapiens
ctccggggttcacgccattcaccgggcctctccaccaggcatgtctttggcagtcccaatataaagggcagagtcatgagaacttcacacggcaagggtgaggggacgaatcttggtaggggtatagtctctgcaggtatggaggctaatggtaagggagctgtgtcccttgaccggggttctagtctttggagagttcggccaacggtgc

SEQ ID NO: 638440 - DNA, 275 bp, Homo sapiens
cctgatttcctgatagtcgtctctagagtatccaccctagcatatatcctaatctggatcgcaaatgagccgatctcagctcactgtagcctccacctcccaggttcaagcgattcccctgtccttagcctcccgagtagctggaattacaggtgtgcgctaccatgcctggctaatttttgtatttttagtatagatggggtttcaccatgtttgggaaggctgttttcgaactcctgacctcaggtgattcacccgccttggcctcccacagt

SEQ ID NO: 638441 - DNA, 790 bp, Homo sapiens
  misc_feature (179)..(179): n is a, c, g, or t
  misc_feature (188)..(188): n is a, c, g, or t
  misc_feature (191)..(191): n is a, c, g, or t
  misc_feature (449)..(449): n is a, c, g, or t
  misc_feature (554)..(554): n is a, c, g, or t
  misc_feature (570)..(570): n is a, c, g, or t
agcggtcttgactaaaagtacaaagattggccgggcgtggtggcaaacgcctgtagtccctagccactcgggaggctggggcaggagaatcgcttgagcccgggaggaggaggttgcggtgggctgagattgcgccaccgcactccagcctggacgagacagtgagactccgtctcaanaaaaaaaanaanaaattttaagtgaatttagaggcaggtgacacaattcaaccgctaacttagaccctaatcaaacccttccactggtgtctgtggagtttgtttctttttcatgcctcccgtttttatcttctctgtgtctatctgtacttctctaaccaggatctttacagccataatgcctatggtagcagcgggactgataatagatgaccccacactgcagcctgtccgacgacttgtttcccttgtaggcactgtgtgtgtttngggtttgtttgagctgcccccttggaatgtctgcttcggctactgctggggctgacctgtctccccctggccacttaagctgcatggccgccacctgtgtgctcnatttgacgtggatgtngagtgtgatttcagctgtgccactggctgcgctcggtctactcgagcgaagcctcagaattctcgggtctgtcaccgataattcttttagtctcttctgtatctgtgttaaaagcaccttgcccatgatccagtaaagaaggtccttttaagtgacgggttaggtaatcaagcccactggggcccgagtgacactaaccctatgttttgatgtgcacctg

SEQ ID NO: 638442 - DNA, 257 bp, Homo sapiens
cccacttccacctttattaccagcacaaccttaggccaaaccatttacccaattaaaggtttagggcggttagaaatttgaatcccttggcgcaattagatttaggtacccgcaaggggaaagattgaaaatttattacccaagcatatttataggcaagggacttaccccttataccttctcgcataatgaattaactagaaataactttgcaaggagagccaaagctaagacccccgaaaccagacgggctacct

SEQ ID NO: 638443 - DNA, 115 bp, Homo sapiens
ggggaaaacttggtctttccaagcttccactggcagccactttcttccattgttgggcatcgggagacaatccgttatgccctggtcttcccacctattgcttttgtcccttcgg

SEQ ID NO: 638444 - DNA, 914 bp, Homo sapiens
  misc_feature (26)..(26): n is a, c, g, or t
  misc_feature (28)..(28): n is a, c, g, or t
  misc_feature (31)..(33): n is a, c, g, or t
aacccacccagacacgagtcgggggngnagnnntttaacaagcattggcaatcttggcaaaaaccttattgaaaactttcaatatccaagccactggcaacaccgaaatgtaggcaaggatgcgaattagcaggagctctaatccattgctggtggaaatgcaaaatgatacagaccctttgcaaaacggttcagcaactccataggaaaagagtatgctgacgtgctgttctatctcattgttgctatcatttagaaccactctaaattcacataattgttagaacatccaacacaataacactaaccacctcccttatttttcacatatcacccaccctccgtatataatactctcaccatatacttcctcccccaaaagaacctcaaacaccttacgcaatgataccacaagctctccacttcaacatctatcattacaatactaatcaccatccaccatatcaccccaatattatagtcatctattccctcaacactgcattactatctcattaggcctcaactacacattgtcatcgcgcacgtccacactaaccacgaccccccgccctatattgaaatcctcgcgctactcttttataatgaaaaatgctttatattaagagtaacaatacatcaaatctaaatacagtattaacaatctaccccgtccttcacgtttcccttgcaatacttcataccattttattcatataactaattagaacaactaaaattctctattccacaccaccccctcctcaactcttattcacctctaattatgtctatccattattaacactaactcttctagtctaacccaactacgatactaccaaccccagactaacaatttgtacatatcaacccacaaatgcacccattaacgaactcaaatcatactaaag

SEQ ID NO: 638445 - DNA, 191 bp, Homo sapiens
ggggggtgccatttagggatcgtggggacggggtccaccccaagaggaaagaaaggcccgtccacaggcccggctctaggcacgtgcccggaagaaggtgtttccagagtaagctaaggctttcccaaacaaccagcaggcgtggtgcttcttcttgcctatggcaccagtccagttccagccgtttgctt

SEQ ID NO: 638446 - DNA, 745 bp, Homo sapiens
cgagaggacagagagaggaggagagaggaggaggagaggagaggagagaggaggaggagggagagggggaggctagatggggcagaggataggaaaggagagaagagaggatcggcagagatggactgggacaggagagtggcggagcggcggagggaacagcaggaggcggtagagtgaggcatgtgaggagagcgcggagcaggagatgacgacagtagcctaggcacgaaaagcgcgaccagaccataagatgggcggcgatgatgggcgaacaattaggtgtacaggtgccgtcagtaaagtgtgtaaggtgtgtgagagtaagtgtgtgacaacatgcatacaacattatagtatagatagtggcactgcgctaaaaagctgctttggtcgtgcctgtaatcccaacgatttgtagggctgaggtaaaagggttgcttgaggtcagaagtttgagagcagcctgggcaacataggaagagcctgtctctacaaaataaaaattaaagaattacatatgtggtgtggtgtgcgtctgtagtcttagctacttgagagactgaggtgggaggatcacttgaggctaggagttcaaggttacagtgagctatgtttgtgccaccgcactccagcctgggcaacagagtgagaccctgtctttaaaaataaaacaaaaacaaagatgtggataaaagatgtagagcgtccaacctgggcagcatagtgagaccttgtctctaac

SEQ ID NO: 638447 - DNA, 312 bp, Homo sapiens
aataagatcgagcgcggacctacagagaagagcgtccggaaacttcagtcgtcttattcaaagtctgtatagatggctggccagcaagagtgtcttcccggtgctgtcacaatacccttctctggcgaaatgtcccactagcagcactggaaggtaaacggtcccgggccaggtagaatatcctcctggagccctacctcttctggcagatcttaaatggccaactcagccaatacccggggtcctactcagacttcaggactccttagacacagtcttgatcttcggaactgccggtgtgtgtattaggct

SEQ ID NO: 638448 - DNA, 1430 bp, Homo sapiens
gctctttcccatcttgcaagatggcggcgcttgaaagaagtttatacacgccaggataactagagagaatagactcgtaaggcctatgcaagagttcgagtagtcttgcgctggtcagggtgtaactagagaggtaatcgtcaaagctaacaaggtccttacgaaagtgggcaatgtcccccaattggcacgtgcgcagacccgtgatccttgctcaacagcgagattgagccggtattcgacgatctgtccattgtcattccatcaacaggtcctagtgtaccagacgacggaacgtacctccaaggccgactgacaagtcacagcgcgattgaaatgaagacctaaacgacaggtagaagaagctatcgtctgactaattatgaattagcacacacatacgatctttgagcagggattgaaccacagtccattgcaggggaccgatggcacgcacagcgggcgagatgggccgtaaaagatgactgtgcccaggctggacagattgctcccgtaagaaaatacgtacaaaatcaatctataccaatgccaacacgcccatcggatggaagccatccgctggcaattcgacctcggctttggggacagactccacaaagttgcggtacacatacaagaagtcgcaattccgaagagtgcaaaggccatgggtatgcacgaaataacatagcactctccgcatcccagatgacaccacatcagcgaaagaatccatcgcggcgcgcatccagttatcgttacagaccaagattttatcccatacgggcagttttcccaacctatctcctctcaagatggatcgaacgaatacggagaccccacacaaagagagcggccgcactacattttaccgcgtcgtccgacgttatccgatcgccgcatctttgcccataagcaacccacacgtattgcgaccctcagattgaggacattcacaagattgacagcggatagtgcccgaccactttggtcggaacgccacttctatcgagagttacccatccacaataggatcggcaggcgtttcgtggtccttaacgaggtaaagacgtgaaaaacacccagtagccaaatatagaggaagtaatgagcgacaccacatgtaggcactaggccacctaacactgagaccacacataccagattgcgcaactcacatgccaacggaaaatatgaactacgcatactataacacgccggacaagatatgacacgttccccatacaacaacgtggatcggtgtacgcgcaacacgattctcacaccggcaatgagccaacgctaacttaccaactaggcagaggaaccagtgagaccgacgaggaacacaacacacacgcggacacgtacaacacgcgccaacgaacatacattgacactcacatacgaccacacacgcggacacaaga

SEQ ID NO: 638449 - DNA, 369 bp, Homo sapiens
ggtggtgagatgacgactttagggctggataatggagttcacaacgccaaaatcggttacggccatgaaaatgtgtcggttattcctaattgtcagttccggtcaaaaccagcacgttttaaaatttttactgccaaccagatagatgaattaaaagacctttctggactcttttacatcctcctttttcaaaagggctactggttgaattggaatgttcagagacaagtttgggattacctttttggatacttttaatttcacttcaattcaggattcaatgattgaaattctatttgaagaacaccagttttaagcacttttactagtaaatgtctgttttttaagggccattagtttttccggagc

SEQ ID NO: 638450 - DNA, 1428 bp, Homo sapiens
  misc_feature (983)..(983): n is a, c, g, or t
ggtaacaatatgctacttcaatactgtagaaccatggataacgaaggttgactgacttcacgctgtaggacagtgtgttaccaaaagatgtcatgaacaacgactccgcatcattgataagggctcccacgcccatcttaagctgtcctctgctcatgcctgcctctgttcacttgcgtcagtggatgactagccgggtcaccttagagaattgccacagtggtacgtagcgcttctgcagaggataacaaaccagcaggtgtccagcatatgctcactcttctaaaccatcccatacctttttagccgtaaaccactactgcaggggcgcaacatgctgggaccttcgtcgtcccgaatctctgccacttagcacggggctttccgtaaaattagtaaaattgaaacccacggggacgtatagtttgctcttgcttgttgctttccgctacgaggaacactgcatggggtattccctatcaacacgaggtacgggaaaacgcttgtacactctctcattacgctacaagaaggtgcctccccttatcacaagaccattggccacccaatttgttggggtgtgcaattggtgccttcttctaacacaccttttggcccttaaaatggcacgaacttatcacgctcggttaagacaatccgcttgggatcccaaagttgacaacttaaccttcgaaactatactaaggcgccacgccaagcattaacaccatagccactgggttatccccaaagcagaatgtctgcccctaaggcacgacgcatgacataaacccatcaattttcatccaaacctactcccctaacattttcccaaaccattacagaagtcttattccgccgcaccgactcacactcgtccagccaggcaccctttcaacgaataggcccccttcttccctattctcccacctcacacccctcttctctcaccgttgctccacagcggccctcacgcacttccnccgaccacaaacggcacttccctcaaccgcgacaccccctctgggaccggtcaactccacttctgtgtctcatcacaccacagaacatgccgccgacataccccccgcgcaagctggcgcccaccctcaacaaccagccgcctcccagccgcccagctccatctatcctacagcccaccatcactaaatgcgacggaagcacacaccgtgccccgtgcgaaacgcgatatcagaaaccgccgagaggacacaaagcggcgcacccacaaccagaaccacacaaatcctccaaagcaagattgacgcacgagaacgctacacaaggaaacgccgtcccacaacaagcaccaacaggggccgcggacctaatacgaccactcacaccagacagcagggtacacccgccaccgaatagccggcagaccagtcgcacaatcaaacaaga

SEQ ID NO: 638451 - DNA, 1243 bp, Homo sapiens
  misc_feature (41)..(41): n is a, c, g, or t
  misc_feature (108)..(108): n is a, c, g, or t
  misc_feature (119)..(119): n is a, c, g, or t
  misc_feature (526)..(526): n is a, c, g, or t
  misc_feature (557)..(557): n is a, c, g, or t
  misc_feature (613)..(613): n is a, c, g, or t
  misc_feature (624)..(624): n is a, c, g, or t
  misc_feature (647)..(648): n is a, c, g, or t
  misc_feature (693)..(693): n is a, c, g, or t
  misc_feature (701)..(701): n is a, c, g, or t
  misc_feature (705)..(705): n is a, c, g, or t
  misc_feature (749)..(751): n is a, c, g, or t
  misc_feature (790)..(792): n is a, c, g, or t
  misc_feature (813)..(813): n is a, c, g, or t
  misc_feature (822)..(822): n is a, c, g, or t
  misc_feature (826)..(826): n is a, c, g, or t
  misc_feature (1162)..(1162): n is a, c, g, or t
  misc_feature (1181)..(1181): n is a, c, g, or t
  misc_feature (1183)..(1183): n is a, c, g, or t
  misc_feature (1216)..(1216): n is a, c, g, or t
gcctggccagcgctccgaaccttgtcctcgctgcgcgccgntgcccctcgtgaatgccccagcatgccctgggtaatggagtgcctgcctgctggtgcctgttgctgnctcctgctctngcgcacagctggaaccctgcgaaccctggaaaatggctggctgctggctggagcctggagcctggatcctgctcagacctgggccccggcctggccagagccgctgggcatgtctggaggcgcggaaggggccggacgaggcggaggagagccagtacgactctggcattgagtctctgcgctctctgcgctccctacccgagtccacctcggctccagcctccgggccctcggacggcagcccccagccctgcacccatcctccgggacccgtcaaggaaccacaggagaaggaagacgcggatggggagcgggctgattccacctatggctcctcctcgctcacctacaccctgtccttgctggggggccccgaggctgaggacccggccccacgcctgccactnccccacgtgggggcgctgagccctcagcagntggaagcactcacttacatctccgaggacggagacacgctggtccacctggcagtnattcatgaggncccagcggtgctgctctgttgcnnggctttgctgcccaggaggtcctggacattcaaaataacctttancagacagnactncatctggctgtacatctggaccaaacgggcgcagttcgggcacnnntgctgaagggggccagccgggcactacaggaccggcatnnnaaaaaaaaactatcatgtggnctgccagcnccanacttggcctgtgcccgctgcctgctggaagggcggccagagccaggaagaggaacatctcactctctggacctccagctgcaaaactggcaaggtctggcttgtctccacattgccacccttcagaagaaccaaccactcatggaattgctgcttcggaatggagctgacattgatgtgcaggagggcaccagttgtaagacagcgctgcacctggctgtggaaacccaagagcggggcctggtacagttcctgctccaggctggtgcccaggtagatgcccgcatgctgaacgggtgcacaccctgcacctggcagctggccggggtctcatggnatctcatcactctgtgcangnggtctgactcctgctgcggatgtggagatgaangcccaggactgacttaggatccttgtc

SEQ ID NO: 638452 - DNA, 262 bp, Homo sapiens
aggaaggattcatatcagctatgcattggtggactcctcagatattctgctgctttgcgtggtgatgcagctttgatgctgtacaggtgaggtcagtcttgctacaggcgccacatgctcattggtcttcatgagcatgtctgggatctcccgaagctctgcagttcactgaatcaagctctgacccagccttattgcaaggttgggtgcctggtcagagcagcagggaaagacaggggatcctctacgacgtcgccctgca

SEQ ID NO: 638453 - DNA, 1111 bp, Homo sapiens
ccacctgttgttctgtcccttcttgaccccgggggaaggggtctgccacacaacacgtgatgtggggccacacaccaaacaggagttccccagaaacaagtgctagaagagaagtgtgacacaccacacagatctagaggtgtccaccatgactcatgagccgttgttggaacagttggggagaacaacacccaccacaccccggggtgtacaacaagtgtgatagaccacagagacacacccggttctaagctgggagaagcccacccccgggtgagaacacagggggcacccccagacacaacaacagagacgcccatacacaccacagaccgttaacagagtgcccccccgtctgtggtctaaaagagacaccacaaaatgtgaggtggagtgccacccccacacaaccgctggaaacagggggtgccacccagacggggggcggtccaagaggatgatcaccgctccccgccacgcggcccccgttgtacacacgctggcgtgctgcccacaccgtgccaacacaagaacacgttccgcggggttctcccgcggcactgcctgttgtatgactaaatacgcccgcgcgaccacgatccgctgtaggtgtgtcgtgctgtccacagcgtggacacacacaccagcggtggcgtcccagctgtgtgtatgacgtgccaccgcggccgctgtgtgtgtgtgtatgaggtgtcacccacgtggtggaagtgtccacacgcgggttgtctgccagtcgaaaggtgtagaccgtctccgcaagagcacaaccagtgtcacgagagccccgcttcctcgctggtggcgttgtcctaagagcacctggtggggtgctccgaggcgtcgtctcccccccccagaccgtcttgtctgtgtgtgaggtgcgctgtgtgtctgttgtgtccacgagtgtggttggtataaagagtggtggtgggggcacacacgaggaaccgtgcacccgctcccgctgcccccgtccgctccgtcccggcgggccgccgtccccgcacacacccacgtctgtgcgttataagttgcgtctggaaacccccgtcacccgtaagtaagaggttttcggcggtcccgtcag

SEQ ID NO: 638454 - DNA, 259 bp, Homo sapiens
tactgcacatgcctggctaatttcttaattatttaagtagaaagtggggtcccactagtgtagcccaggctggttacaaaccgctgggctcaagcctctttctttttctttttttttttttttttggactgggagttccgctcttgtggcccaggcggaagtgcaagggtacaatctcagttcacggaaacctccacctcgggggtacaagagatcctcgtgcatcagcttgccgagtacgctgggataacagggcttg

SEQ ID NO: 638455 - DNA, 725 bp, Homo sapiens
tagctataacaggacagcagaataagcgggccacaaggtatagacagaaaaccacgtctggatgttggcactagactgcagtgtgacgatcgcaagaggagtcacacccagatgatatcattgctctagttagtactccttgagggtagagaatacctccattacttcggcactccacagctaggtataattcccacgtccgacatgggtcagagatatcagcacattgcgaagccatctgtaaaaccaaatgtcggtgtcataggtgtctcactagagcataaatcacctctatccgaatgggcacctacacacctgacagatactcattctggcgactgatgtctgtggctcgtatccgaacacctatctgtgtctccattagtagccagctttccaatggccgatgtgagaataagcactgattctctcaataagcccactgtagatctcgcagtggtgatatcccagtactgaggtattcctgtataaggtagccacgaaagggtaagtgttaaataaggaacggttgattaacacctggatgatacagatcatgagtggcagctgcaattaagctcagcaagatatcccaaggagttacagaattggcaagctaggttcctttaagtaacagtgcatggcctgagtaacatccgcagcgtggactgcgttatggtaaggatttgactgtggaatcttcttgatcataactaacatctacg

SEQ ID NO: 638456 - DNA, 408 bp, Homo sapiens
gccggtaccgaatgtatcgtccaacacaatcctaaccaaaaagaacaaagctggaggcatcatgctgtctcacttcaaactacactacaaggttaccataaccaaagcagcatggtactggtaccaaaacagatatatagacaactggaacagaacagaggcctcagaaataacaccacacatctacaaccatctgatctttgacaaacctgacaaaaacaagcaatggggaaaggattccttacttcataaatggtgttggggataacatcacgtgatttatccccaacactctgtagaattatggtaacgtgatacaacatggcagctacaactaaggactttggacaaacagacctagatttaacatatgagtctgcaacttatttgtgttgggcgataacatca

SEQ ID NO: 638457 - DNA, 146 bp, Homo sapiens
cggaccgactgttctggtgagaagtaagcggcacgcatatcgcgccgctacttcatgcgatcaagtctttccgcgcctacgcagcgcgcgtagcctccgctcctgccgcattgtcctgccagtcgagcactgtaagataattgtcg

SEQ ID NO: 638458 - DNA, 141 bp, Homo sapiens
gttggcgacactgtactccagcgtggttagcagagcagacccacctcatacaaaaaaagaaaatggattaacggtataaaataaccgtgacaaatttacaaagtaacatggcattggccatccagtacagtgatcgaccaa

SEQ ID NO: 638459 - DNA, 114 bp, Homo sapiens
tggggtctgtagtcccagctagtatggaggctgaggtgggaggatacctgagcccggaaggcagagtttgcagtgtagccaagatcgcgccactgtacttcagcctgtttgtca

SEQ ID NO: 638460 - DNA, 1877 bp, Homo sapiens
  misc_feature (1819)..(1819): n is a, c, g, or t
  misc_feature (1841)..(1841): n is a, c, g, or t
ctatgaggtaagtcttgggaagtatcactatcgaatcccaactgagtattgtaccaaagtgagagctgtcctagactaaaggaacgatagcaaggaattgagcggtcaagagatccaagactggacttctagactagccatctagactgttgtgactggtaggcagacacgttactgtggtatggtacgggcggaggcccattactcaagattcaggacaccccatatggactgcgaagtagtccatctttgttgcaacacaggtgactatagacgaagaagctaacgccaggataactcaccataggaggaacggggtgccgaggacacagtttagcgataatctagattgaatcttaagcacatggaggtgtatatgccagacgtgcaggcatcatgtaatactgtatgcaagactcgtttaattttatggagcccgcaatgcaccctgtacacgtctgtgcccgtgaaaaaatggggtgagaagcaacgttcttgggatgctgtacgtagcatatgggcactgtaacatagcccctaagcttcctccgtcaggttcctagagcaaaaggaaatcggtttttccagaaggagagcctcagggggaacccgagcatttttgttcgtactacaccgggtttgaggcggacaaggtgaggtagaaattgcgctcctacaagggtaaattcaataggtaggtcttaatgtagctttgtgttttaggcgatgagcggaaaggatataacggcgctaattttggagaaaaggggcatttgggaacgttcgcaacgtccgacaactttagcaccttgatcacgttagggcaaacatcggcaccacgtggaactaacggcagctatcggtatatgaggcgaaccaaggcgcccggagtacgttacggtaccagcgcgcgtacaacggaggcgcatacaccaaggcggcagaattaacaaccctttggtacccgatcgtagaacccctcttaaaaggattcctccgttccgactttgggtgtggtcggattcataccacccgacagcctaatattttgccgcatagggcaacgcgagcccaaaccacattcgtttcagtcgagcaaccttgatgtctaatctacacggtcgcctaaaaatatgtcctccgtttggtcagtgtcgctgtacagattgacacatatttcaccttttccaatgggctgggcaacgatttatgggagggcgcaacactttagcatagcgcccctatacacgctctctcccctcggcgcgcccactacaagccacacatggcaaccttctttccaacgcgcgaatacatctatactgaatacaaccaaagtgagcacccattgacgaactccaacacgctaaggacgttggccttggcctgcttgtaaccgggggggatacttcccacacacgtttagagaatgatactgcaacgttttgtgtgatgagactaacagcggtttcttatgaacccgaacctttgcagtgtcaacaccatcctaacggctcctacaataaatagtggcccgcaacactgaaaccaggcaaacctttcttctcagacacaacattattactgcggcctctaaccggggtgcggagcaccgcccttcataagcttacatatgtaatacaccgcgcatggtcaccccaccaccagtgttatggtgctacgcaccggacgcttcaacagcactcgccggttgtgtgcaatcacgtggctaccaacataaatgattgatgactgcgactctgagttaatacacctaacagatctctagcagcactgatcgagactaatgtgccgaccngctcgctgccgcgtcgaacacnctaccgttataggaatacacgcccactaaacacatg

SEQ ID NO: 638461 - DNA, 294 bp, Homo sapiens
agcctggcccaagttatagaaaaaaaaagttacaaaaaataaaagattccgggaagctttgagctagggattgacaccataaaggtgatgtgaaaagctcatcattattttgttgtgacttcaagagtacaagatgtaacaggtagaaatatttccatgaagcattgctccacaattactgcattcttatctttacttttcattgctataagttctgccccactttctgcaacataatttgttgaatgcatggatatttacaatgcaatttttttccagcatcatatggctttc

SEQ ID NO: 638462 - DNA, 684 bp, Homo sapiens
  misc_feature (235)..(235): n is a, c, g, or t
caaaagcaaggacttttttggacagagttctatggtttgaaaaaaaagggggctaggttcaaaaactgtgtggcccacagatttctgcgtccaaatggaaaagcttgggttcgctacagtcaactttctgtcattctcaagacagaaaaggattgcctcacaaagtgttaaaaagaataaatgttggcacgccgaaatcagtaagctaaatggaaaagccaagctaaaacgtgcntagagaatatatgcatcccattctattccttaataaggaagttgctaagcttctcaaagagagaaagcaagtcagaaagcaagagtgccatgcttacctcataagaactttccctgtggccaaagaacagccagtactcaatctcgcggtccgttcactaacatatatgcatatgtgatgcctggaattggataggctgaccagccattcaaaagaaggcaaccttttgtttcttacaagcctatgacctggaggccccctccctgttttatgttgtcccgcctttctggcaagaccctcaatgcatctcacacgtgttgattaatgtgttatgttgccctaaaatgtagaaaacgaagaggtgccccaatgacctcgggaccattccaggtttactccccaaccagtaactccgtgtggtaagcaacatggctttgatgatcttcgtc

SEQ ID NO: 638463 - DNA, 185 bp, Homo sapiens
ggaccccatcatatcagtctcttgggcttcgtcaaccttagtcgctttcgacttgctatgcttgccttcagcgttgaatttacgtttgggcatcacataattcaaggccaattcccagtcctttgcctcggtccacttgataagaatttcaaagacttgatttacggtaaggacctttcgggtcg

SEQ ID NO: 638464 - DNA, 116 bp, Homo sapiens
ttccaggcaatttaaaactttcaaagttgggggtatccccagttcccccatttaaatttcatttattgaaaaatcccctaaataggaaatagaaagatgcctggggcccttcccga

SEQ ID NO: 638465 - DNA, 236 bp, Homo sapiens
tacatataaatcgagctctgtacctgaacattcgtgtcttcgtgtcctcatatgtgaaaggtcaggaagctctctggggtctcttttatttattatattattattatttagtgagacgaggtctcactctgttgcccaggctggagtgcagtggtgtgatcatagctcacggccggcttgagctcccaggatcaagtgatcctcccattcaggctctgtggtcttgactgttcaga

SEQ ID NO: 638466 - DNA, 941 bp, Homo sapiens
  misc_feature (258)..(258): n is a, c, g, or t
  misc_feature (272)..(272): n is a, c, g, or t
  misc_feature (291)..(291): n is a, c, g, or t
  misc_feature (348)..(349): n is a, c, g, or t
  misc_feature (364)..(364): n is a, c, g, or t
  misc_feature (377)..(377): n is a, c, g, or t
  misc_feature (379)..(379): n is a, c, g, or t
  misc_feature (384)..(384): n is a, c, g, or t
  misc_feature (386)..(386): n is a, c, g, or t
  misc_feature (396)..(396): n is a, c, g, or t
  misc_feature (444)..(444): n is a, c, g, or t
  misc_feature (490)..(490): n is a, c, g, or t
  misc_feature (536)..(536): n is a, c, g, or t
  misc_feature (551)..(551): n is a, c, g, or t
  misc_feature (573)..(573): n is a, c, g, or t
  misc_feature (581)..(582): n is a, c, g, or t
  misc_feature (658)..(658): n is a, c, g, or t
  misc_feature (662)..(662): n is a, c, g, or t
  misc_feature (671)..(671): n is a, c, g, or t
  misc_feature (678)..(679): n is a, c, g, or t
  misc_feature (730)..(730): n is a, c, g, or t
  misc_feature (737)..(737): n is a, c, g, or t
  misc_feature (744)..(744): n is a, c, g, or t
agcgggtctgcgttccgtgtccaggcaggtgcaggcgccgcggggcggatctccggcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgtctgcccgccaccatgttccacctgctcctggcggcnccgttcgggccccngcgcgcctgctgggtccancccgcgtccctgcccgggctggaggtgctgtggagcccacgggcgctgctgctgtgnngtcgcctggctcggnctgcaggcggcgncntctancntactgccggngcgcaaggtggccgaggggcaggaattgaaggacaagagtcgcctgcngctatcctattaacggcttccaggccctggtgctgacagccctgtnggtggggctggggatgtcagcggggctgcctctgggggcgctcccnggaaatgctcctgcnccttggcgtttgtcgcacaccnctcaccgnntttcatcttcagcctctttctctacatgaaggcgcaggtagccccagtttcggccctggcactggggggaactcangcantccgatttncgacttnnttctgggacgagagctcaacctcgtatctgtttcttcgacttcaaatattnctgtganctgcganccggctcatcggctgggtcctcatcaagcttggcctgttgatgacggaggccaagttcgaggcggtcctcatggcctgtggtggcctggtccaggggcctcgtggggtgtgcccctgggccaggagccgcctccccaccacgggttccctgccggtggttcgcgggttgggcatgcgggggctcccagccgggcccc

SEQ ID NO: 638467 - DNA, 350 bp, Homo sapiens
ctcccaggttcatgccatcctcctgcctcagcctcccgagtagctgggactacaggtacccgacaccaagcccggctaatttttttggtatttcttagtggagacggggtttcaccatgttagccaggatggtctccatctcctgacctcgtgatccacccgcctcggcctccaaaagtgctgggattacaggcatgagctactgctcccagccccaaattctttaatgtggcgttcaaagttcctttctaccagccaggcgcagtggctcacacctgtaatcccagcacttggggaggccgaggcagatctgaaaaagaacgaaatatgttcagaagttagaaacataa

SEQ ID NO: 638468 - DNA, 299 bp, Homo sapiens
gcgttctagagtatcccggggtcgggacgtcctggaaacatgagcgcatcctaattgactggctaatacatgtaccatgcaattcaggttgttgcaggagaccagtgtacagtcactgtctccattattgctcggttcatgcatgaataattgtgtgcccaagaagatgctgcagcttggttggtgtcactgccatgtttattgcaagcaaatatgaagaaatgtaccctccagaaattggtgactttgcttttgtgactgacaacacttatactaagcaccagatcagacagataggc

SEQ ID NO: 638469 - DNA, 889 bp, Homo sapiens
  misc_feature (258)..(258): n is a, c, g, or t
  misc_feature (272)..(272): n is a, c, g, or t
  misc_feature (291)..(291): n is a, c, g, or t
  misc_feature (348)..(349): n is a, c, g, or t
  misc_feature (364)..(364): n is a, c, g, or t
  misc_feature (377)..(377): n is a, c, g, or t
  misc_feature (379)..(379): n is a, c, g, or t
  misc_feature (384)..(384): n is a, c, g, or t
  misc_feature (386)..(386): n is a, c, g, or t
  misc_feature (396)..(396): n is a, c, g, or t
  misc_feature (444)..(444): n is a, c, g, or t
  misc_feature (490)..(490): n is a, c, g, or t
  misc_feature (536)..(536): n is a, c, g, or t
  misc_feature (551)..(551): n is a, c, g, or t
agcgggtctgcgttccgtgtccaggcaggtgcaggcgccgcggggcggatctccggcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgtctgcccgccaccatgttccacctgctcctggcggcnccgttcgggccccngcgcgcctgctgggtccancccgcgtccctgcccgggctggaggtgctgtggagcccacgggcgctgctgctgtgnngtcgcctggctcggnctgcaggcggcgncntctancntactgccggngcgcaaggtggccgaggggcaggaattgaaggacaagagtcgcctgcngctatcctattaacggcttccaggccctggtgctgacagccctgtnggtggggctggggatgtcagcggggctgcctctgggggcgctcccnggaaatgctcctgcnccttggcgtttgtcgcacctacgttcatcttcagccttctctactgaaggcggtgcccagttcggccgcaccggggactcagcaccgttacattttctggagagactcccccttcgtctcgatcaatttcgtaatggacggccatgtggtctctcactgctgtgtgagaggagtcgagagccccaggcaggggcagtccggcacgggagccggaagggcgcccaccgtaccaagggtgcccggcgggagcggcacaacgagcatggcacgaccggccgcgccacaaggacagggcaaaacaactacggacaacgaggggaaacgcgcacccgaggcga

SEQ ID NO: 638470 - DNA, 168 bp, Homo sapiens
gttgtacatagtattgatcagaccaggactttggtcgatggaccttgcactcaacgtgaggagacaggccatgcatttcaagtgcatgcagctcactgatttcatcctcaagattaccgcacagtgcccaacagaagtatgtccagacaagcctggaagaaggcagac

SEQ ID NO: 638471 - DNA, 1429 bp, Homo sapiens
  misc_feature (17)..(17): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcgcgtttgtcaccctccgtctcccatagcatttgtcgccggcaacagtttggagtctgaggggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 638472 - DNA, 157 bp, Homo sapiens
gtcgacctttcgacgatgtcttttttcctttgtaattaatgaataatccagttggtgacactgagcatgtcctggtgagctgtgtgactcctagctgataatggtggtttttctatgcctgttcctttctctttcacgttctattaggtctggcgtt

SEQ ID NO: 638473 - DNA, 1339 bp, Homo sapiens
  misc_feature (17)..(17): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttttttttttttttttttttttttttttttttttttggggggccgggggggttttttttttggcacacaacccccgggggatctactaccctgtgggccccccc

SEQ ID NO: 638474 - DNA, 104 bp, Homo sapiens
tcaagcttctaacgatgtacggggacatggcagctcacgcctgtagtcccagcattttgggaggctgaggcgggcagatcatgctcataaggaaaggttaaaaa

SEQ ID NO: 638475 - DNA, 2845 bp, Homo sapiens
  misc_feature (17)..(17): n is a, c, g, or t
  misc_feature (1217)..(1217): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggtgaggggcgcgggccgccaggaccccgggaaccccgccccgccgagaccccgtcgagcccgccgacccccgttagggccggaagacgacctgaggggcaggacgagacccctccccggcagagactaaccgggacgcaggggagacccccacccgtggccgagacccctgccccgggccagccctgccgttcactcccgcaaccccggcagaggccgcgatcaggcctggaccttgtcccgggagagccacccgctctggactcagacccctccctcgcccgcagtcacaggctccgcacccttccctgtcccttaactccagacccccagcctggcccgtcgactccttccttggccctgtcccgcctctcggagcccccggggtgttcgggcctcctctgcgggccgcgccagccccttgccttcctccatcccggcctgggcatcctcacaggccgagccccgccccccaactcagccctctcccacgctccgtctcttacagcgtttgtcaccctccgtctcccatagcatttgtcgccggcaacagtttggagtctgaggttggatccccttttcttctggagcttccgtgcctcccctgcctcttcccagcccttgtcatcctccttcacaggccagccagatacctgtcttgcctgtgggcccattttcttccctgtctgtccccaccccacaagaaccaggtttctctaataaattctctcccttctttagccaggacttagcccgcagcaacttgggtgtgggtagttatgtggacaccctccgaaaagagccggtgtgcttatataagagccaggaggtcgggcaagcctcctctgggagtgtctgggcgctggagcctctgggccggctctgtacagtgcgggctgggcctctgtgttctgtgcggccacagagagactatggagagaggctgtgtgtgaggactttgaaggggccagnaggcagaaggaggtgatatgtctgtgagatctaaagtcctttatgaaggtcctccttctccttccaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatatatcctttgggtaggggctgtgggcctgggtttctggtggagtcaggaggctgcctggcctggtgccctctggtggctgctggatgccactgcccagctgtccaggggtcacctgcctgggtggtcacctgcctgggtggtcaggctgtctcacctcaggagggcccccggaccagctgaagggctgattctgtctgcttgtggggcctaggtcccctggggctgtagcctgaagctgggtctcagtcaggaatgggcctggggcaggcttggccctgcagcccttcacctctccaccaggtgtgggtgggcagaccgacccctgtgtggctgggcagaacctttccagcccccaccccaacatggcccccagcggggcaggtggtaggtggagggcagcgacgttgtcctcaggtgggtccttaaaacacttgcacgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 638476 - DNA, 1807 bp, Homo sapiens
  misc_feature (17)..(17): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatatatcctttgggtaggggctgtgggcctgggtttctggtggagtcaggaggctgcctggcctggtgccctctggtggctgctggatgccactgcccagctgtccaggggtcacctgcctgggtggtcacctgcctgggtggtcaggctgtctcacctcaggagggcccccggaccagctgaagggctgattctgtctgcttgtggggcctaggtcccctggggctgtagcctgaagctgggtctcagtcaggaatgggcctggggcaggcttggccctgcagcccttcacctctccaccaggtgtgggtgggcagaccgacccctgtgtggctgggcagaacctttccagcccccaccccaacatggcccccagcggggcaggtggtaggtggagggcagcgacgttgtcctcaggtgggtccttaaaacacttgcacgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 638477 - DNA, 1467 bp, Homo sapiens
  misc_feature (17)..(17): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaaggtgggtgagcaggctcaggctgcccctcccagctccattctctggaggtggggtgtctcagcctctgtggggtctgtggtgtgaactggggatggccctgcccaaccagcctcctgggagtcttgggcatggtgggtggagagcccagccttgggtgagcctgtgcggccttccactctgggggatctcatgtggccacaaggctggaggcctcaccccctttctcgcagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttcttttt

SEQ ID NO: 638478 - DNA, 1446 bp, Homo sapiens
  misc_feature (17)..(17): n is a, c, g, or t
  misc_feature (912)..(912): n is a, c, g, or t
  misc_feature (914)..(914): n is a, c, g, or t
  misc_feature (918)..(918): n is a, c, g, or t
  misc_feature (923)..(923): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggtgagcccctgttggaggggctggagggctgctccctcggagcggtgggctaagccacgtcccggncnaggngatcnaagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 638479 - DNA, 156 bp, Homo sapiens
gaggcagaggttgagtgacctgagatttacactgcactccagccctgatacagagggagactccatctcaaaaaagaaaagaaagaaaaaaggagagagaaagaaaaaaagaggtgaaaggacagaattggtaattgtgggttaatgtgagtagat

SEQ ID NO: 638480 - DNA, 2922 bp, Homo sapiens
  misc_feature (17)..(17): n is a, c, g, or t
  misc_feature (1217)..(1217): n is a, c, g, or t
  misc_feature (2388)..(2388): n is a, c, g, or t
  misc_feature (2390)..(2390): n is a, c, g, or t
  misc_feature (2394)..(2394): n is a, c, g, or t
  misc_feature (2399)..(2399): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggtgaggggcgcgggccgccaggaccccgggaaccccgccccgccgagaccccgtcgagcccgccgacccccgttagggccggaagacgacctgaggggcaggacgagacccctccccggcagagactaaccgggacgcaggggagacccccacccgtggccgagacccctgccccgggccagccctgccgttcactcccgcaaccccggcagaggccgcgatcaggcctggaccttgtcccgggagagccacccgctctggactcagacccctccctcgcccgcagtcacaggctccgcacccttccctgtcccttaactccagacccccagcctggcccgtcgactccttccttggccctgtcccgcctctcggagcccccggggtgttcgggcctcctctgcgggccgcgccagccccttgccttcctccatcccggcctgggcatcctcacaggccgagccccgccccccaactcagccctctcccacgctccgtctcttacagcgtttgtcaccctccgtctcccatagcatttgtcgccggcaacagtttggagtctgaggttggatccccttttcttctggagcttccgtgcctcccctgcctcttcccagcccttgtcatcctccttcacaggccagccagatacctgtcttgcctgtgggcccattttcttccctgtctgtccccaccccacaagaaccaggtttctctaataaattctctcccttctttagccaggacttagcccgcagcaacttgggtgtgggtagttatgtggacaccctccgaaaagagccggtgtgcttatataagagccaggaggtcgggcaagcctcctctgggagtgtctgggcgctggagcctctgggccggctctgtacagtgcgggctgggcctctgtgttctgtgcggccacagagagactatggagagaggctgtgtgtgaggactttgaaggggccagnaggcagaaggaggtgatatgtctgtgagatctaaagtcctttatgaaggtcctccttctccttccaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatatatcctttgggtaggggctgtgggcctgggtttctggtggagtcaggaggctgcctggcctggtgccctctggtggctgctggatgccactgcccagctgtccaggggtcacctgcctgggtggtcacctgcctgggtggtcaggctgtctcacctcaggagggcccccggaccagctgaagggctgattctgtctgcttgtggggcctaggtcccctggggctgtagcctgaagctgggtctcagtcaggaatgggcctggggcaggcttggccctgcagcccttcacctctccaccaggtgtgggtgggcagaccgacccctgtgtggctgggcagaacctttccagcccccaccccaacatggcccccagcggggcaggtggtaggtggagggcagcgacgttgtcctcaggtgggtccttaaaacacttgcacgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggtgagcccctgttggaggggctggagggctgctccctcggagcggtgggctaagccacgtcccggncnaggngatcnaagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccaaaaaaaaaaaaggggggcgtcaaagatcctcggggccaagtacgcgtaaccagcttctgtccagggcctatagggagcgataaaagaggacggcgtcgttacaccgcggacggaacagtgcggactgg

SEQ ID NO: 638481 - DNA, 985 bp, Homo sapiens
  misc_feature (17)..(17): n is a, c, g, or t
agcggaggatgccgcgngcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggtgaggggcgcgggccgccaggaccccgggaaccccgccccgccgagaccccgtcgagcccgccgacccccgttagggccggaagacgacctgaggggcaggacgagacccctccccggcagagactaaccgggacgcaggggagacccccacccgtggccgagacccctgccccgggccagccctgccgttcactcccgcaaccccggcagaggccgcgatcaggcctggaccttgtcccgggagagccacccgctctggactcagacccctccctcgcccgcagtcacaggctccgcacccttccctgtcccttaactccagacccccagcctggcccgtcgactccttccttggccctgtcccgcctctcggagcccccggggtgttcgggcctcctctgcgggccgcgccagccccttgccttcctccatcccggcctgggcatcctcacaggccgagccccgccccccaactcagccctctcccacgctccgtctcttacagcgtttgtcaccctccgtctcccatagcatttgtcgccggcaacagtttggagtctgaggttggatccccttttcttctggagcttccgtgcctcccctgcctcttcccagcccttgtcatcctccttcacaggccagccagatacctgtcttgcctgtgggcccattttcttccctgtctgtccccaccccacaagaaccaggtttctctaataaattctctcccttcttta

SEQ ID NO: 638482 - DNA, 471 bp, Homo sapiens
ccctggactcccaagggcaagcagtgctccctaaggcacatttcatcatctattaacatccaaaaattattatagaggccaacgtgggaggattgcttgagcccaggatttcaagaccagcctgggcaacacagtgaggtctcgtatacccatacccacaaaatctgccaggtttggtggcatgtactatagtctcagctactcaggaggctgagtgggaaggatcacttgagcccaggaggtggaagctgcagtgatctgtgattgtaccaccacactccagcccgggcgactgagtgagaccttgtctcaaaaaaaaaaaaaaaatccaaaaattattaaaccctacaaatattttaaaattctcacatttacttaaagcttaatgcctcataaaacatgctaaagttactgttcatcatttcttacgataagaatcattttgttaaatttatcaagcttgccataaaa

SEQ ID NO: 638483 - DNA, 424 bp, Homo sapiens
acattctctttatccaatccaccattgatggaccctaggtgattccacgtttatgctatagtgaatagtgctgtgattagcatacaagtgcatgtctctttgtgtaaaattatttattgtcctttgggtatatacccagtcatgagattgctgggtcaaatggtagttctattttaaattctttgagaaatctccaaattgctttccacagtggctgaactagtttacattcctacaaacagtatataagtattcccttttctctgcagccttgccaacatctgttattttttgactttgtaataatagccattctgattggtgtgagatggcatcttattgtggtttcgatttgcatttctttgatgttgatataatcaccaaaaacgtaaacatttcagttgctataggttacatattacgg

SEQ ID NO: 638484 - DNA, 323 bp, Homo sapiens
aaatgggtcaccatataagagaatatactattaaagaacttgatagtttagagtataactgttagagactaaagagtattattttaacagtgattaaaattgtggtttaactacactactattctttttaaagataactacctgggcatagaaataggatagggctgagactcctacgaacagatacgaggtggagattctattaggtagaaacaccgactacctggagccagtaaaagaaaatacacggtgggatgaaaacaccatgctagtcagatgggtaggaagcactaccagttctagacccctaggaaagacaccaa

SEQ ID NO: 638485 - DNA, 130 bp, Homo sapiens
ccaggcgcttgtttggtagattctgcgcattgaacccgtgattgaagccggcgtgtagccgtagggaaatgtgatcatgaattccccggctcctgcgtgatctgcagagggaaaggagacaggtgagggc

SEQ ID NO: 638486 - DNA, 409 bp, Homo sapiens
attgccaaaagctcgaaccacacgctttaccgagacgctaacaaggacgccactgagttcgtcgagcagaagctgcgcgacaacccctggatttatcctgacaagaatacggttgccacacttgttccgcttgaaccactaccgttgaagttagaacgaatccgcacgcgtgtgtggaccaaggtcaagagcggtacataacccgcttggcattcatctttattggcagagggttacatggctatttgcaaagaaaccaaagccgacagtcatcaattagtgacgctgataaagatggttgaggcctatgaggcgcaaagaacccatggcctcgcgtcactgggtaatgatgaacgactgctgaaccgcatcaaggcattgctccataaacatgatgggggagtcgctc

SEQ ID NO: 638487 - DNA, 221 bp, Homo sapiens
ccttttttttgggggggcccctttaaaaaactgtggccaaaactttttaactgggttaaaggccttttttgggggggggttttgtcctttgggcggtttttttccctgcccccaaccccaaaaggtttttttttttgggtgggggggcccagggcccttttttgagatattttttttttggcccggtttttagggtttccattaaatgggcccccccccca

SEQ ID NO: 638488 - DNA, 398 bp, Homo sapiens
agtgggggaacctgaggcacaaacccagaggccaagaaagcagtgccctgaggatatgtgacagagagacctggggagggagagacagagatggaggcccagagatgcagagaggcagatcctggagagtgagaggagctggcatagacagaaggaggaaccaagaaacactctagaaggctctgaacacacaaagacacagatacggagggaaatgaagataagaaattcagaggcagagggagagtttggaaacatcagcaagaggccgggtgccatggctcacgcctgtgatcccagcacttcgggaggccaaggcggctggatccctggagcccaggagttcgagaccaacctggacaacatagcgagaccctgtctctatgaaaaacaacaac

SEQ ID NO: 638489 - DNA, 416 bp, Homo sapiens
attgtatgctcccatgacaatgcgaaggttcttccaagttgtgagggctgtgcagacaacaggttggactgtgtccgcgagtcgatatgcgttttgcggcgttataagagacatttggctggcgttcacatctagtacttattggtgtgttgagacatacaaagtgactttatacgctaaatatcacaacaaaagctaagcagcaggctggtcgaaatgcggcgtcggttctggcaccctaccccgtcaattcaagtgggagcgcttggcgccagctagcgggtgacggtcttacgctcgtatgatcttgcgaggatcgcactactgatcggtacatgtggagagaagcttgcatgaggtagtaaaagggtgtaactagccgaacgcacccgagttcgtgccagtggtggtacgaa

SEQ ID NO: 638490 - DNA, 275 bp, Homo sapiens
  misc_feature (12)..(12): n is a, c, g, or t
  misc_feature (91)..(91): n is a, c, g, or t
gtcgacggcagnataggcgcttgtgaactgggtcaaggcaatcgcgccgccagccaggggaggatgtccacgccgagcaaggcaatgcganaaaacaccaggaacagctgcatcaacagcggcgtgccctggaacagctcgatataggtacgggcgacgttgcgcgggaaagccttggtgctgatgcgcatggtcatcaccagcaagccgatcacgccgccgccgataaacgccaccagcgacacgagcaaggtccattgcaagccggtgagcag

SEQ ID NO: 638491 - DNA, 318 bp, Homo sapiens
acactataacttggcttctgtattacaagagatgatgaggctggcttatttcttttatgttacttctacatgtattctagctgcaacgagaggccttcctctttctgttttataaaaagttttactgccattattggctttccattccctgtagccatcctcactgttacctgttttgggtttctggtctactttgactttcatagtacctccagcctcctcatacgcacagctttaggatgacctctgcttgagtttctccatatgtgcatgtacatctagcattctgccgttgttctgccgttgttcttcgacgaa

SEQ ID NO: 638492 - DNA, 239 bp, Homo sapiens
tgtcgatcaccggacttacagctactcaggaggccccgctactcgtaaggccagctactcaggaggcccagccactcaggagggatgtaatctgatttaaggttttttttttttggaaatggagtcttgcttaattggccaggttgaaatgcagcagcaggatctcgattcattgcatcctccatgtcccaggttcaagcgattctcccgcctcagcctcctgagtagctggggggatc

SEQ ID NO: 638493 - DNA, 170 bp, Homo sapiens
tgctgcatatacagctcagagccagtctatcgaggaagcgagggcggcttcagtacagtcaagaaggaagaagaggatgaaagctatactccagtgcaggctgccagtgccacagactctcaaccgtccctggccagagagctgttccgccaggctcttcagacgagctt

SEQ ID NO: 638494 - DNA, 786 bp, Homo sapiens
  misc_feature (159)..(159): n is a, c, g, or t
gacagtgagtccgagatcggtgccagtgcactcccgcctgggctacagagcaagtagtccattctctagaaaaatgagaagaagaggttaggggaattagtatatcgtgttataatgtagatatctttgaataatggcgttgacttggtagtcttgggnaactgattctatgagcggtcgtggatgacgcgaagtaaacacgagttatccattctattgagtgtatccctctttccgaaggaagaatgatcgtaatagcaggctaccagtgaattttgagaacttgcaaaaacagcttgcaaggacacatgaagcttcctattttcatagcagatgcattcacagcaagagcatttcgtgggaatcctgctgctgtttgcctcctagaaacatgaatcggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaacctggcttctgcagctgtgctgtttcacaaaataaaaaacattgaatagcacgctcacgtttgtcactctgagtggagaactaaggggcagaacgagccagaggatggcatcgtcctggaattgcctctttatccaagcccaaccccaggacttccatgaagtagaggacttgataaaggactgtcataggcaaaaagtggccagggacatctggtattctccagatac

SEQ ID NO: 638495 - DNA, 197 bp, Homo sapiens
atctagaggtcccctgtggagactggggtctcacacccttccagatgatttgggctgcgacctagggccgggacggggcgcctccttccgctggttataaccatgttcgcctacgagggcaatggattacttctgccctgaactgaggatctgcgctccttggacctgccgcggacacgtgctggctcatgatcacc

SEQ ID NO: 638496 - DNA, 734 bp, Homo sapiens
tcccaaaattgtttccaaaagtttatttaaaaacacacacatagggtcagatacaaacgccttttaaccacgggggtggggaagagtaaatctgatggcttccaatgatcatctcttccctcgtgcgtccacggtcgctcagagtctcagggagttatgagaggagtgtgtctcttcctttacttcccgtgttggtggtaatgagtccttcgaatgagagtaatatacgtgaccgaatttttccataactagttggtggattattaaagtttggcaggtggctggttttcctatgggtgtcttacaaccaagcatttcttcataattggggttgtggaaggttcattcactttaaatatacagttattattatatccttcttcttctccactactccgagcctcacacaggctgctaaggcgtatttctgccacatcagaagataatacatcataacattgagaggtaccttgatcgagaagctgactggtgaatttctgactgcagccaagtacttgtgcctacactgaagtggtcctcttcttcactcaaaaggtactggcaaattatctgatagttccaacaaagggtttaaaggagtcctataaatattctaacacagtattgcctttctctgaaactaggatggctgcgaagacattgtatgggttcccttttaacaagcaggtaaaaggcttttaaaggacttgaagtgttactggacaggaacagac

SEQ ID NO: 638497 - DNA, 185 bp, Homo sapiens
cccactacattcctctccggtggcagctcggtgctgaatgcagacacccacttcttatcaagggaattcacatccccagctgggggtcctgactggtcacgcaaacggttacagttcaaagcctgctgataaccagcactgattgctaggaattgcgctgcatcatacgcgtgatgctggacgaa

SEQ ID NO: 638498 - DNA, 389 bp, Homo sapiens
gatcagacagcaaagcagaacagtataaagtatcaaaaatacaagtgctagcactgaggagagtgagaagggttgggttgtggccagaggacctctgggacacaggattgaggacttgccacagctccaatggaacctaggcctgggggcctgtgcaggatccttggctgagggtggaagtggcttgagcggggcccaaccctgggccctgaaagtatgagaccagttgtgtgggcacttctgcgagcacggtctgtgccaatgctcccgaggggcctgcaaaaaagggaaaagtcagtggtggccagaacagctgcccaaagtctgtatttcatgctcaagaacccaaccatatcccagggctatagaggaaaaggtgagcattcccc

SEQ ID NO: 638499 - DNA, 801 bp, Homo sapiens
catgatctcggctcactgcaacatttgcctcctgggttcgaacaactctcctacctcagcctcctgcgtagctgggattacagatgcttgccaccatgcccggctaattttgtattttgatatatatatataattttttttattcttttttcttttttaagttaaagacgggatttttcaccatgttgtggccaggctggtctcaaaccccttgaccgtgtgtgatccccccgacctcacgcctgtacatcccagcatttttggtaggccaaggttgggtggcttcacgaggtcaggagctcgaaaacgagccttggatcaatatgggtggagcccccgttccgctactaaaatgtgccaaatttttagctgggccttgtgctggaccgcacccatgatggtcccagcatacttgggaggctgcggcaaagaaatcgattgaacctggctacggccaaggtcgcaggtgacaccaagattgtgccattgaccttccaagccgtggatcacaagagagagactcactctcgaactaaagacaaaccagcaacgacagcacacacgcctcacctgggagcgcccacggcccgcccgcagcagacgctttgacgcacaacttagttgtgcgcgccgcaccccaaatcgtgatttaccagtgcgacgcaccatgttcctcacggaactcgtgacgccacatactcgtgattcgcacaaatcaaacagacccggggcaacgcctcttgaactaccaagtgggtcgagcacctcgtccacaaggacaaacgaccgacattccccccc

SEQ ID NO: 638500 - DNA, 327 bp, Homo sapiens
aatttttttttttcaaagataaaatcctgctttgttgctcaggctggagtatagtgggacaattatggctccctctaacctccaactactgagctcaagggatcctttcccctcagcctctcgagtagctgggactataggtatgcccccctacaaaaaagtaatttttttttaatttttttataaaaacaaggtctccctatgttgcccaagctggtgttgaattcctcaagtgatcctccccccttggcctttttaagtgtttaaattacaggggtgagcccccgggcctggcccccaaatattttaaaataaaaatgtttttta

SEQ ID NO: 638501 - DNA, 298 bp, Homo sapiens
caaccagccatgaaacaaaagtttaaaagccactcatctggtttcccctttgttttcaaagaaggaagctagaaaattaagtgatgtatccccaaacacacacatttaattggagaaagaacccctaatcaattcttgaattcaaatttcaaattagctgaatggcatgaacctttcttcccctggaatagccttacagagacctcaccattaacagcatctgcaagagaagattaaagcacacgattactttactcactgtgtaacacatgaggaacatggacgagatgggaaaaag

SEQ ID NO: 638502 - DNA, 672 bp, Homo sapiens
gcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcgattggacacagtgcacgttctacaaagcctcccagatataagtgtgggatctcaaaagcttgccctgagaagcattttgttttaaaatggcaagtggagcagccaagtggtgggacccaaaatctgctggaagataatgttaatgagtggtgttaagaataatgtcggacagagggatcaatgttgccttggcaaattggacaaaaacaggagacgtattagacactaaatatttgacactgtggggaggagatgtggcaccattctatgagttatgaagggccatacaagatggaacaatagtttacaatgggaacattacgatgatggagcaccaaataaatgatgaggccacagtggctcatgcgattgggggagaacatctattagtaaatttggtctacgagaaaatgggctg

SEQ ID NO: 638503 - DNA, 200 bp, Homo sapiens
aagcacagtacaagacaccattatacgagaccgagacagggccagaccaggacaacctactagagataacgaccacatctacaacgttatcgtcacagacccatgcatatgtaatcatcttcttcatagtaatacccatcataatcggaggctttgacgataccgtagtagatacggaagtcgagagaggggatcctcta

SEQ ID NO: 638504 - DNA, 1256 bp, Homo sapiens
  misc_feature (431)..(431): n is a, c, g, or t
  misc_feature (456)..(456): n is a, c, g, or t
  misc_feature (527)..(527): n is a, c, g, or t
catggtagttcattgtctgtagatcccagcacttttgtgaggctgaggacagagtagaattgcgtcttggatgcccaggagtgttggacactagaggctgggcagacatatggagcatgcccatctcgtacaaaatgaaacagagattataatattagcgcgttgccaggaaactggtggcttcacgacactatgatcctgaatgtattcgcgaggacctttattggagcaagactatggtatgatgcccaatagagcttcaactataacatgcctcggggctaagcgagtagtctagatagtttcacttcgtccataaataacatttgactataacattatagtccagtagcgatttagactggggctgcgaggtgctcttggtgtgtcaccagggtatcactgtatgagggcatgggcatgcgaggctncgctggaattatgtgtcgttagagnccgcacaaggaactgtccgagggctttcgtgaagcttctgggactcaatatccatctcgtagtcggccatngcatcgggctgatcagtaagacatagatctcccgtgtgcgttaactccctttccgcctctcagcacagtacttgcagcattcaaatagactagtttgaggccctaagtacttggggttcgagctaccagttgtccttgctcacgtgtctcacgagaaactatagcatacgagcgaaaagcgtccatgaatcaccagctgagagtggattcgaccttgtagaccctgggggagaggtgtcccaggacaccttgtcagaaatacgcccggttgattatgcgggtatcccatcccaccaatccccaccactttaaggttgcacccaggatttggaccaacaacgtttgttggcatctggatccaagattcttggttaccaacccttgccactggcttggttaaaccctgtgggcttgatggattacaggcactaaggcccttcctaagtattcccgttttgagtcgtttaaaacctcggcggaattagcaaagggaggcctgactggttgcctacggttccaggatatttccacttggtacaagagtgagggccttctggggatggaccaacatctaaatttccaaggttccctcaattttctgtatcctggcagggctctgcaagtcaaagatggtagcgcggaaacgtagagggtttccttctccatgttttggggaacactgcaatcttaaatctctaccaggacttcgacaaagcttggagaacttcc

SEQ ID NO: 638505 - DNA, 1457 bp, Homo sapiens
ggggatgagtgtgtggagttagatcatcgaactcatcgcattgtgtgggttaggaaatcaaaagtaactaaggaggttgtgatatagattggagtctgattttttataatggttaggttgtgtatattgtgttgatgtggtagatgtgaggattatttattgtgttatgtgtataggatggtgatagagagctatgttgctttagattgtgtggggagttgtgtgtgggatatatgtaggttttgtgttgttggatagatataatttgttgattgatttagtatgtaattgggtagttatagctatagttattgttcataagtaatgtgtatgtttcgtttgtgttttgttccgtcccctccctatgtggttgtttggtttgttctgcgctctctgcttcacttcattgcgttttgtttttggttgttgtgcgccctcgtttttatattgttcgtttctgtcctggggtcgaggactgtctgtgtggtgtatgtagatttgtagtggtagtcgttctggtggtactgagtgtggttgttctccacccctccgcgtgtgtgtaggtcgtgcacgctcgtgctggtcctcttcgacggccgcgcccccctgcgtggtgtgttcgagggtgtgacgctactacataactcacctcctctgcctccttcagctcaccaacaccagcaggtggatagatggtgttgtctcctccacagcactgcgattaggaaaataccaacacgtagtctgctcagatggtatcctctactagtacggtacgatatgatgtgtgtgagacaacaacaacaaagatgaagcaaatgcaccgactctcagggcgtctactcacaccaacagcaggaatagtagtaagagttgcgtgcaacacacacaacaagacaggaggaggagataggtgaggagatgagagagagtgcgtggctgtgtgtttgtactactctcttctctctctcccgcctttcgtcacactcggtgtggctcacgcagcgggtgtcacagagctggtgtggttgtgtgtgtagtgtctgtgtgggctctctagtagtattgtgtgtgtgtgtgtttgtgtgggtgtggtgtgtggctgtgtgagagacacacacgaagccgtctctgtagacgcgccctcctcctctgttgttctctataggctcacatcgcccacctcagtacaagaagagaagatctcttgtgtattgttgtgtagaacaccgttgctgtctcttccctccgcctcccccctcatcatcttcgcctcgtcggtatatgagtgccctacctctcggtgttgtgtcatcatagatagagaagaagtggggggaaaaaaagaaaggggatgtaatttgagaggggccacaggtttttagttggttgtttcccattgtgtgtgaaaatttttgtgggcgctgatgtgagaaaaaagaaaagaatgaaaaata

SEQ ID NO: 638506 - DNA, 208 bp, Homo sapiens
  misc_feature (197)..(197): n is a, c, g, or t
agttcgacggagactctctttagtacaattgcatacaatatccttttccatcctttcaattttaacccgtgtgtatctctggatctaaagggagtctcttgaagacaacatatagttggaatatgttatttattcattctgccaatttctgcctttcaatcagaagacttaatccatttacatttaaagtaattatngggtaccgagc

SEQ ID NO: 638507 - DNA, 477 bp, Homo sapiens
  misc_feature (406)..(406): n is a, c, g, or t
  misc_feature (429)..(429): n is a, c, g, or t
  misc_feature (432)..(432): n is a, c, g, or t
  misc_feature (457)..(458): n is a, c, g, or t
tgatgtataatagtattttgtataaatataccacaatttattttccattttattgttggtggacatgtggcttgcttaaatttgttgatattatgaaaattggtgctttaaacatccttttatatatgtattcttgggcacctgggagttagtggtatgggctgaattttgtctcctcaaaattctgtgttgagttctaacccccaatatgactgtatctgagatagggtctttaggaggtaattaaggttaaatgaggttgttaagagtggggccctaatccaataagcctgtggccttataagaagagtctttctgtgtgtctcatgtgaggacacgatgagaaggtggccatgtgcaaggcaggaacagagccctcactgaacctgaccatgctgtcaactgntgccagacttccaccttccaganctntgggaaaataaacttctgttgtttnnatcacccaaaaaaaaaaaa

SEQ ID NO: 638508 - DNA, 688 bp, Homo sapiens
ggacgcgtgggtcgaccacgcgtcggaacatggtcctggtgttgtgcagcatctctgtgacggcgctggtggctgctggggtcccggggtcctcgcgctggggacgttgctgtctgcggcttgcggcgcgttttctattccaaggacaatgaaggcagctggttcctgctccctcttagtatcacaaatgtggatccccgtgacacggatgccgcagtcctatcctgctgtccacgaaggcaaaccatgcaagctcctataagatccaggtttcacaatgtaaagcctgaatacctggatgcctacaacagcctctacggcaggctgttgctgcccaagccttcacctggactgacgacatacccagtgctcactcgtgcggcaactgggaacaccgttcgcgtatggggagcatggaccaggcatgtgacaccttgtggccgattcttcaaggtggctaccccagtccctccatggatctgcacttgatcgaagccctccaactgaccacataaaggaagttaccatgcgcagttcccgaaagggagccggaagccaagcactgctgctggtaccagggagaaaacccagcctggccttcctttgaggtacagctttctgggaattgagccacagccccagaatgggttccccaacattctattgacgctgaggaccatccagccta

SEQ ID NO: 638509 - DNA, 192 bp, Homo sapiens
aggagagctccgacatagcatagaacacgcacaggacagcacagaatagaatagaatagattagaacagaaccgaatagaaccgaacaaaacaaaacagaatagaatagaattcaacagaaccgaacagaatagtatcgaatataacagaatacaaccgaatagaatagcatagaatagcatagaatagaat

SEQ ID NO: 638510 - DNA, 114 bp, Homo sapiens
actctagaggatctctagtgatataggcgccagtctaacccaagtcactcaagtactatagttgtagcaggaatcttcttactcattctggttcacccctagcagaaaatagcc

SEQ ID NO: 638511 - DNA, 735 bp, Homo sapiens
  misc_feature (10)..(10): n is a, c, g, or t
  misc_feature (348)..(348): n is a, c, g, or t
  misc_feature (368)..(368): n is a, c, g, or t
ctcgtgccgnatggattatgttttgtttgctttatggaaactggcaaggaaacaaggaaaggttttggatttggggttatagagtgagtcatagatagagttaggatttcttgttgtgttcttttagtcacaagctcttgactatattcctgcataaaataacttgttgaatttcctttctgatgaggagaggtaaaatgcttcttgtacctccatgtaatttaactcagtattcccacattgcctgtcatttttggatcagtcttaaaatgcattacaagcatttgaatcaacttcaataaatcatttatattctataataatgtaggccgggcatggtggcttacncctgtgatcccagagtactnggattacaggcatgagccaccacacctggcctataactaatttttaaacagtggtttgcttggtttgctgtgactttcagtacctttttgtttcagacatatacatatcacacataattgctttcttttgggtttctgtactttttccgtctctgcagtagttaccttataccataccatgtcttattgataactgttcttttgttgtgtaatgatgcatgctattcttaaatatcttccaaagtcttggttccttttgcaaacttaatatattttgtgttcacttaagttggtcattaatgaaacattttagtatggaaagttcagaatatgaattaaaatagtccattgaatttcaacagaaatg

SEQ ID NO: 638512 - DNA, 219 bp, Homo sapiens
tgtagttcgatatatagtatgtgatagggtgtaggtgtgcttgtggtaagaagtgtgctagggcattttaatcttagagcgaagctatatcactgcgccgtcataatggatggcatggtaggttatagatagttgtgtggttggtgtaaattgagttgaggcaggagtccgaggagttagtttgtggcataaaaatgattaaggtactagtataagaga

SEQ ID NO: 638513 - DNA, 1133 bp, Homo sapiens
  misc_feature (1133)..(1133): n is a, c, g, or t
gctcttccgcctgagcccctggaaggttgatgtggctgcggaatcgcgggcctcgcaaatgtctgccatttacaattttcagagtctattgactgtaatcttgctgctaatatgtacctgtgctatatatacgatccttggcacccagcctccgtggacaagaaataaaactggatgtgtggggatatatcgcgggaaacgttgtgccagaaatgggttgacgggacaggagtcccttattgtggcagtagtgctgtcatagctaactgggccttccagcatcctctttcatacagtaagcttgggagacaaccttgccagacatgtatgttgcccatcagatttgattggtgacaccaagggaactgaacttgcagacaaaattacacgtggaccacaggattgtataaccttcttaacattcctccgaacatttggcattgagcataacattttccagaattgctgtacctctaatacaacttgttcacttgggcacccattgttcttgtattaaacgcaattaatgattgtaaccaatttaaaataagttcttgtaacaaattcaactcaaggtacgggtcattacaataattacatttctgcaagatgtgtatacgtgtggtatcaagattacaaaattttagttgaggaattctctaaacgtgcacatttagtaggaacaccacaacattgggtaacataccctcaaattttccctttcacgtggtcactttgtgggcacctgattttacctttttaataagaacttgagcaccccttttttgggagcctaagctttctatctcacaacagtgcgcaaccttgcgtgtcgcagaacgggttcgggctacagatgttaaacaaaggcggcattggtaatccacttagtggaacaccaaatggtgcaatataaccacaagaatgcccacacaatcttaacgaaccgactatgtgtttagcgcgtttttaaaacatatttaccaaacacgatatcgcgcgttcaagagacgacgaagatacaggatgagcccacaacatggtgcggcgacagtgtacgtaccaatatgatgggtgcacacacacgacagattataatgcaactcccgaatgaatatattggcgcaacgtgn

SEQ ID NO: 638514 - DNA, 442 bp, Homo sapiens
  misc_feature (54)..(54): n is a, c, g, or t
  misc_feature (75)..(75): n is a, c, g, or t
ttccccatggtacccaggctgctctcaaacccctggcctcaggggatccacccnccttggcctcccagagtactnggattacaggcatgagccaccacacctggcctataactaatttttaaacagtggtttgcttggtttgctgtgactttcagtacctttttgtttcagacatatacatatcacacataattgctttcttttgggtttctgtactttttccgtctctgcagtagttaccttataccataccatgtcttattgataactgttcttttgttgtgtaatgatgcatgctattcttaaatatcttccaaagtcttggttccttttgcaaacttaatatattttgtgttcacttaagttggtcattaatgaaacattttagtatggaaagttcagaatatgaattaaaatagtccattgaatttcaacagaaatg

SEQ ID NO: 638515 - DNA, 354 bp, Homo sapiens
ctaatatttaatattgcttctcctgcatgcattactgcctattctgctatttaaaaaccctcaatgactttattttctactgccgcctttttctgtgcaaccaaaaggtaaatgttatattttactgtgttgtacaaatggtacccaacacaaactgttttgtaattagtaatactctcgtttaaagtgttaagttcgcatttggactttttttgtaaggatgtatgttgtgtgtttaacctttatttactaacgttaaaagtctgtgatgtgtgcgtagaatattacgtatgcatgttcatgtctaaagatatggctgttgttgataaaattaaaatcagctttcatttttct

SEQ ID NO: 638516 - DNA, 517 bp, Homo sapiens
  misc_feature (10)..(10): n is a, c, g, or t
  misc_feature (348)..(348): n is a, c, g, or t
ctcgtgccgnatggattatgttttgtttgctttatggaaactggcaaggaaacaaggaaaggttttggatttggggttatagagtgagtcatagatagagttaggatttcttgttgtgttcttttagtcacaagctcttgactatattcctgcataaaataacttgttgaatttcctttctgatgaggagaggtaaaatgcttcttgtacctccatgtaatttaactcagtattcccacattgcctgtcatttttggatcagtcttaaaatgcattacaagcatttgaatcaacttcaataaatcatttatattctataataatgtaggccgggcatggtggcttacncctgtgatcccagcactttgggaggccgaggaccttgtttccccttttgtcaggcataattaaatttacctggcaacacgctattaaaagtgtgccttttgatattacgaatgtcaataccccacctttttgttatgaaaaaggaaatcctactttattgctgttagcc

SEQ ID NO: 638517 - DNA, 1059 bp, Homo sapiens
  misc_feature (884)..(884): n is a, c, g, or t
  misc_feature (1024)..(1024): n is a, c, g, or t
tgtggtggtgtgtgcctatagtcccaactacttgggaggctgaggcaggagaatgcttgaacctggtgggtggaggttgcagtgagccgagatcgtaccactgccctccagcctggtgtggacagagcaagactctgtcctaaaaaaaaaaaaaaaaaaaaaaagtgtcaaacccttggggggggcatacatgggaaacaggcgggaaatccccagaactttggggaggccaagggggggaaaaatccctttgggggccacaggagttcggaaacccagtctggggcccaacttggggggggacctcccctattttacacgagggaaaaacaaaactttttcaaaaaaaaaggggggggggacggcgaggtacatccctggtgggccccaaggcttaaaccggactacacgctgcagcgtgggagatgagttgcgctttgagccccaaaaaaggggtccacggggcttggaaagtggagagcaatggaatcatttgccagatgggcatattttagtcgtggggggacacaggatgttacgagccctttgttttctccaacaaacaaccgatcatcaaacaaaaacaacaatattgtgggcgggacgcagaggcacccacaagaaggaacgtttatcagaacacacatttgtgggggggagcgcggcgcccaacagagtataacgtacacacctgagcaacaagtgcgtcccaagaggacaacggtggccaaccatgcgtggggggattctccccacaaaaaaaaagcgccgccgacaccggcggtgttgacacaacaccagaggggggactggcagcccacatcgagcctctcaacacgggcccacaagagagcgaataaagatccaccagacggggtaggtanacgcagcagccagacacgaaacgcgagacacctcatagacagcagacgaagcaggtagcaggccatcaagacagacaagccggccaactcgacaacacgacgaccaagcacatgataagcaacggatagcacagatgcgncgaccgagaagagagcagcacccgacttaccggca

SEQ ID NO: 638518 - DNA, 814 bp, Homo sapiens
gggctcgctcgccctcggaaagctgcgaaagtgctttggaggcttcgtacaattcagcggactatctggcgtctactacgtcgtgggtggacctgtccggaaacacactttaagccccagtttgccgcatcctcactttctgacgatcatagattggaggacagcctcgaatatgctgcaaagattgagaatcagcctgagcggagtgtggttgtaaaggtggagtgtggacaggatggttttcggcacatctactgtagttcgcagcgataatgtctggacaatgtcaaggccgagaagccactgagaacgcgatgtgcagtggcaaggagagctatgggacacttctcgttctagccataggtacattaccagtggtgagagtcatgagagaagcgaccaggaaaaacacactagtgtgcaagcgtctcaccatggaacttgacggaggtctgggcaagcaggtcagttcgtgtccctggagtgtttgccgtccacctgcgtagacctcccaagtcattaaagcagaagaactaaaggcaatgatcctaatgtaaacattgtacctaaagatggcacagggtgggcatcaaaacaagagcaagcatgaagaagaataaaacaccagaagtgccaccagtacagcaaaaacgctggggttgcagctcccccagaagtagcgagctgtcccaaaatcatggggcagtaacaagcaaggtgggcaaggagatggaatccaaagtgaatagtcagtttcagcaaagaatttcccaacctggaggccagtgggggatcaggagacaaaaacgacacg

SEQ ID NO: 638519 - DNA, 733 bp, Homo sapiens
  misc_feature (407)..(407): n is a, c, g, or t
ccaaaggttcatgtttttaattccccatggaaaattgtggtcccagactgggaaactcttagtactcggttaagctgtgaaagatttcacactgtgatgttttccagccaatgttttaagtttaagattcacatttacttgtgtccagaattattattaagatgttgagcttttgttttggaaactagtttgtcacacatttgtgcataagcccagtgtttatattgtaggccaattgtgaatgtgtagacatatgttcattgtgaaggaacggacttattcatgggataatattgaatccagtctcagcttgccatcttcagacacttaagacctgcacatatcctatgttacatttaccacagacaagtttttttggctgacattagccagctttaaaagcatcnccctcaatgttgaaggtgctgcatctattagggtgcgcatattagtgttccaataagcatgtgattctgttaaggtggtggtagccgaaacatgaatataattacgttaggcctcttaggctttggtacatatattgggataagagtttatgctgtaggttgcaaggttcttcttggttgtcagtaaaaagcccaaagaacaaagcatgagtgagtaaatgacgtgagtagacagttccttttatgaccaacattgcactcgtccctatggtggttcgtacagtgtaggataacttgagcgttcatttttcaatataaagtaatat

SEQ ID NO: 638520 - DNA, 145 bp, Homo sapiens
gtgtggtcagccttggcgccttacataccgcagctccatgatagtacttgacctgtcacccctggaatgtgcagtgggacagctgagagtacgccttgaggatgtaggagagggagggaagggtagcagagagagagagacagaa

SEQ ID NO: 638521 - DNA, 335 bp, Homo sapiens
ggtgggggaaaacccccggaaaaagcgcccccccttttttttttgggggttcccccccccgggcccccccccccccgggcctttgtttttttgggcccttgggacccgggggggtttccccgggccccaaaggggccaaaggggggtcccccctggcccctttgggggggcacccccggggttgggggaaaaaaccccccccaaattttttcggggggggggggggggaaaatttcctttttggggggtttttttaaaaaatttgggccccccccggggggaatttttggttttttttgttttttaaaaaaggcccccccccccttttgttttta

SEQ ID NO: 638522 - DNA, 126 bp, Homo sapiens
ctggatcacatgttaagaacgggaagaatgggtggcaatggtgtgctcctggaagaagctcacccatgcacaggttgcccttgaagctcgggggcccttggagttcctgtcccctgggggataatt

SEQ ID NO: 638523 - DNA, 867 bp, Homo sapiens
taggtttcgaggggggaactgctggaaaattgtaatgggtatggaaacatgtcatataagtacatgctagggtgagtggtagagaagttttttcataggaggtgtatgagttggtccgtaaccggatatcggggtgttatgcttgttcccgatattcctataacaaaccacgggcagtgttcaacaatgtagcgtgttcttgggtgacaaaatattattgtttgttgtagatgttccaggggacgatgtgctgtcattattgtttgttccctaaggaacgtattgtcagtgcgtgacgggtgtgtctatattatattatattacaagtgttttgtggtgatattctcgggcttatgtggaaaacaaattatgggcgcagaaaggggcgcccctgcgcgcgtatattctcagaagtgttttagaaacgcctgtgacaacttatgttctcgagactctcccactgtctcgcgcacaggctccagaacaggggggctatccggatgtggactcctctgtgccatagtgtgttgtgcgacagatttaaaatctcacttattatatgtggcgccgacagggggctcatttagatgtgggccagagcacgtataaatcctcccacgaaaggggtgtcttccccctgtggtgtagtttgtgcagtgcaacatacaacggggggtgttgtgcaccgacggcgttttacacaggggaacgcccccagcttttatgtttacgactaaagtgtttcagacctacgttagcaaatgttggacttgccggccataggggcggtgggaacatttccttctaatttgcaagcaactttggctctggggggggccataaccgtggcctccgccacgtttgccc

SEQ ID NO: 638524 - DNA, 105 bp, Homo sapiens
gtggctcacagcaccagcacaaataaacagtgcaatggcagcagtagacaggaaggaaggaaggaaagaaaaaagaaaaagaaagacagggagcacagcagagca

SEQ ID NO: 638525 - DNA, 861 bp, Homo sapiens
tcacaggcctcgcgagatgtgcttcccccagtgagcccgccgtcgttgaccgtccgcccgccgtggatgtgggcagacaaaatggggaccttgcacaaatatagccccgcccccccggggaaaatgcaccacgcggcaagagtgttccacaaggggggggaacaccccgacatccaaggggcgctaagacccgtcctgtcacaataacacggaggtgtatcggccccgccccacagggcgagataacctttcggcgactcccaccacagggggccgctcccctcttgacaggcgcccctttggttgattcgaacacgcgccgggctatacaataatgtcgggacccccccggcgtccttggtgggtgcaccaccgatgccgacaccgcgtgggggaaccccactctgtgttctgtgcgagaaatatgttggaccacccgtgcgcccccgccacctattttgcgcggagttgttgtggtgtacgccgcctgattgcctaggccacgaatggtgcagattatattattcttgcttggtggcacacccgcacgttgttgttaatttctatgcatggcggctcgaagccctgttcacgttcagagggggcatagaacaaaacatgagagcaccgtcgggcggaacaacagccccacacaggggacatctttgggaccaaaagggctccgaacatcccgcaagccactcttctagacaggcgctcccctccccccctcgccgcgaacaccccctgggctccccacgccaagaggaggcgcaccgcggcgcacgccgagcgccaacaccaaagggtgcaaggcaacccccgccactgaaaaaaaaaaaagcccgccaacaaaaacaa

SEQ ID NO: 638526 - DNA, 774 bp, Homo sapiens
ctgttcatatgggatactccgctaacttgccatgcaattgtgatgactgtgtgtcctttacagatgtaccattgtgtggttcttgcaaggcaatcaaaggttttcgcattctccagtgggagtatagaccacagagctacgaggcgagtttgacaactattgaaaaccagagctccaacagttatgaggtagctttgcaggtttggtggaagtggcctcgttttccatgattgactgtagtatgagttcaaagtctagaggaaaggaagcatccctggtaattccatcacaagttgtgccttatcgggagccatactgcggcaagatatggaccagtgtccatggttgggtcagccgcaatgggtggtcattctcctatggctttaattgaacggagactggtatcttgtagacgaaggatttgcctctgcacagtttcccaatggtcctcagtttgcaagaagaccctcccagttgccttcaactcagttatcttcctcaccttttggagactatcgacaagtatcagtaggactctttcctaggattcttttaacagaaccgagttgtggtcccgagaaggtttcagaaggatccaggtcacagcctgtttctaaaccctaggtgggacagcaatggccaataggtataaagaccaattcagacctttgctatttaacggacaacccgcgcaggtggcaacgatattcttctttttccctgattgctttgccacatcagttctcctagcgcaaccacgtgaatcagcaagca

SEQ ID NO: 638527 - DNA, 320 bp, Homo sapiens
cagtgatgaagtagaactttccagtgaaaattaaaattttgggccggcgcagtggctcatgcctgtaatcccaacactttgggaggcgaaggtgggtggattgcttgagcccaggaatttgaggccaacctgggcaacgtggtgaaacctgtctgtacaaaaaaatacaaaaattagctgggggtggtggcacatgcctgtagtcccggcaactccggaggctgaggtgggaggatggcttgagcctgggaggtggaggtgggagtgagtcttgatggcaccactgcattccaacctgggcaacagagagataccctgtc

SEQ ID NO: 638528 - DNA, 84 bp, Homo sapiens
agcggagagtatcagcaagagtagcagcgagcagccgcgctggtggcggcggcgcgtcgttgcagtgcgccatctgtcaggagc

SEQ ID NO: 638529 - DNA, 225 bp, Homo sapiens
gctcattaccggtgagctgggcacacatgctgtgtctgtgggcaccaagcccgttaccaagtacatcagcgtcatgtaaccgtgtcccttcaagtgctttagtaaacccaaaggctcttttcagtgccactcaccttttcccaattggtgatatatattgacatgtgatgttactagaaactcctgcatgctgaattagccatgtttttccatgttagaatggca

SEQ ID NO: 638530 - DNA, 343 bp, Homo sapiens
cagtcttgcatcctgcaaagatcaaaagacccatacatcacagtatatgcactcaatacaggagcactagtattcataaagcaagtcctgagtgccggccacagagagttagagtacgtgacattaatgatgggagacttataacgccttgctgtcaacattagccggatcaatgagacagaaagtcatcaaggatactcaggaattgaactcgtctttgcaccaagtgatcataatagacatctacagatctctccacctcaaatcatcagaatatacatatttttcagcgacacacctcacctattccagaatggagctcatacttgtaagtacagctctc

SEQ ID NO: 638531 - DNA, 165 bp, Homo sapiens
  misc_feature (85)..(85): n is a, c, g, or t
tcccgtttattcaactgcgttgactcacaaatacagttcttggtctctttgtgagcctgagtctaaacgctgcatcatggctcancttgtacattttcagttgttggaagtaaaaggaagccactgccccatggcgtcttcacatcctcaacccccaccacagag

SEQ ID NO: 638532 - DNA, 679 bp, Homo sapiens
ccatttgcttggtaaattgtcctctatctctttattttgagcctatgtgtgtctttgcacatgagatgggtctcctgaatacagcacaccaatgggtcttgactctttattcaatttgccagtctgtgtcttttaattgtggcatttagcccatgtacatttaaggtaactattgttatgcgtgaatttgatcctgtcatcatggtgctatctggttattttgcccattagttgatgcagtttcttcatagtgtcattggtctttatattttggtgtgtttttgcagtggctgctactggtttttcattttttatatttagtgctttcttcaggagcttttggaaggcaggcctggtggtgacttccttagcatttgcttgtctggaaaggattttatttctcctttgcttatgaagcttagcttggctgaatatgaaattcttggattgaacattcttttcctaggaatgttgaatattggctcccaatctcttctgggatgtaagggtttctgctgagcccactggtagctcgatgggctttggttttgaagtgaactggcctttcttctttgctgccctcacaattttccttcattttgacctggaagatctgatgataaggcgcctggggttggaccttctaatggggcttttgggggcccctgattttctggtt

SEQ ID NO: 638533 - DNA, 594 bp, Homo sapiens
taaagaaaaaaggtccaaatcaataggtcttttatggcatcatttaaatatcacaagtaggtcttaagtgtcatcgggcatcttctttctgtagccgggtaactcttaaatcttatccatcagccgggcggaacagtccctttttcagagacatagatcccactccaaaattccctgcgggccaccatatcacaccccactcctaaaaaaaaaaaaaaaaaaaaaaaaaaaaaaaaaaaaaaaaaaaaaaaaaaccgcggggcggacttttggggggggggagaaaaaggggagcaagaagaagagagggcagcgaggagaaccacaaggaggtcgccgacagacccaccatgttgtctgtgagtgaaccaacgaaggggaacacctcgagcggcgggctccctcactcaaaagaggagggaggcgcctatatataattcttggacgagaacagccgcgagatgattctcccgcgcgtttcttatattataatcttcagtgacggaaacaaataaaagataaaaaaagcgaatccaaatagcggatacgaaacaagacgagacaaagaagaagaaaaaaaaaggaaaaatacat

SEQ ID NO: 638534 - DNA, 452 bp, Homo sapiens
  misc_feature (33)..(33): n is a, c, g, or t
  misc_feature (84)..(84): n is a, c, g, or t
gccccatcaagttggatgcaagtttcctccccnagtcctcgaagggtcctttaacattttgggccatgaatttttgcagcagcnggtacccagttggttccccttcccatgtttaagcatttcccttccaggagctcttttaagggcagtccctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggtttgtagagtttcttctgggagatctgctgttagtctgatgggcttccctttgtgggtagcccgacctttctctctggctccccttaacattttttccttcatttcaactttggtgaattattcaattatgtgtcttggagttgctgtt

SEQ ID NO: 638535 - DNA, 126 bp, Homo sapiens
ccacagcatacacaccttggaaaccaagaagactctttgtgtgtgtatgtgtgcgagactgacgcgtctctacgcgctctatggggggagatttggttatttcggcgttacacctccggtgttctc

SEQ ID NO: 638536 - DNA, 795 bp, Homo sapiens
  misc_feature (51)..(51): n is a, c, g, or t
ttttttgtttgttttttttgtaatttttgcagtcaagttgatgctcagtgntttaggatcccgtagtcgatcaaccctatgcagcctcaggcagaaaccgcgcttatcaagatctggtaaaggcaaagcacatccccttgctctaattttcttccgtgcgtgcgtatagcgcacctactcgggcttgcttctacttatctgccctgccttcacctcatccgcataacctgccagccgatcctcaccatcatgaaatacagtgagcatcctaagcacggcctgggcgtctgccttgttccctgccaggctcagccgttccgcaatcctcatcagctctaccgctgaccacttgaggtctgaggcaatgccttggaggtcgcgcttaaggtcttggttgggtttagtgagggacatttatggctccaaactcagtgcgcggactgccattcaccagattccgcctcgtacctatcgaaagtctctctaagtgcaacaatatccagcggcgacttcggggtaatcgagccaggctcctctggaacaattccatcagcctccatcaattcgacgagctttttgccgcgagcaatgcccacgttcagatggcgagcaacaaaagctgcgcttaggtgcttccctgttagggctgcaataaccgctctgccgtacatagggtcggcagcgtagctgtcaggatccaggtagttttccagccatccagcgaatctgcattcggaaagaagacatctagatcagctatcgttgatcgagctacgggatctctagagtcactgc

SEQ ID NO: 638537 - DNA, 753 bp, Homo sapiens
  misc_feature (41)..(41): n is a, c, g, or t
  misc_feature (98)..(98): n is a, c, g, or t
  misc_feature (105)..(105): n is a, c, g, or t
  misc_feature (132)..(132): n is a, c, g, or t
  misc_feature (135)..(135): n is a, c, g, or t
  misc_feature (139)..(139): n is a, c, g, or t
  misc_feature (148)..(148): n is a, c, g, or t
  misc_feature (154)..(154): n is a, c, g, or t
  misc_feature (156)..(156): n is a, c, g, or t
  misc_feature (158)..(158): n is a, c, g, or t
  misc_feature (160)..(160): n is a, c, g, or t
  misc_feature (177)..(177): n is a, c, g, or t
  misc_feature (180)..(180): n is a, c, g, or t
  misc_feature (187)..(187): n is a, c, g, or t
  misc_feature (192)..(192): n is a, c, g, or t
  misc_feature (196)..(197): n is a, c, g, or t
  misc_feature (214)..(214): n is a, c, g, or t
  misc_feature (266)..(266): n is a, c, g, or t
  misc_feature (278)..(278): n is a, c, g, or t
  misc_feature (288)..(288): n is a, c, g, or t
  misc_feature (295)..(295): n is a, c, g, or t
  misc_feature (309)..(309): n is a, c, g, or t
  misc_feature (316)..(316): n is a, c, g, or t
  misc_feature (328)..(328): n is a, c, g, or t
  misc_feature (332)..(332): n is a, c, g, or t
  misc_feature (342)..(342): n is a, c, g, or t
  misc_feature (348)..(348): n is a, c, g, or t
  misc_feature (369)..(369): n is a, c, g, or t
  misc_feature (382)..(382): n is a, c, g, or t
  misc_feature (486)..(486): n is a, c, g, or t
  misc_feature (587)..(587): n is a, c, g, or t
  misc_feature (629)..(629): n is a, c, g, or t
  misc_feature (653)..(653): n is a, c, g, or t
  misc_feature (675)..(675): n is a, c, g, or t
gcagtgtggaaatcccagagctagaatttgaactgggaatngcagtcctcgggggcaagttcaccacactggaagggctgctgaaagacatccggganctggtgnccaacaatcctttcacactgggcgacngtnccantcctgcacngacggngngncncccggagtttcgccagnagntggcccngctcntcgnnggtcacatgcaggcccnctttcttatggatgatcccgcaggaaacagttacttgcagaatgtgtatgcncctgcagatgancctgagatgnaggtggngcgtcacacgcgcncctttgnccaaaatgaggngctngggctcaatnacatgnagacagagggctttgaggcanccctgctccgccncggtagcagtgggtggctcaagggccagcctccagcgctgctctttctgtaggttatttattagtattggatgaaggcgaaggctgggagtgtctttccccccngcccttgcccatggtggggaggacatctggtctgagtcagagatctgtgcacactttctaaacagcttgtgatgcaagtgtgagcctattgtgttacttgnccttattttggaagttttgaattggcctaggaggaaacccanaaatgaaccaggggtatgtcatcncttttttcatatcaagtcctcnccctccttccccataatgctctatcctttaaggttggaacttttaagttggagaaggtggaataaagttacccctgga

SEQ ID NO: 638538 - DNA, 350 bp, Homo sapiens
cgtctgcttatacttcctatctgccactgccctgtcaacagctgaataagctgaccagagctgctgatgagagtgacagaggtatgaaggttattgaaaaccgggccttataacgatcatcgaaacgattgaactccagttaaatccaactcacacagaagctaagcacattgcagaagatgcagattgtaagtcttaagaggtggctcgtaagcttggtgatcattcgtgggagacttgtcatgcacagatgaacgagctgagctggcagagtctaagtgttctgagctggaggaggagctgaagaatgtcaccaacaacctcaagtctcttgaggctcatgcggtgaa

SEQ ID NO: 638539 - DNA, 981 bp, Homo sapiens
taagagacaccagagaaatccctcacaattttctttgtttttccattttggaaacgggagtctggcttccggtcacccaaggcttgagccacaagggtggtgatcctcagctcatggcaacctcggcctcccaggttcaagagattctcccacctcagcctcccgagggggttacaccaggtcacgccagcctgggtctcaaatcttctggacctccaggtgatctggcccacctgggcctctggaaatgtcgtgggcgattaaagggtgtgagccactggtgccaggcactcccttacttctttcacaatggtgaggacacgagtaaggccatctatgaagcaggccctcacaccagaacaataaacatcgcgcaagtggcctggatccgggcaataaaatctatggtgggttcaaagcaaccccaagtctaagggtgaaacaatggtgcgaagtacgtgccaagagggcactaagcacagagccctatgggctatctagtgccgcgaatacacgccagtacaggagcacggtctaccagtttatcctaacctgtggtcctctattctacccttaaagcagagatatagagttcctctggactacaggttagttggggcaggggatactggtgtccggaggcccctcacaaggcaggcagtgaaccaataaccatataacgggggcacataggagcctcaataggcagaatcctctacaacaacaggacaggctggggatcagcgccacgtcagaagaaagagacccaaaaaacacgaccctcccataaaaaagcacgagcaaagggctgtgcacggaggcgacgcgaaaccatatggggcaccagcgatataaaaacacatggttgagaatatcaagacgacacgtagacgaaccggggtggcaaaaatggaacgggcagccaattagggggctgcatcacaccgcgacaggaccacccaccgcgtgggataagaaggg

SEQ ID NO: 638540 - DNA, 401 bp, Homo sapiens
gtatggtggctcacacctgtaatgtccgaactttgggaggccaaggctgggtggatcacttgaggtcaggatttcgagaccagcctggctagcgtggtgaaaccccatctctactaaaaataacagaaattggcgaggtgtggttgtgcacgcctgtggtcccagctacttgggaggctgagaaactgaggcacaagagtcgctttgaacccgtgtggtggaggttgcagttagcccagatcatgccagcctgggtgacagaacaagactgcttcttaaaaaagaaaaaaaaggttgtccggacctttggtgtcccattccggtattttatacttttatttttcctggaccaaattttctgggagtagaggtgcggccctttttttcccaggcgtgtttgg

SEQ ID NO: 638541 - DNA, 1188 bp, Homo sapiens
  misc_feature (210)..(210): n is a, c, g, or t
  misc_feature (213)..(213): n is a, c, g, or t
  misc_feature (220)..(220): n is a, c, g, or t
  misc_feature (224)..(224): n is a, c, g, or t
  misc_feature (237)..(237): n is a, c, g, or t
  misc_feature (246)..(246): n is a, c, g, or t
  misc_feature (249)..(249): n is a, c, g, or t
  misc_feature (256)..(256): n is a, c, g, or t
  misc_feature (261)..(261): n is a, c, g, or t
  misc_feature (265)..(265): n is a, c, g, or t
  misc_feature (268)..(269): n is a, c, g, or t
  misc_feature (314)..(314): n is a, c, g, or t
gggcagattacccccctacttattatccagatctggcagtctccttcgtgtgatctgcccctccctgcttctatacccttaccgtgctccagctatgacaatagggatgaggtacccgatagctcagccagccccatcaggactcttgtgaaaagagaggatatgttcacacctagcgtcagtattttccctgctagggcttttaggtcnctncccctcncagngctacttgggccnagctcctgntcnacagccntcccngccntgnnatctagagcttgatgccagtaggctcaactagggagtgagtgcanaaagctgagtatggtgagagaagcctgtgccctgatccaagtttactcaaccctctcaggtgaccaaaatccccttctcatcactcccctccaaagaggtgactggtgccctggcctctgtttgattgaaacctctaagcccaggtcttgcacaccagctgatcttgtcccttggagtcgtgtaaaccacagagctgcatgggggattctggaccatagtctccttccacagccccagcccttgctctcaacccagtgagcatccactctccttctctgtctcatgtgtgctcttcttcttgctacagtataattgtactctactgatatctaaatattgatttctgccttccttgctaatgctccattaggaagatattagtcttggggcgcacggatggagtttttcggcctcatgtgactttagacaacccccgcacacactggaaaacgcatatacctatagttcacaagatagtgagcattttgccaaaattgattaatataagaacctctcagtgataagtgatgtcatctgtcactataggtcatacaatccattcttaagagtacttgtctatcccgtttgcactgatatactgtctgtccttctccctccggggttgcatgtacctactaagggcgccgagtccctggtccaccacgcgcattgcccttagttaaaaggcttccttcgtttcccccttgttgggaccacccccgtagtctgtggctgacctggaggagcccgtctggctttggcgtgactttgctcacgcggtgattggccaattggctagggggactgccattggggggcgctttaaaaatgctaaaggaagtactaggggccggggaagcattggtacggccg

SEQ ID NO: 638542 - DNA, 131 bp, Homo sapiens
cttattgttgtctggtatacgggctcttttttggttcatttgaatcctaaagtagttcttttctaattctagtgaagaatgtcaatagtagtttaatgggaatagcaatgaacctataaattactattggg

SEQ ID NO: 638543 - DNA, 243 bp, Homo sapiens
ctatgttaagaaaaaagatagcaacaaggcttgatggagccagtgttctgtgctaattgtgatcattcaaattattaaacatcaaccttaacagtcttcttggtgcttaaataataactaaccattaacattacccttttttattagaataatcaagttctatatgaatatggacagaataatttatttcaaaactgtcaatcataaatgtcacaactttagttactagggggtaccgagctc

SEQ ID NO: 638544 - DNA, 544 bp, Homo sapiens
  misc_feature (210)..(210): n is a, c, g, or t
  misc_feature (213)..(213): n is a, c, g, or t
  misc_feature (220)..(220): n is a, c, g, or t
  misc_feature (224)..(224): n is a, c, g, or t
  misc_feature (237)..(237): n is a, c, g, or t
  misc_feature (246)..(246): n is a, c, g, or t
  misc_feature (249)..(249): n is a, c, g, or t
  misc_feature (256)..(256): n is a, c, g, or t
  misc_feature (261)..(261): n is a, c, g, or t
  misc_feature (265)..(265): n is a, c, g, or t
  misc_feature (268)..(269): n is a, c, g, or t
  misc_feature (314)..(314): n is a, c, g, or t
gggcagattacccccctacttattatccagatctggcagtctccttcgtgtgatctgcccctccctgcttctatacccttaccgtgctccagctatgacaatagggatgaggtacccgatagctcagccagccccatcaggactcttgtgaaaagagaggatatgttcacacctagcgtcagtattttccctgctagggcttttaggtcnctncccctcncagngctacttgggccnagctcctgntcnacagccntcccngccntgnnatctagagcttgatgccagtaggctcaactagggagtgagtgcanaaagctgagtatggtgagagaagcctgtgccctgatccaagtttactcaaccctctcaggtgaccaaaatccccttctcatcactccccccccgggaaaagattaggacaggacttcgttttacaaacctgtaacccagggtcgtgacacagctcattcgtgtgcctaggacgctgtaatcagagacatgctggggattttgctagtcctttccaaaccccacgctgctt

SEQ ID NO: 638545 - DNA, 489 bp, Homo sapiens
  misc_feature (210)..(210): n is a, c, g, or t
  misc_feature (213)..(213): n is a, c, g, or t
  misc_feature (220)..(220): n is a, c, g, or t
  misc_feature (224)..(224): n is a, c, g, or t
  misc_feature (237)..(237): n is a, c, g, or t
  misc_feature (246)..(246): n is a, c, g, or t
  misc_feature (249)..(249): n is a, c, g, or t
  misc_feature (256)..(256): n is a, c, g, or t
  misc_feature (261)..(261): n is a, c, g, or t
  misc_feature (265)..(265): n is a, c, g, or t
  misc_feature (268)..(269): n is a, c, g, or t
  misc_feature (314)..(314): n is a, c, g, or t
gggcagattacccccctacttattatccagatctggcagtctccttcgtgtgatctgcccctccctgcttctatacccttaccgtgctccagctatgacaatagggatgaggtacccgatagctcagccagccccatcaggactcttgtgaaaagagaggatatgttcacacctagcgtcagtattttccctgctagggcttttaggtcnctncccctcncagngctacttgggccnagctcctgntcnacagccntcccngccntgnnatctagagcttgatgccagtaggctcaactagggagtgagtgcanaaagctgagtatggtgagagaagcctgtgccctgatccaagtttactcaaccctctcaggtgaccaaaatccccttctcatcacgctcacaccaaagaggggacaggaccagcctatgacggacacagacgataagcaccaggtctagacaacagctgtcgaccctaggagcagt

SEQ ID NO: 638546 - DNA, 230 bp, Homo sapiens
attgtatcgttagcacatctttggggattcctctaaagattctaccaagcgtgcttacagcaccgccttgctccgtcgtgcacgactctcttctctggagacccccctcgcgttcccaggagagcacccttctttccctgctcctgaccctgtgggacaagagggctattggctcattcccagccaggctctgccactctttctctgttttcattctcctggatcaatcc

SEQ ID NO: 638547 - DNA, 210 bp, Homo sapiens
ggaatcacaccggggggtgccaactgtcatccattagccatccccaataaacccatgaatgttcagcctgaatcagcatagcaaagacctcgatctctacagaaagaaaaacacttcaataaatgtaaccaggtgtgagtggcacatgcccatgatactcaaggaggctaacgacggtcaggttcacctcgagcccatggatgaccgagg

SEQ ID NO: 638548 - DNA, 289 bp, Homo sapiens
caatttttttctttgtttcccgtcattgccatttagtataccagttttgctaacgttttaaaatgaagtcgttccctcataatttatggttttgtccagcccttatagaaataagctgttcttttgaagttgaaatcccccgtaaaatgttgaagaaggatggggggttttttcatatttggcgtttttgaaaccctttgggtttgctgttgtgtgaagattgccctttcccctgattttcctttgtttctgcagaacatagagaaaaataaaagcctaacgaatagta

SEQ ID NO: 638549 - DNA, 239 bp, Homo sapiens
  misc_feature (23)..(23): n is a, c, g, or t
  misc_feature (49)..(49): n is a, c, g, or t
  misc_feature (112)..(112): n is a, c, g, or t
  misc_feature (131)..(131): n is a, c, g, or t
  misc_feature (198)..(198): n is a, c, g, or t
  misc_feature (213)..(213): n is a, c, g, or t
  misc_feature (228)..(228): n is a, c, g, or t
aaaaactctcaccaaagcaagantcctgctagcaggtttcccgcctcanagattgaagcccaggtcgccacacaggaacaggctcctccccgctgcaaatggcgtgaacttntggaggccccaccccgttntcccagtgcaaagaaactcacattttttctatctcattacctgtggtcagaaattacctcatgtggnttcaacagggcattntgtactaaccatggnttattgaaaat

SEQ ID NO: 638550 - DNA, 118 bp, Homo sapiens
tcctagattagaaggcaggaagggactgaacattgaagcagcattcagagccggtgtctggcgcgacacacttgggagttaaagtccactttactgtgcgtcgaatgtggtccgcgct

SEQ ID NO: 638551 - DNA, 1885 bp, Homo sapiens
  misc_feature (255)..(255): n is a, c, g, or t
  misc_feature (984)..(984): n is a, c, g, or t
  misc_feature (1126)..(1126): n is a, c, g, or t
  misc_feature (1600)..(1600): n is a, c, g, or t
  misc_feature (1711)..(1711): n is a, c, g, or t
tctttattattattttatgggctggtggtttatcccctcggtcccggctacgggaaatttctttccagtgtataaaatttcatttctgtggttccccgaggccatagtttcaacagcacatacgtgaatgtgcaattctcagcatgtgtattttccaccagtggctcgtggtaagctgggtgctccagaagtgtgtgcatgtgagcgggtggaagacaacacctctcaccatgtgtggtgtctcgtggtgtgtgnaccctcatgtgtgctccgcgtggaagttatagtgccagcgcgacaacacgccataacatgtggcgcgtgtatacacaggggacacaaatctcgtgatgtgtggaatctcctcctatagagaagcacgaggagtgtgacgagctgtgcgcttctcttgtgtggtcacctgtgagcgccctgtggctctctgtggtgagcctgtgcccgcagtgtgtgacagtggtgtgacactgtgtctcgcagcctgtgcgtgtgggcgacgacgcctctgtgagagagtgtgtgtgcgcaagttgtggcacagaccacccggcgcgccctgtgcccacccggcggtgtatctcaaagtgagaaggggccccaagggggacgagagacacaccgtgcggcgatgggtgggcgacacgcccctccagagggacccccacagagagagacaagccccccagatcagggaagacaacccctctcgcgttgagagtgacgcacccgacgcgcagacgaaacctcgccgcaaagagagcccattcagttgacaacacacaagcttcaacaacacgaacaccgccggccccccaaaccaaaaggagaagcgagagccttcaacacagggagtactccccccgagagcaaaacactccaataaacccacacgtggtgtgccaactgcgaggctagaagaaccccactcccgctagacacacgacgactccactacccgcagcacantatgcaccggggccggtggcacacacacgcttagtggctactaccccacccagcggagacggcgcggcgcagcacccccaccctccacggtgggagcaagcaacccacgccgcccaacggacatctccaccccaccaacaanggcggcgttgcgccgacagaccttagataaccaccaccatccgcgcacgtcgacacacaactatcaccccccccatatcaccgacatcccacacacacttatcccgcactcttcaccaccctcaatacaagagaaccacaccaaaatacaccctacgccccatcatgcagggccaacaccacaagggcgccgctggtgcagcaaaccactcctcgggtgacactccctcacaacaacaccccccgggagggcaaagacacccccagagcacgcggaaccacacagcaacacagacacatcctcgaaactatatggaccaaacaccgtgcggcaccgaaacaaacaaccgaacctcagccgagacacaccaccgcacaccacacatacagacacaacagccaacaacccccaacgtactacataggggaactccacagagaaatactcacctacagcgacacaacaaaagcgtgngcagccgaccaacccataacaacggtagacaactgatacgaatccacatcccaaaaagcccgactctcaatcaactaccagatgcgacgcaataatccacgaagaagatcnaaactcacccactaacatgacgcacacaccctcatcaacaccgcgctcccccccctcataacgcaacgcagccacaccatgaactagctacaacacagacaaaacatagcagacaatcaactaacagacatcgtatccaaccaagcagaaccaacaccatccgcatacataaac

SEQ ID NO: 638552 - DNA, 534 bp, Homo sapiens
  misc_feature (6)..(6): n is a, c, g, or t
  misc_feature (79)..(79): n is a, c, g, or t
  misc_feature (142)..(142): n is a, c, g, or t
  misc_feature (274)..(274): n is a, c, g, or t
  misc_feature (279)..(279): n is a, c, g, or t
  misc_feature (490)..(490): n is a, c, g, or t
aagccnatattttaccgtgatcactggaggtaatcaagatcagaggattgcaagtgtgtaaaaccccaagttatgaggnaaattgtaggcactcctaccgtaatgaaaatctgcccttgcctgtccttcccatattgttaantcctactggtgtttgtttccccacccacacagtatggaaaaaatacatgttgctgtctccctccctttcctaaagctgtcccatctaaatacaaagcaagtttagaaatgttttctcttcatgccgggcgcnggtcncacgcctgtgatcccagcactttgggaggccgagatgggcagatcacctgaggtcaggagttggagaccagcctggccaaaaccccatctctactaaaaatacaaaattagctgggtgtggtgcacatgcctgtaatcccagctactcaggaggctgaggcaggagaatgcttgagcccaagaggtggaggttccagtgagccgaaaattncgactgcactccagcctgggtgacaagagcgaaatccgtctcaa

SEQ ID NO: 638553 - DNA, 1071 bp, Homo sapiens
gaatataaagccgtgtgtttatatgaagtgaccttatctgtttcctggataatacctttaagaattaatgttcctgagtcaggcgtgcgatggtgctgctgcatctagtcccagactatttgggaggctgaggcaggagaagatcgcttgagcccaggagtttaaagctgcagtgccctgtggttgcgacctgtgatagtaactgcactccagcgctgggcaagatatgcgagagctcactctccacaaaacagaagaaggataataaccagagaaaataggacatgatgttctgtatgagatggcctattcacttggagtgagtactcagttcttacagcgttctatcctagactcggggcattctaagatgtttgcaaatctagaacgagttctttacccaggcatcgctttgagagctgttgacctgtggtctgtgtctctatctaatgttgtctgtccctcgtgcttcctgtactttgggttccttctttgaacttctatctttcatctgtctttcggtcacttttgacatgcgtatatatgggcagggcgtgagagacagttactgagcacctgggtgagcacggcctggcttcaaagattggagaagagcttctggaaccagaagccctgtcttcctccagtgtctcaacacggtgtttgctcttcagtcataaccggaatctgaatcacagaacgtcatttttcaaatatccatgattactccctgtattggaggcttagcctgaatccatgctggtttgtgcctgtaaccaggtctcccaagtgcactcatccagggtcaggggttcagatgtgtttaacggagacccctatattcagggcacagttggcctgaacacctgccgatggcgaacgcacctgacacaatctcgtccaggcccctattcaggatcgcacagaaatccacgtgaccctacagttggacaatcgccacttaacctgtacaggcaccatccggttgaggcccactggctgaatcgtagacaacgaccaaactaactggctcgcatttacaccacacgccaacaacacacaaacaccagc

SEQ ID NO: 638554 - DNA, 176 bp, Homo sapiens
  misc_feature (32)..(32): n is a, c, g, or t
  misc_feature (131)..(131): n is a, c, g, or t
  misc_feature (155)..(155): n is a, c, g, or t
  misc_feature (168)..(169): n is a, c, g, or t
agcgggcgcagagcggtttggtcgttcgttgnggcggtgctgagtttttcgctcgtcagaactgcggctcttcactacgggcagcaggaagcggcagcgtgcggtccgcgagacagtggcctaaagacttnccggcgttgggtgaacagaacacntcggcccgaaccnnaagcaga

SEQ ID NO: 638555 - DNA, 201 bp, Homo sapiens
atgatgaaaaggcttcttgtagtcccataactttccttgtgaactaatgttgtgatcccctcgtatacagtcacctgcatagttcctacaggctaatgtggtaaaactgtttgactttccaatttaaccttaggcttctgttgcttataagcgattcactttgctacggctgggaatatggggaaacttaattatgggcct

SEQ ID NO: 638556 - DNA, 1173 bp, Homo sapiens
  misc_feature (1173)..(1173): n is a, c, g, or t
cggtggggacggggcggggcgcagccttgcgaagccctaatcgcatgcgctggggaggggggcggctgaaaggggggcggtggtcgtgccgcgcaagcttgtgattgaatggtggccctgtgctcagactggtcacggggggaggctagccggctgtggaccagcgggaaggcggtggctggggctcgtcggtaggccatcgcccacaggtctgtccctggtgaggagctgcgccctgttaggctgcttggacgtcggtgcgaggcaggcgcgcagcgtgacagttcctggacagccgatcgcagtcgtgcgatggagatgttactggcaggcttggggcctgcgtgtgcccaggagccgtgctggtggcgggaaacgtctcatgcctaaacgcttggaagcagccacccccaatgcccgggcattgtcatccgagaccatgagggcgaggcatttccgagaactggattgcgtgagcagaatagagaaagcttagcggaaagagctcctttgaggcaagtccccctgagccaaaaaattaccccttgacttttcttcattcccttccccgacaaggggccccggtgttgggcgtggaagctttcttgagacaaacgttcccctttcaaggtaacaaggtggggacccacgcttcctttcacgtaggtcaaagctggagcgttggcgtagcctttagggccttcctccaaggcctttgggatggttgcgccatgccgcttctttcggcttatgggcaaaggctatggggggtatcaaacttccccccaagcgttttcaagtttcgcgttggtgcgttggaaaaacacgggcgatggttcgcgttgtgtggccttttttttggaagtagtgttgtgcgaggacgcgaaaagttggcaatatttttacacccccaaagattccctgtggaatttatagcccccacaaaagaatttcctctgggacgcgccaatgcaaatcccgaaagacccaaaggattaggccattctctaggcgcacaaagagaaagagttttggggagatccatctaggaggcccccatttgcaaataacattagcaggagagagagaactttccccagaggtgggttagagaactcgtgtataagccaagttttgtttcaccaaagtatttcacaatatttggcatatacn

SEQ ID NO: 638557 - DNA, 961 bp, Homo sapiens
gattgtctgcggttcaccttgcctcatcctgtctgtagcgtttcaggagaaccggaccggctgagagctctaaaggagtcaacgcgtcgaactgtgtggtcatccccaggtccagttccggtgtgttccaggtagcctacgtggttgttccagatagccaagtggggttgtcatcggctttcggtcccttgaagggccccctgtttggtgtccacagtagagccaccctgtgaagagtggcattcacaagttgatcagtgactacgcagactctgtgcccgaccctgaggccctgaggtgtgtaacgtggactacgttcagtggaggcatatgaccagaagatcgctgaggaagaagctaaggccaaggaggaggacgggggtccctgacgaggacgggctgcggtgtaacggtgaccccagtccgtgggcctgcgcgagctctcgtgcatccgcaccgtgatctcgaggtcagctcagtcttgcgcggtcgcttggacgaggcgacgagacctggatcgcgcatgccgtaaaacgagctgctgcaacttcctacgccctggcagcatcgagagagcaagatggagcatctagcgcagctgcgcaagaagttcgaggaggacaagcagaggatcgagctgactgcagggcccagcgcaaattccgaccgtactgagctgtgagagccgcagcgaatggactggaggtgcagggccaggaggaggcgaggcagggcctgcagcggtctctgagaggccgagctctggccaacgggccacaggttgaaggccaccgcgtccaacagccccatcagagtccacacaggccaggagggaaggaccaggccacccctcggttcttgtgcttcagcagttcctggggaccaaggcgtgccgagaggaggacttgtccttcctgcttcttgcctccacacccttaactccaggacctggatgaagtcc

SEQ ID NO: 638558 - DNA, 284 bp, Homo sapiens
  misc_feature (6)..(6): n is a, c, g, or t
  misc_feature (26)..(26): n is a, c, g, or t
  misc_feature (32)..(32): n is a, c, g, or t
  misc_feature (124)..(124): n is a, c, g, or t
ctacgncgggcccggcctatttaatntttttnagagatagggtctcactgtgttgctccagctgtagtgcagtggtacaatcaaagctcactgcaatctccaactcctgggttcaagtgatccncccacctcagccttccaagtaactaggactataggtgcaagccactatacttagctcatttgtaaaattttttgtagagctgagatctcactgtgttgcctagctggtcttgaactcctggcctcaagcagttgtcccaccttcagccttccaaatctct

SEQ ID NO: 638559 - DNA, 402 bp, Homo sapiens
atctcagcacggtaacatttcttgcacggcaacagccctaccagttccttcacactgtggaacaggaactttcacaaaccgctgagcagcatgtgcttttttgtcactgttgttgttactcccataaccaatgttgggcatcaagatctggcccttaaatcttctacgaacactgttgtcaataccacggggtttctgcttaattttgacatatcagtcagactgatgccagatgaacgtcttggtcctggttttgatgatcatgggcttcgtgaggagcccgagtgtggccctgatgctaagtgggagatggctgccaactgcataggcagcgccaaggaagagagctcaaacccacgttgttcaaagatcaattgtgatcatttgacagtgttattgtga

SEQ ID NO: 638560 - DNA, 419 bp, Homo sapiens
  misc_feature (1)..(1): n is a, c, g, or t
  misc_feature (154)..(154): n is a, c, g, or t
nttcggcaaaaggcctttcacctactgccatgattctgaggtctctccagccatgtggaactagtctcactccgtcacccaggctagagctcagtggcataatctccactcaccacaatctcccgggggttcaagcaattcccctgccttggcntcctgagaagctgcagacactcaatgccagactgtgaaatcagccaggagggagactgtccctgcaaagcccaggggcagagctgcccaagaccatgggaacccaccatttgcatcagcatgacctgaatatgagacctagagtcaaaggagatcatttcggagctttaaaatttgactgccctgctggatttcgggcttgcatggaccctataacccatttgttttggccaatttctcccatttggaatagctagatttaccca

SEQ ID NO: 638561 - DNA, 311 bp, Homo sapiens
tggagtgccaaaaccttctgctgactactggtgcaaactttaataaaaaggacaaatatgggagatctccactgcactacgctgctgccaactgcgattacccgtgcctgtttgctcttgtgggatccggagcaagtgtgaatgaccttgatgcaagaggctgcccacccctgcactatgcagctacatccgacacagatggccagtgcctggaatacttattcagaaacgatgccaatccagggatccgtgctacgccaggatacaccgcagtacattatacagctgcttatggacaccggctatgtctt

SEQ ID NO: 638562 - DNA, 1048 bp, Homo sapiens
cggaacgcgtaggacaagaccaggtctactgtgatagagcatagcatctaagaatctttaaggaaggtttactactataaaaccaacaaaatcaatatgggtggcattggcaattggagctccgaattccaagaatgatagcaaggaatctttagggggtagatagcttccctaataatcccagagatggaagtgaggggtaactcccagaagtgggactaattccagattagcccctaggagagcgttacggcatctgtactacgctggtagcttcccttaataatcacacacgacgtgttagagactcagggtaggcgtggtgggggtgactttgaccggtttggtcgtggagcagcaatggcaatctcctagaaacggttctaacagacacaatccagggtacgaaccctgagtgaaagggaacacgtgggggtttttggtgctgttcaaagtgtcgtgcgctctgctgagggggggatcacaaggaagaagctctgttggtccctgagaccgttggctaggaaatggtgaagccactcgcttaggtgaatcgtgtcaggagatggagaggtccgcgttatcatcatttctatgacgctagcagctggactaacacaccacatctaaagaggcgaggcactaatttggaaaagaagtcccctcacgaagggggaccccacaagtgtacccttgtttgaaccctatctttatggggtgaccagtgtggttgcctctatacagtcgggtgagccattttttacaagatagacctgcgtgacagaagtctgacaaagttatgatcatggaggaagaatgcgtcttcatgtgtggagacatttgtgggagagagcagcctaagcctttgggggggggacgtatgttggagccatacctagggatttaagagccaagggaaaattaccatttcaaggtgttaggtggggcacacaaacaagatatgattgcgtagaaaaaatcgtcagaaagatagtttttagaaattaccaggggggataaaatagaatagagggataggggtagatac

SEQ ID NO: 638563 - DNA, 244 bp, Homo sapiens
gaagaattttccatgtatttcgccccacacagggacagccttcctcatcagtcagcatcccccaccagagtggtatgtattgttacagttgatgatgccgacattgacacatcatcacctaaagtccatagtttacactagggttctctcttggtgttgtacatgctgtgggtttggacaaatgtataatgacatgtattcactattatggtgtcatacagaataatttctgtgcccatttcaa

SEQ ID NO: 638564 - DNA, 868 bp, Homo sapiens
  misc_feature (384)..(385): n is a, c, g, or t
  misc_feature (435)..(435): n is a, c, g, or t
  misc_feature (464)..(464): n is a, c, g, or t
  misc_feature (571)..(571): n is a, c, g, or t
agcggcttttttcagttctgtcttcctgaggctgctgtttctgggcatggccagggatcttcagactttacaaaccagttgtgcagagccaggcatttcaataaggaacaaaatgctgagtaacaacatgaagtcagagtgttgcttgccaagagctgggaggcctgggtggtttcccaatcttaaagaagcagaaggatattaaagtgagcctcccaaaggaaaacgtggatctacttaccaacgcagaaaatgatacacacggattcgatttaggcacgctacattcaaatgacttggaagagcaggttctctgagccaggatactaaagtccctgtttaggaaagagccacgttgtatgtttaccctaccacaaagatacnnaattctggaggaaagtggctctgggaattgaacagtggctcagtgatgtnggggccaccaagtctgcaattctccctanctgttcttcatggttgtaagatgactgctgcaattctcggcatcatgtgcatgttaatgtcaggaggaagaaaggaagagggagcactgggatgttacattcatttngtcaggaaaagcaaagcctttccagacagctccgaaacttgcttacctctcattggccagcaccatcacttgaccacttgtccactcctagctgcaaggaaagtggcaaagtagaaggtatttgagaatgtctgctgggttagccaaaacaatagtgacttctacacccaattttctgggcactgcagaagtatccttgagtcctatgtgatcagagggagagcaaacctcaataatgaaacagattcaatttccatcacccagtgagacaccatgggattagaataaatttttaaa

SEQ ID NO: 638565 - DNA, 309 bp, Homo sapiens
gtgcacttatatttggcataatgtcccatgttgtagcatgtgtctgtacaccattcttttaaaaggatggataatattccatagtgtggatttacaacattgtgtttgttgacagacacttggattgtttccgccttttgactgttatgaaggatgctgcgtgaacattgtcacacaagtatctgtttgagtccctgttttcagtttttcctagggtataaacctaggagtggaattgctgggtcatatggtaactctgttcaacttttcaaggaaccaccaaattctttttttttcctttatttcttt

SEQ ID NO: 638566 - DNA, 400 bp, Homo sapiens
  misc_feature (69)..(69): n is a, c, g, or t
  misc_feature (82)..(82): n is a, c, g, or t
  misc_feature (115)..(115): n is a, c, g, or t
tcagacatgtgagagttgctgcttcactgatgaggtctttccctcagctcgggacctccacagtacacntaggaacctctgnaactccatcctccctacctagacccatagtgcntggccctctcctggtgccattcaccctcaacttcaccatcaccaacttgcagtatgaggaggccatgcgacaccctggctccaggaagttcaataccacggagagggtcctacagggtctggtgagagtccaacccatctcactctgcctggcccaccttaccagattccacctgcatcacccatgcccgggatatagaagaagatcccatgtgaatcaccttcgaccccgagtcacaagccctacccactggtgtcagccccacccacctatctcatgtcatac

SEQ ID NO: 638567 - DNA, 185 bp, Homo sapiens
ccacgttcactaatgtaatgaacccatgcatatatacgtatcatatgaatattttagcagtgtcctatgttgaatctagttctctgcattaccattattactgttaaagtattttttaaatgcttaaaccaaaaaaaaaaaacaccaaacaccacacacacacaccaaaaacacacacacccccc

SEQ ID NO: 638568 - DNA, 169 bp, Homo sapiens
  misc_feature (124)..(124): n is a, c, g, or t
agtgatctttattgactgtactctttatcctgctattacctgatttaattgataattttttgtgtttgtttttttaggacgactataccataggttggcattggaattgcgacatgcagaaccngtggagattaatgtgctaaaatttgatatggtgcctgtttatgct

SEQ ID NO: 638569 - DNA, 232 bp, Homo sapiens
gaggttacatgtatgtgcatgccaggtatcaaaggtgtgcatatgtgaatcagaaataaatgaatgtcagagcaacccttgtgtagacaatgggcagtgtgtggataaagtcaatcgtatccagtgcctgtgtactcctggtttcactggtggccaaatatgcagattgatattgatgactgttccaatactaccgtgtctgaatggagcaacagtgtaatcgatcacccga

SEQ ID NO: 638570 - DNA, 357 bp, Homo sapiens
tcgactttttttgaaacagagtcttgctctgttgccaggctggagtgcagtagtgtgatctcggctcactgcaacctctgcctcccgggttcaagagattcccctgcctcctgagcagctgggattacaggtgcacaccaccatgcccagctaatttttgtagagacagggtttcaccatgttgctcaggctcatctcgaactcctaacctcaaataatctccccgccttggcctcccaaagtgctgggattacaggcgtgacgactgcacctggccattgagtatctttttcatgtgcctaataggccctttaggttatctttttttttggacaagttcgtgtcgacgcggccgcg

SEQ ID NO: 638571 - DNA, 195 bp, Homo sapiens
gcgtatctgatggggggtgccagaccccaactaagcaacccgaggaaatgggaggcagtgtgaggtggatgctcatggtgagttcttggtcctgatgcaaatgatggagcatggagatggatgcctggatggcagtgtcccagtgcactgcggtgctcttgtaaaggccttgagtgcctcctgaggcctatccca

SEQ ID NO: 638572 - DNA, 437 bp, Homo sapiens
ggatccagttcgagtatggcagcagggctccgaccctgcgatgtggcatccacgctgaccttcctgcgcctgatgtccaccgagtgctcccagaacatcacctaccactgcatgaacagcgtggcctacatgggatcagcagactggcaaacctacaagacaggcccctgctccctccagggctccaacgagatcgagatccgcgccgagggcaacagccgcttcacctacagcgtcactgtcgatggctgcacgagtcacaccggagcctggggcaagacagtgattgaatacaaaaacaccaaagacctcccgggctgcccggtcaatcgatggtgggccccctagggacgttggtgccccagaccaggaatacggcttcgacgtttggccatgtatgcttcctgtaaactacctccatcccaatccccggtcga

SEQ ID NO: 638573 - DNA, 727 bp, Homo sapiens
tggtattttaaataaagacggggtttcaccatgtaagccaggatagtctcaatctccgggcctgtttgatccacctgcctgtggcctcccaaagggctgggattacatgcatgagccaagccaagtgttgcccggccaaaaattaaagtttttttaaaagcctgatatacagaaaccattcatatccatgtgcagtgagtgcgtggacagatcatttacaccatctcagaggataagtgtaatttcgtgtaaggggatccataacaattctccaaaagtgctacgaataaagataatttcactctttaggaaaaaaaataattaacccacgtgaagacccaccgtggtataccttacaaacaaaaaatcctatccccaaattcacattacaagaagcagcaagtgaaagatgacttattcattcatagacatggtcactacagtgactcaaatacattggtcactcagtgctcaatacagtgggatacgaaaattacccgagacatctccatctgagaaaaaaaaacccataaaaccgtgagctaaaagaagccaagagaagggagacaccccaggggtagggccatgacagataccactaaaagagcagagtgccatagaaacgtagactgagtaactcagacaaggatcagaacaaaactgggagatcacgcgcaaaaacctaagagcaaacagaagggcaaaaaaggacaggtaaaaaaccgga

SEQ ID NO: 638574 - DNA, 916 bp, Homo sapiens
cggacgcgtgggttgacaagagaggagtgtatccaatttatacaggaattacaagtgcagtctgattgtgaatccttgtcttggcttcttagccttgagagtttttaaaagttgaatgtgaaattccttatgaaaaagttccaacaaagccaaactttaaaagagcctatatgtggtcaatcactatttttgctgtactttatgcaaataatcaggccaaatataataaaactaaaacttattttgcaaataaatggtcctgttatgatttgcctttaatagaaaagggggactggagagagaagaattatgtttcagaagaaaatgatagcatacctgtgttagattctagctttgtccatgtttttaagttgtaattatttgcctacatttgaactaaatcttgaattctttcctggctacaagtctccaagctaacatttaaatttttttctcctatgtttctgacttggaataagtagaagttaaaactatgcttttcttgaagccctgcagactggagcaagacaacttgaataaactatgggaaaaatcactacagcaacttatatataaacagcttttatgctttgttgatgtatggaatactcagaaagtcactgcaacacctgatttaaactacaaccaggagactctgtcagattaacactaccatctgaagaactacgagactctcaaaaactagtgtatagtctacagtagatattaacttgtttcttctgtttcatagaaaccctttattaaaatctgttgcgtcctaaaaaaaaaaaagggggcgcctaaatcccggggccgctaccgccccttggcaaggccagggcgtaaagcgggcgtaacccgggacagccggtgggccctggggtgcccccaccgaatgggcccccgcgtctaacac

SEQ ID NO: 638575 - DNA, 180 bp, Homo sapiens
  misc_feature (161)..(161): n is a, c, g, or t
cactcatccaatcatgtctgcttagcagtgctccagataagagatttcaaagcataattaatccaagtactatttaacgtggcccttggttggttcttcttagcagctgttgacccaaaaacgcacattggacgcaagagaaagacactgtgccatttttngctgagctggttagggatg

SEQ ID NO: 638576 - DNA, 88 bp, Homo sapiens
tgggggccagtggcgtaagaaacttgggagtgagaggtttgactgagcttgggaagggagcttgggaaaacacaacttgtgaaatcag

SEQ ID NO: 638577 - DNA, 241 bp, Homo sapiens
  misc_feature (81)..(81): n is a, c, g, or t
  misc_feature (151)..(151): n is a, c, g, or t
  misc_feature (238)..(238): n is a, c, g, or t
  misc_feature (241)..(241): n is a, c, g, or t
aacaaacaaaaaaaaaaccaaacaaaaaagccaaaaaacaaacaagaaaccaaatacaaccctccccccaagacaacacgncagtgcacatggcttgttcacttcacagccccggacgcaaccttcccggacgggcgtggaagcaggcagncggcctccatgcactttatgtggagacaactggccccgcccgtggcctcgtgctccgcagggcgcccagcaccgaccatcggccccnccn

SEQ ID NO: 638578 - DNA, 207 bp, Homo sapiens
attccgagcatacacccacatgagtctaggcacagctctcctatccctcctgtctccagccctccggagcagaaagtgggtctttatcgaagacaaagctgaacttcaagacaaaagtgaattttcggatgtggaccagctagctattagggattatgaggagtttgaatcatcttttgaatctgcagggaacatgccaaggcagtt

SEQ ID NO: 638579 - DNA, 414 bp, Homo sapiens
  misc_feature (347)..(347): n is a, c, g, or t
atcacatcatttatgggactagaaattgtggagaactcattccctccaacaccaacccctagtgatctcattctagtgagtaaaacctcaggtcagttgattgtaaatggatttttttttaaaaagcttaattcaggcttttattgctcttgtgttcagtggattcatcttgtgactggctccagattgtgcccttctcccatcccacaccaagctgatttgcaaattcacacaattgttcccaaggagagaaaattgatgactcagtataaacccatcactactcctagaaaatataattcatgaatgcattccttattcaaaaacatttagtagcatttcatagnggaggagatcagcatattatcaggagaaaagattcatgccacattttggtttaaaaatctggtttca

SEQ ID NO: 638580 - DNA, 1675 bp, Homo sapiens
  misc_feature (549)..(549): n is a, c, g, or t
  misc_feature (1675)..(1675): n is a, c, g, or t
ctggagactgaggaggtacacagtgtcctgtatctaaaaaggagataaaaccggaagcgtagagaaccgaaagaagaagaaaaagccccagcgggtgcgaggggatggtacatctgaagaagctctgggtgacccgtgtgaacgacaagactcaaactcctggttccctgctggtctctgagtatcccacagcagactggatgtatgagacttgatgtaatgatgagcgtgaagagatcctgtaacacatgtatagcggatggctcgctaatcttttactactttgctattagaaggatgcgaatcgtattgatggtcattttttaacgtctcccatcatgggagtagtcgtgggtagaagaggagagggaatggagacagggagaaaggcgatgcgcaagaaggaaagaccttggaggaaagctggggagagaatctactgctcaggtcccccagagagagaggaacggggagatttaagtacacgaagtgcagagcgagcaacgtgtgaccacgttgcactgaaatgtaccagggcacatgtaatgnaacggagacaagggagcaacagtacggcccaggaagtcaccacgcaaggactggtcccacaagacaggcacagttagcagcacagaaggcatggagaactcggcatttccatcgttgtcgggcttgtacacatcggatgtccagacgtaggggtggggcctcaggggctcacggagtcgttcagataggggagcaatggacaaccgaattgatggaaccaaagacgcccaagagaacaccgtgaaaggcctccatagggaatccaaccattcccacgtgacccacgagtcgcggcaacgtcctgatggcccgttgttaccccagcagccccagcttgggttgtcaactaacagggcggccaaaaattaaccgtggcacggggccaaaaaacagggggggcaatttggacgaaaggccgcgccaaaatatactgaagcattgaaccaagcacttaccattcgacgaagaacgccacccagggggccaattccccaggggaaagacattgcacgaagaaaaggggcccctcggcaagagacaggacacggggagcgagaaaccacgaacacagacacagtggacacggtcgcaaaacaactgcgcgacgagaagaacaaaggaccccgggcctaaagagctgggcgcccacgaagcttggagccatacgagagtggaccaacgaaagagcctggggatgaaatggcatgctaatcacacgtggggccaaagaaccgaaagccagacaggagctgaaccacaacccagaggaggaaacagtgaaacaagtaacgaggacagcggacagagcgaacagacaacagagacaaggagagcaaacaaccagcggaacaagcagcagagcagacgacaaaaagagaaccaatggagtaacgacacacagagaccaagctagcagccagagagcagcccaccaaggagataaccaacaagcagatacaacgcccacgcaaccacgaatcagcggaagaccagatcagcgacaaggcaaaaagggaacgaacaacacaaagagaaacgaaaagaataaaaacaaaagaaaacaacagaacgaacgaagaaaacaaaaagcagacacacaagagcaaaacaaaacagaaagacagan

SEQ ID NO: 638581 - DNA, 661 bp, Homo sapiens
ctggagtgcatgttcagactggacattagcccatatatagcccctggctctacagagagcggtagagctagctgatcatggagtaatatgcctgcaggccgagactgatcctaggactgaggcgccaggatcactcaggcccagcagtacaaggctgaagcgagctatgatagcgtcactgccctacagtatggacaacagagcacgaccctgacacttaaaatagtaatattcaaccaatgggacactagctattcaccagggagattgaggccctagccatgagccaggcagatgatcgcagctgcgatgtgatacgttagggaacagaccagacaatggctacctgacgttgcgcagctgacattgcaatgcgagtctgagtaggacagaagatactgtcagacatgcactacggcggcatacgaaagaccgaaacaagagtcgctgagaaacagcgggatagtatggggctctagcagaacgtgatgatggggtctctgaagataaactgaatgatttgagatgccggacagcctgagatacctgcacttggcaccggaacctgtgcttagagtaggcgcatgctaaatctcaaggagaggcccggcacagcagtgctgtcgaacagaactttaacgggttcgctgtcctggctccc

SEQ ID NO: 638582 - DNA, 122 bp, Homo sapiens
ccgaacttgctatgctggttagtccctgagtttgcatggctggttagtccgcacttgcatcgctggtttagtcttgtagcctaacgaagacctgaaaacctgggaaggcggcggactttgca

SEQ ID NO: 638583 - DNA, 902 bp, Homo sapiens
  misc_feature (137)..(137): n is a, c, g, or t
  misc_feature (338)..(338): n is a, c, g, or t
  misc_feature (402)..(402): n is a, c, g, or t
  misc_feature (497)..(497): n is a, c, g, or t
  misc_feature (515)..(515): n is a, c, g, or t
  misc_feature (544)..(544): n is a, c, g, or t
  misc_feature (568)..(568): n is a, c, g, or t
  misc_feature (725)..(725): n is a, c, g, or t
  misc_feature (760)..(760): n is a, c, g, or t
  misc_feature (878)..(878): n is a, c, g, or t
acctgggtggacatcagcactgccattgtcagccctgtgagggttagaagagcttggtgcatattaaacactgaacagatgttagctgttgttgtcttgagcaagttttcttaccattctgggccttaatttctttntgtttaagatggaagtaatacctaattcttaggttgtgagaattatttgaaatgtgaaaaatattgtcagtgggtctgagccgtagtaaacagtaaatagcagctggttacagtagtatccccttaatggcgtaggtatacgttccaagacccccagtggatggctgaaaccacggatagcaccaaaccctatatatactnggttttttcctataccgtacatacatacctacctatgataaaacttacaagttaagcacaatangagattaacaataacataatagaactggtacaatatactataataaaacgtatgtgaatatgatctctttccccttctcttaaaataacttattntactgggactcacctatntcacaccagaatgaccgcggataattganactcgaagtgaaacctcgataagnggtgatactgtatcacctttaatatccatctgtagtatcgtatcacttgaatcatgtgagcttctctaccattctgcaaatgcttacataagattactatcttttacagtttaatccttctagttgtagggattttgagatatgcatagtgagactnacttatatgatagatgttctctgtttacactacangctttctgcgttactcattcttgtgaatgcagttcactatcaacacctgattcttctcttaagagttcgtgactgggattgtctgtgaagatggaaacttatcttatctagaaaatgncattgaagtacattttctatttat

SEQ ID NO: 638584 - DNA, 470 bp, Homo sapiens
gataatttgtattagtgtaggaatatattaggcaaatgtttagttggtccaaattatgcataagatatttggtaacttttaaaccattggccaacattgggaaccagcttagcctatgggaagccataacaatctacactctcgcataacatctcaccatgtttcggcaaaattcacatttttctaaaatttatatttttatggtgttagcctgtaagagcattttagcatattgaaatgcatgctgcttaagatgtgtctggttcaaatatcaaaacttgctgggtcatttttacatagtagaaacatactgtctatgtgttgcccaattgctgtttgtccactctgaattctggaccctttttggactaagaattagttaaattcgtgaactaagagaattagagatggggtagagtaggatcaggacagtggggttacaaagataggaaaggaaagtcagcatttga

SEQ ID NO: 638585 - DNA, 208 bp, Homo sapiens
gcccccccaaatttttttgggcccccccccccctttccttcccccgggccctttcctttaaaaggaagggggggggggttttccccaaaaaaggggaaaaatttggggaaaaccccaaaggttttttattttttttttgcccttttccccccaaaaagggtccctgggtttttttttaaaaccctattaacccctttggggcccggta

SEQ ID NO: 638586 - DNA, 140 bp, Homo sapiens
  misc_feature (113)..(113): n is a, c, g, or t
gacttcgcgcgcgcgccccccacatcctcctcgggacacttgtccctggatcctctacccctggccggcccgaggccgtataatcgggaagccttaccagcccccaagggggntttcccttgtttatctgcgctgcgagg

SEQ ID NO: 638587 - DNA, 116 bp, Homo sapiens
tgatagcgaggcgtgtcccgcagatctacattcgatgttcaatgctccacggggagactcgtccacgcggccggggaccacaggataagtcaccgaggaggggctcgaagctggtg

SEQ ID NO: 638588 - DNA, 367 bp, Homo sapiens
  misc_feature (351)..(351): n is a, c, g, or t
tcggtggactgagctgaccctgattcctgaggtaggtagaaagaacttgtaggtacagagttgggcagtgagaaacatcagcagccacagtgtcatccccattaatctcagccagtggggagcactatggtctgagaagtggatgtgggacatgcagggaggtgtattgtttgcccctgttttaacaggagcaagggagcatcactttaagtaattctatttctgttttccgaagtatccaccatcaaagaaaagagaatcataacattgcacaaatcttttagcaatttggatgcagtttacagggataatataggctgggaggactttctaacccattttccttctgancacccagtgtctgaat

SEQ ID NO: 638589 - DNA, 200 bp, Homo sapiens
cgtattaaaaagagtcgcatttaaaagttctgaagagaaagtgctctgggcgtcaggtggttctgccatgactagctgggtagctgtctatgcctcagtaatcttctctctaaaaaatgagacggctcaagatcaccatatgagatcacatccagctctaaaacaagtaatgttctgtgtcaactgtaaaggaaaataga

SEQ ID NO: 638590 - DNA, 845 bp, Homo sapiens
  misc_feature (311)..(311): n is a, c, g, or t
  misc_feature (317)..(317): n is a, c, g, or t
  misc_feature (415)..(415): n is a, c, g, or t
  misc_feature (457)..(457): n is a, c, g, or t
gtgagactccgtaccaaaaaaaaagggatcaaatcatgaagtgccttgtattttatactgagagcttgagagtttatcttgatgggcgcagtggggtgtctttcggcagaagaatgatgctaggacgtcagtggcttttgactggttagtatcctgtttttttagtaacaaatcttatctttttcctcatggggaaccctttcctcactctcagtttacatgattgggtggggctgatcccattcttcaacgtcagcctgagcactgcatagcccctgtcaaagtgataggttcaagggcgggtgtagaanaccaanatagtccactgagagtcttcttgtgaactttttatttttgggggtggaatctctgtcgcccaggctgggagtgcagtagcacaatctgtggctcactngaacccctgcctcccaggttcaagcgattcttctgcctcagnctcccaagtagctggggttgcgggcacccaacacaagcccagctaatttggtattaagtagagacggggttttgccttgttgcccaggctgtcttgaatccctgattcaggtgatctgcaactcggcttccaaaggtgctggaatacgggcgtgagccatgtggccagccttcttggaacttttaattgaagcaattaggacagaaaagttcaccttctttcagaattataaaatgtgtaggatttggacctgggagattctttacaatggaaagggactgttgagaatgagagcaaggacaaagtggagcaaatggggagaaaaggcacaatcgccggatcattttttgggcaatgatcaggcatggagattaattttccgtaaaga

SEQ ID NO: 638591 - DNA, 229 bp, Homo sapiens
ggatgtattgtaacggcacaggctttttacgtgaaatgacgttctttgataccaaaaatactaggacacgcttgccatattggcaaagctgtttttttaatgcctattgttggcaaaagcagagaatagccactctgtaaatggacaccgctggtaagaatgtaaagtggcacaaatttttcaaagggcaccttgttaatatgcaacaaaaaaattttaaatgtgcata

SEQ ID NO: 638592 - DNA, 260 bp, Homo sapiens
gaatgtttgctgctctgggagaagtaagtaggagagggtataagaaggacgctgacaccaggctttcctgtagtacttattcacagagccaggtgctatagtactggtggtggtgtggggggattgtccattgatcctccttgtattttgccataagagaggccttatttatgggctactggctttctctcattagttatgtgttttatattcttttcatgcagtgatcagaatatcatgtccaaacattcaagccgtca

SEQ ID NO: 638593 - DNA, 208 bp, Homo sapiens
agatatcccgggatctgataggaatccgggatctgatagtgattacatttatctaagcaacatacatacatgttcagtggtaagatgttaactaaatttctggtgacaaactatggctttttttttaattaccaacaaacattattagagtcaagtgcagagtcctaagggataatctcagtagtcactcaagtttttcttcaagtct

SEQ ID NO: 638594 - DNA, 107 bp, Homo sapiens
tccccaggtagactaacccaggtagaagtagaggttaaggaggtgatggtggctatgatggtggggatgatgaggctattgtttttttgtgaattcttcgataatgg

SEQ ID NO: 638595 - DNA, 176 bp, Homo sapiens
ccaacacaggtgaaatggctcagaacagctcagcatgtcctactgaggggcaggaaggatgctgagaaattcccaggcagcggtctcagctgggatgtaattttgaggggcgaaaaagttttgtgttgctttgcgggtttcttccctttgctcccttgcagggtttatattttgaa

SEQ ID NO: 638596 - DNA, 294 bp, Homo sapiens
  misc_feature (61)..(61): n is a, c, g, or t
  misc_feature (71)..(71): n is a, c, g, or t
  misc_feature (83)..(83): n is a, c, g, or t
  misc_feature (113)..(113): n is a, c, g, or t
  misc_feature (143)..(143): n is a, c, g, or t
  misc_feature (231)..(231): n is a, c, g, or t
  misc_feature (249)..(249): n is a, c, g, or t
acccagtacaggtactctcacaggaggcactcagcagggatgtagtgacagcaggtaagantccacctctntccctgcctgcncctgggatccagtattggcccatgtatctnccccatttcctcaggcttcctggacttttnttggagggaaagaggaacagaaagaggagcaggcaggagaagcaagagctcccgggggctatgaaaggtaacatacctggagagtttngggagacggcggcttgtnagagacaaggggaagagacagaaacaggagtattctaagaagcat

SEQ ID NO: 638597 - DNA, 263 bp, Homo sapiens
atatgttgaagcgggtggggctttttgaaatcaaaaaagcatgagaagactgcctttagttttggtttgtttgtttgtcaattagggtgtgcagggtgaatacatggtctgttgtacggtaatttggtaaaaagccaaattgacatttgctcagtacattgttttcactgaggaaatgtacgagtctgctgttaatgataatgcagaggattttcccaaggttgctgttgacgcacatcacaaggtagttttggggtcgacgc

SEQ ID NO: 638598 - DNA, 134 bp, Homo sapiens
tggagtgtatcctcgcgaagtgtatccctcgcgacgtgtatctctcgcgaacgtgttatccctcgcgaacgtgttatcctcgaaccatctagtagctggttccctccgaagttaccctcaggataacacgtgga

SEQ ID NO: 638599 - DNA, 147 bp, Homo sapiens
gggggctgaggcaggagaactgcctgagcccgggaggcagaggttgcagtgagtcgagatcgtgctactactgcctgggtggcaagggtgagactccatctcaaaaaagaaacaaaaaaacccacccagttttctttactgttggtt

SEQ ID NO: 638600 - DNA, 754 bp, Homo sapiens
aatttggatttaaaatataaatttatttatttattttttaatagtcaaaaatcttggctgtgtagtctgcaactctaaaatgatggtgtggctttaggatggatcagaagaaacatccaaaaatggagatgaactgtgggtgcagccagttataagtaatatagttaacaagcaaaaaaagtgctgccaccttttatgatgatttctctaaatggagaaccattggcctgcatccacatagacctttatgtttgtttccagtgtgaaaactggcctccttgtgcaccattcgtaaatgaagcagaattttttttcctcttttttccaaatatgtagttggtctggtaagatgtatcatgcgtatgggggctgtgtaatgaacaacgaattttaattagcatgtggttcagaatatacaatgttaggttttacaaagtatctgtgaggttctttctatttataatttcagactttcataaagtgtaccaagaatttcataaatttgtttcagtgaacttgtttgtgtatggtaggtcattaaacacaaggcacttactcttaaaaatgaaaattctctgatcatctaggatatgggacacatttcaatttgcagtgtcttttgactggatattttaacgttcctcctgaatgggattgataagatggtcagaagagaactcactggactaagagactattattcacgggataataaatattggcaattagaactatggggaacccaggtgggtaa

SEQ ID NO: 638601 - DNA, 341 bp, Homo sapiens
  misc_feature (333)..(333): n is a, c, g, or t
tgtgcaggaattagtaactttatatactgctgatgagaatgtaaaatggtacaaccattttggaaaataatgtggaagggaagtttcttcttttttttttttcttcacagagtctcgctctgttgcccaggctggagtgtagtagctcgatatcggctcactgcaacctctgcctctcgggttcaagcaattctccctgtctcagcctcccagggtagctgggattacaggcgcctgccaccacatcacttaatttttttgtatttttagtaggagacggggtttcgccatgttggctagggctagtcttggaactcctgacctcaggggatnccgccctg

SEQ ID NO: 638602 - DNA, 275 bp, Homo sapiens
gacaagggggtgggctatgaaagccggtctcaaggattactgcatatacactatcaactcaatacaaaatgagaacttaattttgcaccattgacaaataggtcatcttaggcactacaaaattccttaaatggatcttaaaatatttgtcctctaatatttaggtgtctcttctgccgtattcatcaattgcttacatttggtcccattatatttatagtcatatttcagtttgcaatgtgccctaattctggggctttcctggaatgaaggat

SEQ ID NO: 638603 - DNA, 247 bp, Homo sapiens
cccatggtcgagagaaattaggctacccgtcgcatactgatcattctatttccccctcttttgatccccacctccatatatctcatcatcaaccgacgtaatcagccactccaatcaagtgtactatacttaaactatcctctagtgtaaatgataaccatacacaacactaaaggacgaacctgatctcttatactagtatccttaatcatttttattgccacaactaatttctctcggaccaatg

SEQ ID NO: 638604 - DNA, 388 bp, Homo sapiens
  misc_feature (10)..(10): n is a, c, g, or t
gcaccctgcngacgtgttcaataacatccctcaaacactcaggcagctcagtcacctttccttcctcttacctgccccctctgacctggcctatctagtccatggagagctctccttctgtaggttttaacactgactttttcactgaacattccctgcctgtactgcctgaatcatctctgttctccaggcctgtttttatcaaaatcacacacacacacacacacacacacacacacacacacaccacagagtacctagtggcatcttgtaagaatagccatcatataatactaataatccactgtgtgtcaggcactgctaaggcctttgcattcaaacctcacaataaccctaagaggctgtattattatcccattttacagat

SEQ ID NO: 638605 - DNA, 202 bp, Homo sapiens
gaagagatgcagtgtagagagtccgcttagtaaataaaaagaacactgccatgttatatatatgattgattaaataagagacagggtctcactaaggttgcgcaggcgggtctcaaactccggacctcagattatccacccgtctcggcctcccaaagtgctgggattacaggtgtgagccactgcgccgggaccacagata

SEQ ID NO: 638606 - DNA, 451 bp, Homo sapiens
agcgggcctccctccccagccttccccgcgagcggacgcggcagagcctctgtctcgcttgtcttataataaccccccttccccatttctttgtgttgtattgactctgatgcttccactatacagaccatgtaaaacataatcagcagacaagaaagatgataatagcaacagaggcacgggagtgagagagagagtgtaacaagcagcaggtaaggaagaatacaagtagaggatcacgacgacaagaagacagaaaacggggaaagctgacaccagctggcaagaagggagccgttcgcatgtcagtagggcacgatgcggccagaaaacagatcagcagcacagggatagagagcgtgagcacactcccggcgacagactgtggttacggatcgacaggacgacacacgaagatcacagtcacttgaacggagagatttctatcacc

SEQ ID NO: 638607 - DNA, 543 bp, Homo sapiens
agcggagcgcgccgctccccagcccccaggcctggcggggacccccccagggaggggctccgggtgagcgctgcggggcgtctccctcgcagtcacgcccgccactcctgcctgcccctgccgcgcgcgcctgagcagtctgccgccttccctcgcgcagctcggttgtctccgacgtcgctcgggtgccgacttgtgctcgtgcggcccatgggcaatgcagaacaagcaacgctgcaggccccgacgatgttcgcacggaacctgcgcagaagaaccacacgagcttctccagacgctgcgagctgccacgcgagctcggtaccacaggcgcttcgctcaacggaacttgccccacagtgaatcgctcaatggtcgatgacgcttcaacgaacgatctagcgccaagacttcctttccctatcggtgaacgcactccaaagatttgcctgacgcacgttcttcacgacacctattgacgaccaaccagacgatgcgcacccatacgaccttctcgcggacgttcgatcgattgccggctga

SEQ ID NO: 638608 - DNA, 215 bp, Homo sapiens
agaacatgtacaagtacttcatcaaggactacccagatggtgtcatatcgaagctcccttagaccaggatgactggggagcttggcaagaagttcacagcacagtgcaggaatccaggtagtgggggatgctctcacagagaccaacacaaagaggatcgccaaggccgtgaacgagaagtcctgcaactgcctcctgctcaaagtcaaccagat

SEQ ID NO: 638609 - DNA, 192 bp, Homo sapiens
cgagatctaatgtttagacataggcatttagtggaataaactttcctcttaaccctgtttttactgcattccagagattttggtatgttgtgtctctgttttcatttatttcaaagaattaattttcttgtttgcccaaaagtcattcaggagcaagttaagtgtatttttgttgtagcaggcaaacatcag

SEQ ID NO: 638610 - DNA, 177 bp, Homo sapiens
  misc_feature (41)..(41): n is a, c, g, or t
  misc_feature (75)..(75): n is a, c, g, or t
  misc_feature (80)..(80): n is a, c, g, or t
  misc_feature (137)..(137): n is a, c, g, or t
  misc_feature (145)..(145): n is a, c, g, or t
ggaggacctggctcctgactctcagagaggataggctgganccctggggagcctctcctcggcctgctcctcatnttccnggctccctctgcaggctggggcagagcctgaggacaaggaagagttttccatccccntgcatgtnccctcctctacctgccccaaatttttatatta

SEQ ID NO: 638611 - DNA, 101 bp, Homo sapiens
gaggaccccgtccataaggtgtgccacccagattaggatgggtctgcttccccagcccacggactcaaatgttaatctctcttggggcacacattatggag

SEQ ID NO: 638612 - DNA, 164 bp, Homo sapiens
cgctgtaccggtgttatcgatgccactggcagtagcggagcttcatccctagtcaacaccaggagagcttctcccaaactccccaataaagctaagagactcacctgagttgtaaaaaactccagttgacacaaaataaactacgaaagtggcatcgataaaca

SEQ ID NO: 638613 - DNA, 397 bp, Homo sapiens
gggcagaggaaaaagatacaaataaaaccaggtttagggtcgaatgaaaataatatatgtgctatgttatgaatgtgtttcccaaaattcatacggtgggaactttattccccaagcagcagtgttgggaggtggagcctctgaagagatcttcaggcacaagggctctgccctcatgaatgaattagttccctttcaaaatgggctttcagtagtgggttcattccttcctgctcttctgctatgtgaggacacaggtccttctcctccagaggacacagcaagtgccttttgggcagcagagagaagccctggccaaatgctggaccctgattctgggacttcccagccctccaggaactgagaaataaatgtctcttctttataaaaaaaaaaa

SEQ ID NO: 638614 - DNA, 395 bp, Homo sapiens
tcgggtcggtgaagggcatgcccagctcgattacgtcggcgcccgctgcgggcagccccttgaggatcgccagggaggtgtcgtagttcgggtcgccggcggtgacgaaagtcaccagggcggcgcggtttgcttccttcagctcggcaaaacgggtttgcaggcggctcatcagtgtttctcctgctgggactgttgcatgtggtgcatcacggtttgcatgtctttgtcgccacggcccgagaggttgaccaccatcaggtgatccttgggcaggttcggtgcgcgcttgaagacttcggccagggcatgggcgctttccagggccgggatgatgccttccaggcggcagcactggtggaacgcggccagggcttcgtcgtcggtcaccgagg

SEQ ID NO: 638615 - DNA, 567 bp, Homo sapiens
gcttcgcaaaaacattcaatgaaacgccggtaaaactttccacggtactttgggattgttctggaccaggctgagatggaggcagacaaagagaggataaaggagaggcatcacttcgtggctatgcggggaatcagaatcgatgagaaaattccgcagtcgtccaaactgtacttcatattgctggggctctgcctggcaagggactgcagacactatgtcggcacaatgagattctctgtgtaccgtgagattggccgccaactcttcagcagtctgtggcagccgcagtccttgcttcaggggaccgtctgagtccacgtactgccagcgtttgaggtagcaggacactgccatctggatctcctcggtacgcactcatttcatgactgaacatcccaggcggccccggctccccaggcggccccggctccccacgccgccgcctcccggatcgagatgcttccgcctccgtcgtctctgctgcaggtctcgctctgaccgccggctcagctgtgtcctggagccccgcgccccgccgccctcgccaccgctctgggcggccgc

SEQ ID NO: 638616 - DNA, 174 bp, Homo sapiens
  misc_feature (50)..(50): n is a, c, g, or t
  misc_feature (144)..(144): n is a, c, g, or t
  misc_feature (148)..(148): n is a, c, g, or t
cggtggagtcgtgttggtcctcagaatccccgcgtagcgctgcctcctcntaccctcgccatgtttcttacccggtctgagtacgacaggggcgtgaatactttttctcccgaagaagattatttcaagtggaatatgccattnaggntatcaagcttggttctacagccattg

SEQ ID NO: 638617 - DNA, 229 bp, Homo sapiens
ggggggggggggggggggggtttttttttccccccggggggggggtcccccccccggggggggggggggggggccctttttttttcccttttttcccccggcccccccggggggggggggggcccccccccgggggggggggggggggcggggggggccccccgggggcccaaaaaaattgggggccttttttttttttttttttaaaaaaaagggggtttttttttta

SEQ ID NO: 638618 - DNA, 700 bp, Homo sapiens
  misc_feature (435)..(435): n is a, c, g, or t
agtccagagacaatggccccgatgggatggagcccgcaaggcgtcttcgagagtaactggtaatgagatatgttgacagacttagatgacatgaacctctcggagtcccttctccgtggacatctacgcctactggtctgtggaagaaagcccatcgtgcccgattcctagggcaggcgaggccatgctagcacttgtatcaaggcggttgatgatgtgatgtagctgcaagcgccaaatctagggaacgtggggaaagaacggggcacactttgccattgatcgatccctggcagcagattggatactcttacgaactacttaagaaagaccgaacgcctacggtcactttggatacctaagcaacccgactgctagaagattggcatcagccagcactagcagaaggtcggtgcgatggccagctgagggagnacttacattgggcgtccatccctgtcacagccctgtgattgcggggggcaccaatagccgtgcagtgtcgtgaggtcgctatgaaagagcttggcaggattgggataggctgctcccagcactcaatcgttcggggtatcgcctctgggaccgtgatgtttagaataatggctgtaaccctggagagtagcgctgatccccgcatatactacgatctaaagactggtattgttacaggggcactgaacgctgaacgaagatgtag

SEQ ID NO: 638619 - DNA, 932 bp, Homo sapiens
gggtttttggtgaccccctcttggcaccattagtttctctgtcgcccccaaaaccggttccccctcccccccggggtttctactctcctccccgcaatcggttttctcttctacgccgccgtgtgcgtttctccccggagaagccctcttccgtttgtgggcagccccaataggtgtggcccctgcggctgtgaccctggcggtagtcggctccggccttattccccagcgcctttttcctggtgccgctactaggtacgtcgtgtcctcccacggtctccctcccagggagcgcctttcaattctcccgcccctctaagaggactgtcatcacattgggatcgtctgtcgccaaaaagaattatcataaacagtcttgtttccgcacgctttcctccttacctccagaatttcttccccccgaaacgactcacattcccgctctttgtataccccccacttgtgcgagaaaacttcctaacctccggagaacacaattcctggttccttattaactccctcctaggagaagaatttttcctccctctacagccaccactcgctcagcaaagccctccttccccacacaaattatcgcacccacccgttctcccccagggagacgcccccccttttgcacgacccgtgggtcccccaagcgcccccccttgcgtgagccctgtgagtgcgtcccaccgagcgcagaatctcatgggccaaagaaagaatcccgcggccaataccacaggatgtgcgcaccccggtccatacaaaacgtctccctttggcgccaacaccgactccccggccgcatccgtgggaaaccacacaggggtgtgacatcctttgttaggagggttctacaaaaagaagcccccggcaccacgagaacttattttgaatcccccgacttccaagcaacccacaaaaca

SEQ ID NO: 638620 - DNA, 158 bp, Homo sapiens
  misc_feature (81)..(81): n is a, c, g, or t
gctagaggatcctccacgtcgaatatagggtgttctcgtgtgatgagggtaatgttgtaatgtggtggggtgagtgagccncattgtgttgtggtaatatgtagagggagtatacgggctgtgactagtatgttgggtcctgtagtaggagagtgata

SEQ ID NO: 638621 - DNA, 397 bp, Homo sapiens
acagatcgcttgcacggagatggagcagatggaggagcacagacgccagagtcacagcactggaacgcgacatagtgatacacgcaccatctgttgtctactatgaccgtgacatacatcaccatagaagaggaggagagttagcttcgacaggtggataatgctgcagaggcatagcggacgcatctgtctgtgagagaggaacagaactgtgatggacgcacgcatctgccagggatcggatcgtgagcggctgcctacatgtctcccgcgctccgtgtgcatagtgaattgcctgatcctatacgatggtctgcgaggtcaccatgagatagagaaccatagacgagctgttgagtgcatgatggtatccacacacactagggccgtgtctatc

SEQ ID NO: 638622 - DNA, 476 bp, Homo sapiens
tagacggatcccgggcagacaaatagatcgacattcccaaatcgatgtgtggtgcatgtagggctagtacatgttaatagttaacctctacaccctaataaatgttggccgtccatctcggaagagaatatgtcttgacaattacagttgagccgggtaaggcccaggacgggggtgtaggaaaggagctgtgcttggggtgggatgaatatgaataaccataggaagagttgatgatgaggtatacagatggagaaggtaaagaaggaagagaagtagtcggggaaggaaagtatgtaaggtgtgtcgagaggagatcagatgtcacataagggggtgtcgtatgttaggatacgccatcatgtgatgtgtatattttataggagacagaggtctcagttggtggccgaggcgggagtgcagtgatgcgatcagagctcagggcagtcgacaaccccccaggctcgggcgatcct

SEQ ID NO: 638623 - DNA, 1664 bp, Homo sapiens
ttgttgtacgtttgattgtcctctgttgtgtgttgcttctgtttgtacctcctcgtttcatcactatgtcgtggttgcatcttcttgttcgttttgtttctcttgtcttcatttgtgttgtcgtgttctcgggttggatatgttcactctgcattgtttgcttcgttctgtttctctcctggtatttctctgatgcagttgcgagtggggtgaccatttcggcctttatgtgtgtctgccccgtcctgcttgtctcagttccttctgttgtgtgaggctaatcaggtgttgttggtattcttcctttttatttctcttttgtccgccgccacgttgttcagtggtattcttgtttcgcggtccttgaatttcagtcgctttttcgtttgggggctcttgcatttggccacgtcttttggtcgcttcaccatgtgcctcggttttcgccttgtcgggcttttctgtgcccccacgtgtggtgtttccctctatcaccggtctcccactaagtttttgccccctttcctagtgtcttagtcctcgcatgcccctctgggcaatcgtgtcctgacatgctgcactgttgttctctctgcgcttgggatcacggtatgtgcaccctctgggtcttacgtttctgagcacatgcgtctgtaatgggtcccccctggtgtggctctcgcccctatccgctcgatgtcccctgccaccaaggtatccaacttccccgtgccaatttcccaaggcaggtgtggaccttcggggccctacgggggccgcctcggaagggaactaggatctataacgtaccgggcgaaccgatccaacggacggaaccacggccctcacaacgctgggtgcgaggacgcaccggccatggcctcaccaatgagtggaccgaatagagtgatgcatcttctaagatcattgaatgtgatatacgctccatgctccattggcgcgcccctcaagtttcccgttgctcatatgattgactgcttatatgaccttgtgtccagactcatccactcactctctgtatctactctagacgtgctctatgaggatgcatgtggatggaattgaacagtggggagacattcttgcccctgtgcgccagggtatctcgcactcaatgagagcggtgctgatgccctctgcaacatgtctgagagtgttgtgtctccttgtattttagaaattctaccttcttgatgcttataagaaatacaagctgaatcacataaatcgatactagactgagcagtcactggcctcctgttgaatggtaggcatcctttgctacgggcatggcagcgcccattggtggcattggaaggagaggtgctaaaagactatcgggttgctgtatgtctaggcctccacgctgcactggagagccaggcccaagcggtctgaggtgtgtgcactagggcagagggcaggagcggcatggtgtacaggcctggcttgggaactatcgaatcccgtgaccttgcctgcattccttgttagcatatccaccagccactagacttctttggaatcatatcggggatgggggtcatctttggggattatggactgcacatcaccgggatttgagtgtaagggagtgatgggagcatgccttggcagatggggcacaaagtgccctgcaggtg

SEQ ID NO: 638624 - DNA, 746 bp, Homo sapiens
  misc_feature (154)..(154): n is a, c, g, or t
  misc_feature (192)..(192): n is a, c, g, or t
  misc_feature (238)..(238): n is a, c, g, or t
  misc_feature (252)..(252): n is a, c, g, or t
  misc_feature (295)..(295): n is a, c, g, or t
  misc_feature (349)..(349): n is a, c, g, or t
  misc_feature (409)..(409): n is a, c, g, or t
  misc_feature (442)..(442): n is a, c, g, or t
ctaggctgaaggtcacagaagaaagtgaagccacatgaaagtcatttatattccaatctgtggtctgggttactttaagaccaacccaggagatgggggaaggaggcttggctctcaaccaggaaaaagtgtgagattatattgcctagatgtnacatgtttatacattgagaagggtaaaaagcagcatcntaggaagacaggctaagaccttgaagaggtagctatgtttttttcntttctttttttttngagagatggagtttccctctcgtcgcccagcctgcaatgcaanggcgcaatctcagctcactgcaacctccacctcccaggttcaagcgattctccngcctcagcttcctgagtagctgggattacaggcatgcaccaacatgcccggctaattttngtatttttagtagagacaaggtttcaccatatnggccgggctggtctcgaactcctgacctcatgatccgcccgcctcggcctcccaaagtgctgggattacaggcgtgagccaccgcatccagctcaacagtaataataaaatagaaaatgataactgtatgccagcatcactactcttgtgcattggatccattatgaagtaaagtgagggttacttgaacgtaaacactacaatacgtccactgttgatttgggtggtgtgggtagtgcagacagtcgtggaggggctggctaagcgatgatgccagttccagcagatatagtggcaccaggtc

SEQ ID NO: 638625 - DNA, 313 bp, Homo sapiens
  misc_feature (65)..(65): n is a, c, g, or t
  misc_feature (147)..(147): n is a, c, g, or t
  misc_feature (276)..(276): n is a, c, g, or t
tgaggctgtgtcacttcagggtcacctgcccaaccttagaggaggtgagggtgacctgaagtganactaagcgcgctgagcatggggacctggtaccctcctggctcttgatacccccctctgtcttgtgaaggcagggggaaggtngggtcctggagcagaccaccccgcctgccctcatggcccttctgacctgcactggggagccgtctcagtgtttgagccttttccctctttttggcttcccttggaaccttttgaggagccccagctacnccttcttctccaagttggggttcttgcaaatttccct

SEQ ID NO: 638626 - DNA, 599 bp, Homo sapiens
catctacagaaacggcttcatttgagctgacagcctctcttcgaacagagcaatggcttggaatgaggtagggaaatgtgagcagtatttatctggtagttcctagagcaggtatggcagttgtctttcctctcaaaaacattagtacacattcatttgccttgatgtttccctggcttggagtatttcttcttttatgctgtctaacaactgctctgaggaagaactataatacaagctttaaagagtctgttcagaatcattacaaataagttgtgttatttaaaattatagttcataagggagaaagatgaaaaatgttaccagattagagaagatttttcaaaaggatgtaaggaaagaggcagtgttaaacactgttaagaggacagtttatcagtattttttactaaactttaataaaacttttctatttgaatttctgctatgaatttttcttcagcatttgtcctcagtacaggtggttccttgaaacattgtttctaataaaactaaaacatcctgatattttatccattctatagagatcattgatggtacacagacataccgtggattatgtttgttgagtgaattgg

SEQ ID NO: 638627 - DNA, 344 bp, Homo sapiens
cccgggaatcgcacggagggtccagccgcaggaagaaacctcaggaggaagaaacctcagacagatcgccggcgaggcagcgcgggatcccaacctcaggcgtgcgcggacggtgtgcgggtgagtctccccaaaagtggagcccttgttatgacgagcacaggtccgcctgcgtgcccgtgggctgctctctcaccggtggctctcagtcgcggagagcagaacccggcagcttcaggggctgcctgcgggagggtgttccctgctgtacgtgtgtgttcgtcatgggtgtgtgtgtgtgtgtgttggagggggtgcgtctgtgtgtgtgtctgtgtgtgtgc

SEQ ID NO: 638628 - DNA, 161 bp, Homo sapiens
  misc_feature (18)..(18): n is a, c, g, or t
  misc_feature (30)..(30): n is a, c, g, or t
  misc_feature (51)..(51): n is a, c, g, or t
accccaactcttggaggncccaaaatgcanccaatgcctttgtgttttagntctaaattttaattgcacctgagaaaggtggtcacctaagcaatgagccacagcaaaaagtaaagaacaacaacaaaataaagctgttgttaaattttaaacaatattac

SEQ ID NO: 638629 - DNA, 285 bp, Homo sapiens
ttttgggggcttcatggtggtcttcactgaggttgtatcttgggtacggtgctgtcgtcccttggttgctgttggttgtagttggagggacagaaggaagagggtccctgctggtgggtaaggggcccttgattgcgatgtcccgtgtcagtgtctctgaaggggtgaagttctagaggccgggttccgaggggctgtaggatgaagcagagttcccaggaaaggaagttgttttggccacgtgagtgaaccagacctctaattgaaaccggatactgctcctgt

SEQ ID NO: 638630 - DNA, 264 bp, Homo sapiens
actctaaaaaaggtaaatacgacaaagagcctggcagccataacaatgaggtggcatgttatttccacaaaggcacttgacactgtttaaaccactgataaaggaaccaagatgacccaaatgatccaagaatgcctactactcccacccatgtctcatctgctcatcctgtcaacaggcatgagtatcttctcacctctctctccccattttcccagaaacatcatttaccccattaggcttgcagaaaacaaattcgcagaa

SEQ ID NO: 638631 - DNA, 370 bp, Homo sapiens
gaccccccgagtggtcctgctgaaaatcaattgaccatatacgggagagtttatttctgagttctctactttattccattggtccatgtgtctttccttattccaataccatgatgttagtgattattatagtttatgaagtaagttttgaaatcaggaagtgtgagtcctccaactttgttctttttaaaggttgtttagggccaggcgcagtggctcacgcctgtaatcccgatactttgggaggccgaggtgagtggatctcatgaggttaggagtttgacaccagtctggtcaacagtgagaacctgtctctattataaatatacaaattagccaggcgcagtgggtcacacctgtattctcagaa

SEQ ID NO: 638632 - DNA, 488 bp, Homo sapiens
cacacagttcagtactgtagttaagagtcattacagcctattttaatgacatttataatgccttagagaaatcaagaactaagtgtcgcctgataccaacattgtacgtgctgcattgcggttgcccatccgtggagagaatacgggactatccgtggattagcacgcatgtttagacctcgttgccctcttctggtgtctaaagagacggtccaccccaatacttgctaatgtgccgacgctgatactatacatctccctacttgccatcacagaccagactatccatctacctacctcacacggctccgacgtccggcagcacctaactgcgctagcatatcatcactatccccttcgcaactgatctataacgacctccccgggcaactgcgcctacaacggagaagttcaaatcgtagcgaaataatgcaccacaggtgtataacgcacagtagctaagacgcgcgcacttcgcactaactcat

SEQ ID NO: 638633 - DNA, 140 bp, Homo sapiens
cggccggattccaaacagtggctcatgctgtaattttaacactttgggaggccgaggtaggcaaatcacttgaggcagcagttgaggcagctggcaacatgggagaccatctatacaaaataataattactgagctgtgc

SEQ ID NO: 638634 - DNA, 1598 bp, Homo sapiens
  misc_feature (1)..(1): n is a, c, g, or t
  misc_feature (26)..(26): n is a, c, g, or t
nctgtgaggtctgggtgtcggtggtngattgtgttgtgtgggtggtcgcgtcggcgcgtgcgcggagttgggtgggctgtggtgtctgtgcgacacagtcggtgggtctggtgtgtcgcggtctgtgtttggttcgtgtgtgcttttgtgttggttgctgtgtcgtgcgccggttggctgagtctgtgtctgggtggtgtcgtggttggggcggacggtgcgaggagctgggttgctgttgtgtgttgtttggctattgtgtgtggagtgacgccgcttcgggtgtgtgtgttgtggtcttcttgtctgctctctttacgtgtcatgtgtgttttgtgttattgtactgtacacgtgtgagtcggtggtggttgcggtgggcgcgcggcggcgtgtgtgtgtggtgggtcggtgctcgtcgccccgagcgtgggttgtatttgtggtcccgcgcatccaagtatgttattagtatcgcccccccccgttggtgggtgttggtggagcacaccaacccaccggcgcgtgtgtttggtgggggcggccgcacacccgtcgtgggtggagtgcgccttcgtgtgggggtgttggcctccccccacactgtgggtgggtgcgtcgccagaatagtgttaccgcgcgccgtgtgtggtggttaattcgcgcccccgcccccgccccgctgttgtgttttttctaccgcgcggttgtcttctatatgggtggtatggggagcgccccccacggtgtgggggcgcggagatttttgtctccccccatgggggcccgcttttttgttggtcgctctcgtctccgtcgctcccacagtgtgagcaccacatcctgtgtgtggtgtgtgtgtgagagagtagagtttttagttccccgctcccgtttggttctccctactggggggcgacaaccgcctctctcgtgtgtgtggcgctcgcccccccacctttgtgtgtgtgtggggagcgcccctctctgtagtagatagagagcggcgcgcggtgtgcgcgcctccggtggatgcgctcacacccagagatgtgtgcgcgtgtctcgctctctatatatatatctctctcctcgcgccccctctctcgtgtggggccgccctctgtgtctctctctcctcgcggagagtagtgtgtgtcccgcccgcgcgggcgccccgcgcgcgagggagagatataccctcgctcccccgcgtgtagcaccctcttttggtggacccacccctcaagacagccaccccctctcttgggggttgtgtgggggtgtttccccgcgcccccacaggatctcccctctcgccccgagaggcgccccgcgtggcgcgcccgcgggggcgcccccggtgtgatacccccccgggggggcggggtctctctcccccccgccgggcccccccccccggcggggcggcaggtccttttctctcgcgcgagggggcccccccccccgccgggggcgagccccccccccccccccaattttctcccggcgcgcgcgcgcgtggggccccccccccccccccccccccccccccccccgggggggggggggccgaagagggggggggcccccgggga

SEQ ID NO: 638635 - DNA, 184 bp, Homo sapiens
gcccaaacccactccaccttaccaccagacaaccttaagccaaaccattttacccaaataaagtataggccgatagagattgaaacctcgcgcaatagatatagtaccgcacgggaaagatgaaaaaataattacccaggcattattttggcagggcttacccctatatacctctgcaatatgt

SEQ ID NO: 638636 - DNA, 1152 bp, Homo sapiens
  misc_feature (340)..(340): n is a, c, g, or t
ctaaagttcaggcatctctggcagcgaacacttgcaccatttacaggccatgctgagacaaagcagttgacagaaatgctacccagcatcttaaaccagcttggtgccggatagtctgactagtttaatggagactggccgaagctctgcccaaacaatctgtggatggaagagcaccacttgctactggacgatggatgatgatggatgaacgttccacgatcttgtggacgaattgttgcactagaggcttgcccaaggaatgaggcacaactgtagacttgagtcaacttctgaagatccatacctgcagaaggtttagcgtgggagcctgcctganttttaatagttaatgagctgctttgtttaacgacagacttgtctttgtttactggagtctgagtaatacactctacgactactctacatactttttagagccccaacgtccccttggacatctgcacggcgactttctcagtttattgggctttgagtaactatcgagatttccagttctcttggtcaggctcaggactttagaggccagatagggataggtccctggggaactccagaaggtttgggaaagagcacaacgattttagactacccagcttctattctgccctcaggtcagagaacagataaacacacatacctagatacccgaacacattgccaccccattgaacaagcttaaaggaaagattgacaagaccttcctatacccatagagagagaaccgagagggggcgcgggcgcctcttccaacagttggttaccttatcgcacactcgctgggtggctggggccccacaaaagggaattgatttgcgctgccgctgcacgcccaaagtcgtttggccttggggaagaacagagggcgacgcacccattgaaggccgcaaggcgcgaaggtgggaaaaggcacagcctgggcgtttccacgcgtgagcgtcccaacgggttgaattaattcgctttgtagacccccatgtccgagagagcccaaacgagttataaaggcggccggaggcctaatttgtccgcgactagggaaataccgcgcattttggctcaaccgggggcggggggccacaaccaaattatgcgatgttggcgcacacaagtatctcagccttggaaagg

SEQ ID NO: 638637 - DNA, 128 bp, Homo sapiens
aatagcgacgcaggatcaccacagtacacggctacaccatatctttaacccactgagtgaggcaaggatcaaacccacaacctcatggttcctagttggattcacttctgctacgccacgacaggaac

SEQ ID NO: 638638 - DNA, 1040 bp, Homo sapiens
tacagataggacatgcgtgggtactcgctgctctgggtagaccaaaggtgcctgccatcgctggtattcaagtgtttcctatcagtctgatgcacactacctgtgcactcttcctaactaacctactatcaaagatattgagcgctctgacgctctcgggtccacagcacggattctcccgatggatgtgagatagcgtcaaagcaaatccggtttcctctaacagtactgttagtatcattaacaccgtttcgcgtagacctcctccaggtaacaaccccgcagatactttgactgggaaatatcaaagaagtaatagagtccgggggcagtggtaattctggagtgcctaattagaatccccgcgtgatgttcggtgaacgcttacatattgtccagaagtcggaagtggtagactccgtgtgatgggtggaaggattgggtcgcgagcgcgcaatcgggtgtgtggtaagtacaagggctcgaagcaatttgacttcataacttccggttcttgataattttacccaatgctaggtatgggcacctacgggtccggtttctattggtgttctttacaataaaacattttttcttctggacaggggctgcgttgtcattttccccacgttggacaccactctaaggccactccccttctcttccttcaattaataaccccattgggtcctactagcaaactggccgtctccatctccatctttagaagagccagcagggcaccctccaggactttgtgaaacaggggggcagatgagtccgtgggaggggcatgatcaagggggatcaccgggcctcagaggaagttgcgccccgccggggcagggtggtcaaagggccacccggaacacgccggactctcccacacagatcggagtggagaacggatggggacatagcggcgaacgaaggtaaacacgatcaggggaacacggcggagaaacgggataggaagtcaccgaaagtgcccaagaaatgagcacgaacaccgaagcagaaaggagagagaacgaagaagc

SEQ ID NO: 638639 - DNA, 915 bp, Homo sapiens
  misc_feature (36)..(36): n is a, c, g, or t
  misc_feature (91)..(91): n is a, c, g, or t
  misc_feature (120)..(120): n is a, c, g, or t
  misc_feature (146)..(146): n is a, c, g, or t
  misc_feature (185)..(185): n is a, c, g, or t
  misc_feature (194)..(194): n is a, c, g, or t
  misc_feature (228)..(228): n is a, c, g, or t
  misc_feature (233)..(233): n is a, c, g, or t
  misc_feature (249)..(250): n is a, c, g, or t
  misc_feature (279)..(279): n is a, c, g, or t
  misc_feature (283)..(283): n is a, c, g, or t
  misc_feature (285)..(285): n is a, c, g, or t
  misc_feature (287)..(287): n is a, c, g, or t
  misc_feature (289)..(289): n is a, c, g, or t
  misc_feature (323)..(323): n is a, c, g, or t
  misc_feature (327)..(327): n is a, c, g, or t
  misc_feature (329)..(329): n is a, c, g, or t
  misc_feature (335)..(335): n is a, c, g, or t
  misc_feature (337)..(337): n is a, c, g, or t
  misc_feature (356)..(356): n is a, c, g, or t
  misc_feature (370)..(370): n is a, c, g, or t
  misc_feature (397)..(397): n is a, c, g, or t
  misc_feature (411)..(411): n is a, c, g, or t
  misc_feature (415)..(415): n is a, c, g, or t
  misc_feature (529)..(530): n is a, c, g, or t
  misc_feature (583)..(583): n is a, c, g, or t
  misc_feature (629)..(629): n is a, c, g, or t
  misc_feature (632)..(632): n is a, c, g, or t
  misc_feature (636)..(637): n is a, c, g, or t
  misc_feature (640)..(640): n is a, c, g, or t
  misc_feature (653)..(654): n is a, c, g, or t
  misc_feature (659)..(661): n is a, c, g, or t
  misc_feature (664)..(664): n is a, c, g, or t
  misc_feature (693)..(693): n is a, c, g, or t
  misc_feature (705)..(705): n is a, c, g, or t
  misc_feature (711)..(711): n is a, c, g, or t
  misc_feature (716)..(716): n is a, c, g, or t
  misc_feature (801)..(801): n is a, c, g, or t
  misc_feature (861)..(861): n is a, c, g, or t
aaaggaacaaaaataaacaatgacgtgtattccaanccaaacaatgagaaatctaatgcaactagactatcagttcaatctatttccaggncgctatcctcactgtgacacgtggcaganttacgcacagatgtcagcaccaagantataccattttactgggagtaatccaaattcctgggganaagcttcanggtccacagcaaaagaaatcatcccccagctggncagtnacacgaacaaaattgnngattaattcagcccccttatggattaagngggntngngnggggtttgtggtgaaatgagtgctggagccaatnactnanctcttnanattgcagaacttgatagangggtactctgcggnaaggtagatcatgcaaccattaatggnttcggtccctggantgcnatcatcataaatatgaaccatgatgacaatgattttttgtatctttatcaataatagatctaaaaacacttctccactggagaatactcaaaaaacctgcttgaattggggccnnttgtgaagctgctgccgcatctcttccattcgctgcttacggtactgctgaanaaaatctttaataatcttggtcctcattcattatggcaaactcctnaanagtnntcnaaaaaaacccccnnccccnnnccncctttttgtttttgttgctcctcctcttnatccagatgggncctgcnagtcnttgacagcttcttgatcagcctttccatctcccggcactgctcctccctctgctctgtctccaactgcttgaagcggcgccagtnattgatcacaccttttgggcctgtgttaactgagatgccttcgcctgccagctcagcctntgcaggcacagaactgctggctggggcacatctgcctcggtccttgtctcgtgg

SEQ ID NO: 638640 - DNA, 458 bp, Homo sapiens
ggacggtcgtgcggcaccagggcccagcccagagatgcccagcaagatgggtgatccggggtagtagagcaaataacgatgtcagtatatctcagatgatgcgtgatgttagcattcaacaaaccaacatggtcccccctcatgtgcaggccatgcaggaaaacagtgcctcgggaaaccatttctcaggccaggggatgtcttacgaggggcacctttgaggggcgctcccaagggaaatcagatgtcctggggtcaaaatccaggcttcccagtcaatagggatgtcacgctaacgagcccatggtgggtcaacttatggcggagtgacatatcggcaggccattggggggtaaacaataagcaaaataatagcaaggcaaataaagcgaagaaaaagaacgccctgtggaagaagaaaaatagtcggcaagatctaaacagccaagatactcgcc

SEQ ID NO: 638641 - DNA, 556 bp, Homo sapiens
gctgaaaagccatctttgcattgtacctcagtccgcctccttgcccgccgcgagtcgcctccgccgcgcgcctcctccgccgcgcgcggagctccggcagctgttatcgccagagtcccatgaacatctctgcttttcatttttaagtccccatgcatctgtgagtcaccaggcagtgtcacccgaccaatgatcagactgctatgcgcgagtagacacgcaggtcttccggaaagatcaccgacgcgacaggcacttagaactgaccacagcaagcgagagggacactggttgatgcgcacaagcacgggcactgacacacacttagggcacaccgactgaagaccggacgacgcccccttgagcccttaagatagtctgtgagcaacaacgtttggtcgttacaaacctagcaaagtgctggaacaaaaccaacttttgtgatggtggaacgagggccagagggagaacaggaaggatcaattatgatacgccaaaactcagtaacggaccggctggcttaaccaggaagcgcggtaaacaaccgtcaaacaag

SEQ ID NO: 638642 - DNA, 1793 bp, Homo sapiens
  misc_feature (2)..(2): n is a, c, g, or t
tnttccagaagcgagatgctgttccaaagcggagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgagcactgtattcctttgcttcatcgt

SEQ ID NO: 638643 - DNA, 454 bp, Homo sapiens
gtagctgatgcattgaaaccatgtgcatgtttgaagatgggcagaggatggtggtgcaggaagaaccagggtgatgatttcttcattatttgagaggggtcagctgctgtgctacaaggtcggtcagaaaatgaagagttggtggaagtggaaagatgggggccttctgattatttgggttgaacttgcactactgatgaatcgtcctcgtgctgccacagttgtggctcgtgcccccttgaattgcgtaaggctgaaccgacctagattggaccgtgtccccagtttgctcagaggtctgagcaagcgggaaagagaaacgcaggcaggggcactgaccgcacagtgagcctgggtctggctaagatgaccaaatgtgaaaagtgagaagagcatgatggggatgctgagcttctagtccctgaggtactagacctggcagcatgtggaccct

SEQ ID NO: 638644 - DNA, 1774 bp, Homo sapiens
  misc_feature (2)..(2): n is a, c, g, or t
  misc_feature (1696)..(1697): n is a, c, g, or t
  misc_feature (1704)..(1704): n is a, c, g, or t
  misc_feature (1737)..(1737): n is a, c, g, or t
  misc_feature (1740)..(1740): n is a, c, g, or t
  misc_feature (1749)..(1749): n is a, c, g, or t
tnttccagaagcgagatgctgttccaaagcggagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgatgnnttctggnaaggagcggtcgtccactgttgacctcgtagtntgnacatgcggntttcctgttcttcctgactcgccct

SEQ ID NO: 638645 - DNA, 102 bp, Homo sapiens
tggcggaagtaactgtaccagaagatcatgtttggcaagaggcgaaaaatccgagaggccaacaggctggcggaaaagcggaaagcccacgatagcggtgag

SEQ ID NO: 638646 - DNA, 1138 bp, Homo sapiens
  misc_feature (2)..(2): n is a, c, g, or t
tnttccagaagcgagatgctgttccaaagcggagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggttattggcatggggatcctcagagg

SEQ ID NO: 638647 - DNA, 989 bp, Homo sapiens
gcggaagatttcggatggaaaagtcacgaggattgacagctgacttgcagaattacatagcataaattaggaacctccacaacatttcatgtcaattcgatctacttcgcccctctttgttgtctctgaggtgcagttgtttccttttttatattgctggtcagcgtatccatcttctccatattcgtgatcgtgttggagctgcctcgaaagactattttgacccgcagcccccttcttttcagggagtcgcttggtatccagtaccacaatcatctatgacattcgtggccacaacccctcggatgttactatcctccctcgcgcacatattattgtctctccccacgatgtactctgtacatgtagtgggctgtaactaatctttccccctgtctgatgctgcttgggtcgttccgagtctcaaatgcgttcgaagacccccttgcggtaggcactgatagccacgccgcgtgtagcggccttgttaggttaacagagtgcaaccggaggttgattttgccccgaacaccagtctcgtttcaaccgaacggcttgcgtccaatacagggtgggtgagcatgggccaagtgttccacctaggccctcactagtctagagtcagccacaagccgggggccccaaggggttattgccctgttctgcaattcctgccccggagaagccttgaacaatgaatgaggggcccacaacggaacttttcgaggcgccatccagtcgctttggaacttgacttgttgtgcccactcgaacaaggaagcattcgacgcgttttttaagctccggatgcaagttaccaccaaagcatatggcattgattaagaaaaaggcccatagaaacgcaacagtttgggcctctacgccgacgcgatgtgccccaaagccaggggcctcccaaagtttcctttggtgctaagaaaaacaacgccgcaaacgccaaagtggaaactacgcccgggcaggcaaat

SEQ ID NO: 638648 - DNA, 430 bp, Homo sapiens
tctagcacggatcccctatcatttaggcaatagagaagaggcacaagatggttgacaggctactttaagctgtgcatttagtactgtaatatttgtgtcactttttcacaacacggtggttatattcttgtataatcttactaatcctataataaaagacagtgctatatctacaaattctatagtacattcatcttttagtttcataaatatatgcaattctcatcataaagtcgcgactaatacatttgcacgttttcatagactaacataatacatctaacttatggaagtctcctgttattgtgttatttttgtctacatctgacattatcttcattaattttcgatgaagccacaaatgtactgtaacttttggaatctatccgagttttatagaataaatgatcaggagcaattctataaaact

SEQ ID NO: 638649 - DNA, 162 bp, Homo sapiens
ggctcggacccctttccacaggatacgcagtttgtaagtcatggggacaagaggtattattgagggaacatatcaaggtatgaggaaaccagcacatctcagtgtgctcagtagcttccactgactccattctccctagagctagacctgtgcttcccccat

SEQ ID NO: 638650 - DNA, 1204 bp, Homo sapiens
ggaactgtccttcccagcactgtccagctttaacgaagccatgcactcagcactcagggcagctggaggagcaaggctatggaagagctcaaggagatcatacagccaaggcaccacgactggccttgcagcctctcctgagatgaccgagcagccagactatgacctggagacctttgctgaaccaacagcgcgcaactctgcctctgagcccagccacacgccacagccactctctcctcacgccccctgcgcacgactgctcactcacaggccccttgccgccctgggcccacctgccccgccctgcccacacgacggccacgcgccctaagccccagcaccacacactaccgccacgccaacgcacaaccgcgcccccccacgctgcaccgcaccctgccaaccactacacacacactcctgcctctctgcgctcttctggacccaaccccccaggcccccttccctctccccctgcgcccccttcacccccacgcacgcacaccccttctgcgcgttacccccttgcgcttcgcgcgctcctacgggcccacgcggcctcccttgcacgccctgcgcgcaccacgcgcctctcctgcgctacacatctgccccacacgctactgcgcgcgcgccatctccctgcgtgccccccacgcggcccccgccctgcgcgcgcacgcgcgcgcgctccacggcatgcctgcaccacttgcgcgcaacccaccgtcccctctctctccctggctattcctccttcccggccctctcgctcctgcccccctctccaacccgcaacgcacgcgcacagcgcggcacgccctccctctcacgcctctcacccccccttctcctctcggcttggcctcttgccccccgttcccctctcttcccatcttccaccccgcgccgcggccccatctgggtctgccttccaagtcccactaacccacggcccctttacttccttccccgacccacacgaccaacctccccctgggcacccccttggcgccgtcttgccgcgccccctggcggcccttgatcctttaacccttgggcaccgcgcaccgccctttcccccttggggcccggccttctcgcctccccctgtgggcccttccctatgggcgcggccccacacacgcgcgcacccggcgcacggccccctctcctctagcgcctacccagcggccctatg

SEQ ID NO: 638651 - DNA, 456 bp, Homo sapiens
  misc_feature (268)..(268): n is a, c, g, or t
agaccacacacgcgcgttccgctgtgaacgagacctataacgcgacacacacgaggaacacaatgcgcttcttcgcacaaaggagtttttccttctacttccgctcttcccacgagaagaaggaagataagaggggaaaacacacacacagagaagaaaacccctcggtggcacagagagccccacaatttcctatactttcacatgagaattgtgaaaatgcccacggagtgctatataaatcacccccggtgtctttaagccacancaccacaacggtgaagttttgtgttgttggctgctccacactgtgcctttctgccacgcctacacacaggaggggaaaagcaaagggttaacacagaaggatagttcctttcaggaggaaacagccacttaaagcactttgagtcaagaagagtggggaaccatttccaataaaccccattttggata

SEQ ID NO: 638652 - DNA, 981 bp, Homo sapiens
ccgcttgccctgtgttccacatgggagccgctttccccagggcgcttttgccagtccctctgggttctcctgcgggccttccggtgttgttcgctgagtccgtgtgctgcccgacgctcgtagtatccccgggtctttcagctattggggcgctataaagtttctggggaagaataaatttctgtgagagcgtctgtgcggtggaggggaacccctcttgtcacaatcggcgtgtggtggggcggccccccctggccctcgtgacctatcagggtggctcagcatcggccttgcaagtctgtcgatctgggccccgttccgacatggtatttcccgggagcattccttgtgttggtcgcctccccccccaccaaggggtgctcccgggtcgacaatgtcttgcccgctttttgtcgaagatgatttaagcgaccgctcatggacgccccatggatggttgacatggtgtaaacacgccacgttcactagtggtgtcgcccgatcgctgtggcgatgcacgtggtgtcaccccaatccccttgtgtgagcgaccctacaatttttcctccttaagaatttttcctttcccaggggagaaattagtcttgaaaacctctttcctcgtttaccacgctggttgaaagcaacgctaatctccatatggcccctcctgagtgagctgaagcacacctgaaattagtccgatgtttttttgtttttctccccatcttccttttgtccatacagtcttcttacaaataactccgctgcccttcttcgagctatataaaaccccaatcacctgcagaatcaccacccacaaacaatagcttcatgtgctatatattaattcgaacacaataataggagaaacattcatgatgttattttttgtggagaaaaatacccatttttttattttttttccaatcaaaaaaaaaagggaacttttaacaaaacaaaaaaaaccaaacaaaaaaa

SEQ ID NO: 638653 - DNA, 1281 bp, Homo sapiens
  misc_feature (338)..(338): n is a, c, g, or t
  misc_feature (444)..(444): n is a, c, g, or t
  misc_feature (507)..(507): n is a, c, g, or t
  misc_feature (563)..(563): n is a, c, g, or t
  misc_feature (597)..(597): n is a, c, g, or t
  misc_feature (620)..(621): n is a, c, g, or t
  misc_feature (623)..(623): n is a, c, g, or t
  misc_feature (653)..(653): n is a, c, g, or t
  misc_feature (656)..(656): n is a, c, g, or t
  misc_feature (658)..(659): n is a, c, g, or t
  misc_feature (685)..(685): n is a, c, g, or t
  misc_feature (713)..(713): n is a, c, g, or t
  misc_feature (720)..(720): n is a, c, g, or t
  misc_feature (731)..(731): n is a, c, g, or t
  misc_feature (734)..(734): n is a, c, g, or t
gaggcgtgaggcgggcctgaagcggcagcgggcggcttcgtccggcgagagctaggccgaggacccgctgccgtgctccccggcacctcacctgcgttcttcacccggactcccgcggcgccgcggccgcggcgtggggtaagggcgggcggtggtctcctccaaggctgcgcgctcggagccggcctgctgggcttgggcggggcgcaggggtccggggccgcctacccggctccagtcctccccctgtgggacctggcgacggcggcggtagggaagaggggagcgtgcgcccggtccggggccgggggcgggtggggaggggggagggcggcggncgggctggggctcgggatccgcatcgggatcgggccgccatggacgacaaggcgttcaccaaggagctggaccagtgggtcgagcagctgaacgagtgtaagcagntgaacgagaaccaagtgcggacgctgtgcgagaaggcaaaggaaattttaacaaaagaatcanatgtgcaagaggttcgttgccctgttactgtctgtggagatgtgcatggtcaattncatgatcttatggaactctttagaattggtgganaatcaccggatacaaactacttnntncatgggtgactatgtagacagaggatattnatncnngtggagactgtgactcttcttgtagncattaaaggtgcgttatccagaaagcanttacaantattgagaggnaantcacgaaagccgacaaattaccccaagctactactggcttccatgactgaactgtctgccgacaagctactgggcaatgccaacgctttcggaacctattttacagatctctttgattatcttccacttacagctttagtagatggaccacgatattctgcctccatggtggcctctctccatccatagacacactggatcatataacgagcctggatcgtctacaggacagtcccaccatgcaggggcccactgtgtgatctgtcctcggtcagatcccgcatcgatcgtgcgtgcctcgccgtatttccccccgtgctgctggctcccttctcggccccacctctcctgacctttaccctgccctggtctcaccactggcttcctcgtgcccacccagcttgtactgcccggatccccctgggccgtcctgcatcccccagctcggcaccccctcccgctgcccccacttcctggtaccgctgcgcgcaccccgctgcatccgtgcctcgctgcccttcccactcgccttctgcagttggcccga

SEQ ID NO: 638654 - DNA, 1534 bp, Homo sapiens
agcggctttccccggcgattcctgcggacccagctgtggcgacgccaggagaccccaagctgcatcgccgagtggaagcaactagaactccaggctgtgaaagccacaggtgggggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacggtgcgcccgcgggcccagcttctctctgcgctgctccccgttaaattccctggggagacggaagaaaaggcaaaggaagtcggttctccaggggccagaagtgttgagcctaattagtcttcagacttctcaatgaggaatcgcttatcagtttcttatctgggagagttgaggatggagggacagaaggcacccaggatttgcacgggggggattcagggagagagggtgatgagggacggggtgggccttccagtcttggcccagtccccatcttgcacacattgttggcttcctcttagagccgttcgcccccctggggaggggagacccatagtgacctctcctgacacccgccgaccctgaccagtgttgccgggttcttcaaaggccacgctctgactgctggtctgtgtcacctgcaccccccagccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccaggtgaggcgtctgaccctgctgccagccatatctcagaaacagtgcagaatacacagtatcaatcccagacaccatcagcgattccaggtttccagcccctgggccccaaggaacctttggtttacagtgtgtgacgcagattgtctctgggccgacccaggctcctatgcctgtttggcacacacagacactgagctggttatggaggggccagcgagatgactcatggaggcctcaggagttcaagaccagcccgaccaaaatggtgaaaccccgtctccactaaaaatacaaaaattaggctgggtgcggtggctcaagcctgtaatcccagcactttgggaggccgaggcaggcggatcgcaaggtcaggagatggagaccatcctggctaacagggtgaaaccccgtctctactaaaaatacaaaaaattagccaggtgtggtggcgggtgcctgtagtcccagctacctgggaggctgaggcaggagaatggcgtgaacccgggaggcggagcttgcagtgagccgagactgtgccactgccctccagcctgggcgacagagcgagactccatctc

SEQ ID NO: 638655 - DNA, 2907 bp, Homo sapiens
  misc_feature (1744)..(1744): n is a, c, g, or t
agcggctttccccggcgattcctgcggacccagctgtggcgacgccaggagaccccaagctgcatcgccgagtggaagcaactagaactccaggctgtgaaagccacaggtgggggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacgccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggcagctttggacggacagccgtgaacgctcagtcgggggtgtgcaccccggcggggggcctggtgacgggagtgctggtgctgctgtctctggactacctgacctcactgttctactacatccccaagtctgccctggctgccgtcatcatcatggccgtggccccgctgttcgacaccaagatcttcaggacgctctggcgtgttaagaggctggacctgctgcccctgtgcgtgaccttcctgctgtgcttctgggaggtgcagtacggcatcctggccggggccctggtgtctctgctcatgctcctgcactctgcagccaggcctgagaccaaggtgtcagaggggccggttctggtcctgcagccggncagcggctgtccttccctgccatggaggctctgcgggaggagatcctaagccgggccctggaagtgtccccgccacgctgcctggtcctggagtgcacccatgtctgcagcatcgactacactgtggtgctgggactcggcgagctcctccaggacttccagaagcagggcgtcgccctggcctttgtgggcctgcaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataatggggccacccgtgggcatccacagtttgcagggtgttccggaaggttcttgtcactgtgattggatgctggatgccgcctgatagacatgctggcctggctgagaaacccctgagcaggtaacccagggaagagaaggaagccaggcctggaggtccacggcagtgggagtggggctcactggcttcctgtgggatgactggaaaatgacctcgctgctgttccctggcatgaccctctttggaagagtggtttggagagagccttctagaatgacagactgtgcgaggaagcaggggcaggggtttccagcccgggctgtgcgaggcatcctggggctggcagcaccttcccggctcaccagtgccacctgcgggggagggacggggcaggcaggagtctgggaggcgggtccgctcctcttgtctgcggcatctgtgctctccgagagaaaaccaaggtgtgtcaaatgacgtcaagtctctatttaaaaataattttgtgttttctaaatggaaaaagtgatagctttggtgattttgtaaaagtcataaatgcttattgtaaaaaatacaggaaaccacccctcaccctgtccacttgggtgatcattccagacccctccccaaacatgcatatgtacctgtccgtcagtgtgtggatgtatgtttacagttctacataaatgggatcattttatacatggtgctctggaacccacatttttcatgcagtcatttgcagtgaattatttattgtgataataaatagcattagaatacaagatttttaaaaaaaaa

SEQ ID NO: 638656 - DNA, 3339 bp, Homo sapiens
  misc_feature (2176)..(2176): n is a, c, g, or t
agcggctttccccggcgattcctgcggacccagctgtggcgacgccaggagaccccaagctgcatcgccgagtggaagcaactagaactccaggctgtgaaagccacaggtgggggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacggtgcgcccgcgggcccagcttctctctgcgctgctccccgttaaattccctggggagacggaagaaaaggcaaaggaagtcggttctccaggggccagaagtgttgagcctaattagtcttcagacttctcaatgaggaatcgcttatcagtttcttatctgggagagttgaggatggagggacagaaggcacccaggatttgcacgggggggattcagggagagagggtgatgagggacggggtgggccttccagtcttggcccagtccccatcttgcacacattgttggcttcctcttagagccgttcgcccccctggggaggggagacccatagtgacctctcctgacacccgccgaccctgaccagtgttgccgggttcttcaaaggccacgctctgactgctggtctgtgtcacctgcaccccccagccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggcagctttggacggacagccgtgaacgctcagtcgggggtgtgcaccccggcggggggcctggtgacgggagtgctggtgctgctgtctctggactacctgacctcactgttctactacatccccaagtctgccctggctgccgtcatcatcatggccgtggccccgctgttcgacaccaagatcttcaggacgctctggcgtgttaagaggctggacctgctgcccctgtgcgtgaccttcctgctgtgcttctgggaggtgcagtacggcatcctggccggggccctggtgtctctgctcatgctcctgcactctgcagccaggcctgagaccaaggtgtcagaggggccggttctggtcctgcagccggncagcggctgtccttccctgccatggaggctctgcgggaggagatcctaagccgggccctggaagtgtccccgccacgctgcctggtcctggagtgcacccatgtctgcagcatcgactacactgtggtgctgggactcggcgagctcctccaggacttccagaagcagggcgtcgccctggcctttgtgggcctgcaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataatggggccacccgtgggcatccacagtttgcagggtgttccggaaggttcttgtcactgtgattggatgctggatgccgcctgatagacatgctggcctggctgagaaacccctgagcaggtaacccagggaagagaaggaagccaggcctggaggtccacggcagtgggagtggggctcactggcttcctgtgggatgactggaaaatgacctcgctgctgttccctggcatgaccctctttggaagagtggtttggagagagccttctagaatgacagactgtgcgaggaagcaggggcaggggtttccagcccgggctgtgcgaggcatcctggggctggcagcaccttcccggctcaccagtgccacctgcgggggagggacggggcaggcaggagtctgggaggcgggtccgctcctcttgtctgcggcatctgtgctctccgagagaaaaccaaggtgtgtcaaatgacgtcaagtctctatttaaaaataattttgtgttttctaaatggaaaaagtgatagctttggtgattttgtaaaagtcataaatgcttattgtaaaaaatacaggaaaccacccctcaccctgtccacttgggtgatcattccagacccctccccaaacatgcatatgtacctgtccgtcagtgtgtggatgtatgtttacagttctacataaatgggatcattttatacatggtgctctggaacccacatttttcatgcagtcatttgcagtgaattatttattgtgataataaatagcattagaatacaagatttttaaaaaaaaa

SEQ ID NO: 638657 - DNA, 2470 bp, Homo sapiens
  misc_feature (1307)..(1307): n is a, c, g, or t
agcggctttccccggcgattcctgcggacccagctgtggcgacgccaggagaccccaagctgcatcgccgagtgggccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccaggcttcacctctgctgctgccgtcaccatcggctttggacagatcaagaacctgctgggactacagaacatccccaggccgttcttcctgcaggtgtaccacaccttcctcaggattgcagagaccagagtgcagagtgaggactgtggcccggtgggggcgtctcctgcctctgggatgtctgccccagtaacctggaggcagccgcgctaccccacactcgccgggagcagggtctcggacgcacctctccttctctcctagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggcagctttggacggacagccgtgaacgctcagtcgggggtgtgcaccccggcggggggcctggtgacgggagtgctggtgctgctgtctctggactacctgacctcactgttctactacatccccaagtctgccctggctgccgtcatcatcatggccgtggccccgctgttcgacaccaagatcttcaggacgctctggcgtgttaagaggctggacctgctgcccctgtgcgtgaccttcctgctgtgcttctgggaggtgcagtacggcatcctggccggggccctggtgtctctgctcatgctcctgcactctgcagccaggcctgagaccaaggtgtcagaggggccggttctggtcctgcagccggncagcggctgtccttccctgccatggaggctctgcgggaggagatcctaagccgggccctggaagtgtccccgccacgctgcctggtcctggagtgcacccatgtctgcagcatcgactacactgtggtgctgggactcggcgagctcctccaggacttccagaagcagggcgtcgccctggcctttgtgggcctgcaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataatggggccacccgtgggcatccacagtttgcagggtgttccggaaggttcttgtcactgtgattggatgctggatgccgcctgatagacatgctggcctggctgagaaacccctgagcaggtaacccagggaagagaaggaagccaggcctggaggtccacggcagtgggagtggggctcactggcttcctgtgggatgactggaaaatgacctcgctgctgttccctggcatgaccctctttggaagagtggtttggagagagccttctagaatgacagactgtgcgaggaagcaggggcaggggtttccagcccgggctgtgcgaggcatcctggggctggcagcaccttcccggctcaccagtgccacctgcgggggagggacggggcaggcaggagtctgggaggcgggtccgctcctcttgtctgcggcatctgtgctctccgagagaaaaccaaggtgtgtcaaatgacgtcaagtctctatttaaaaataattttgtgttttctaaatggaaaaagtgatagctttggtgattttgtaaaagtcataaatgcttattgtaaaaaatacaggaaaccacccctcaccctgtccacttgggtgatcattccagacccctccccaaacatgcatatgtacctgtccgtcagtgtgtggatgtatgtttacagttctacataaatgggatcattttatacatggtgctctggaacccacatttttcatgcagtcatttgcagtgaattatttattgtgataataaatagcattagaatacaagatttttaaaaaaaaa

SEQ ID NO: 638658 - DNA, 239 bp, Homo sapiens
ttttttttttaaaaaaaaaaaaaaaaaacaaagaaaattttctccccccattccctcggcccaaatttgggaattaattttttttttgaaaaaggtctaatgaaaagggaattggttcccccaaattttgcttttttttcccccccttgggggaacccgtttaaaatgggcccccccctaaaatcccggggaaagtttaacccgggttgcccggaaaaaaatggggattttttccagga

SEQ ID NO: 638659 - DNA, 767 bp, Homo sapiens
tgtagagctgggtgttactcggccgagggcgagctgcttgttgatgctggcagtgagaaagaggaggacgcgctgacctgaatgcagccgcgcccgccctgttgcccctgtgggcctggagagcgacttgagcaaggtcctgtgcacaatgctccgcatgttcctccagagtgctggcccacactgcatgtcgctgcgtggagaagtggctacatcaaatgaccagtgtgttctggcttgctgctgctgtgcctgctgctgtgtgagctgctgagatggagcctggggtgccactgcttcgtgcagcagttgcatccgctgccgtcgatgtgcccgcgatgagcgccttgaccttggattgactgggctgcttgggagtgactgtccactgttatcagcctggagccctgaagctcttctttcgggagctgccctgagcccctcttccccttctacgcacttcctgccagttcattgcggccatcaagtttgcgggaccatggccctggcgcagccgctgtgtgcgtgacttgggttgcgctcgcttgcccgctcccaaccactgacactctgcgtgatgctcttccagcacctctgcctgggtgatcgagcacgggctgagcagaaccgcatgtcggtgcagagcctgttggccattgtgtcgggcccacgctgctgcggcccgtggtggcagagaccatgcagtgcccatgaccatggtgttccagaacaggttgtggagctcatcctgcagcagtgcgcggact

SEQ ID NO: 638660 - DNA, 524 bp, Homo sapiens
  misc_feature (53)..(53): n is a, c, g, or t
  misc_feature (56)..(56): n is a, c, g, or t
  misc_feature (120)..(120): n is a, c, g, or t
  misc_feature (142)..(142): n is a, c, g, or t
  misc_feature (244)..(244): n is a, c, g, or t
  misc_feature (382)..(382): n is a, c, g, or t
  misc_feature (482)..(482): n is a, c, g, or t
gttcaaagaaaaaaagttgccagcagataatcggcgagcattgtctgggacanttngagtacttggagggaaccggttatttctctcaaaggggctggttataacaagggctcatctttnctaggactctgaagggaagaanggtcagggatctaggatattttatttctagatgaaaaggaaagggtctatgaagaagtagtttcttaggaatcagatggaatgtggaggtagaccacggtcngaaaagtttcaaactggaacaggttcatttggtgtagctagaggactcggctccggtgacacctctaaaccttctcgggctctttatccaggcggccggggtagagcagaaatctcagaacacatccttggtcttttnccaggaatcatttagctcatgcaaggacgggtgggcaagatgggttatataaggatgatggatggactaagggacgattaagtcttagcaaggaaacacngccttagcttaagagtggtccggtcccattttaactctctcc

SEQ ID NO: 638661 - DNA, 1381 bp, Homo sapiens
agcggctttccccggcgattcctgcggacccagctgtggcgacgccaggagaccccaagctgcatcgccgagtggaagcaactagaactccaggctgtgaaagccacaggtgggggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacgccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggtgggcggagccgggaggcaggatggcgtggctgaggctgcagtggcccctggcctggctcctaccctgatgtatctgctgggtgccagggggtctgaggtcagttaggacagctgagtcctcaggaacgacatctcagttatcaaagaatcccaggttgatcaactcagcctggtctccat

SEQ ID NO: 638662 - DNA, 208 bp, Homo sapiens
atgctctgcaaggagctaaacccatactggcactgttgcccccgtgttgagcgacagtcaaggccaagcagctcaccccatggatcctggaagccaccagaatgtggcccagttgtcgctggcagagagccagctgcgcttcatccaggcctgacagacccatgcacgacttcggcatctcctatgtcatggtcaggatcaagggccg

SEQ ID NO: 638663 - DNA, 393 bp, Homo sapiens
  misc_feature (25)..(25): n is a, c, g, or t
ctttggtataatcactgagcatatnatacccaatcccagatttgggaatatctgatcatttgaaagttttttgtaatacacaccaatatattcggtgccttcaaaaccactgtatgggccaggtgtgctggtacatgcctgtgatcctagcacatgggaggtggaggtaccaggattaggaattcaaggccagcctcgatgacataatgcctccacgacatgagcccctctaacaaaatatgtaatgtttaggtcaataaatcatattgtaacataatatctagtaattcattctatagttgactggtttgaaacttaacatttttcagaatcccttagatattattttgaaccacatattctcatgttaatgtactagtagaagaattaaat

SEQ ID NO: 638664 - DNA, 213 bp, Homo sapiens
cctcaaagaaacagataattaattacatggtagtatctacactatactgatatgccaggagggaagccatcaccagccctctattattgctgctcctacgtcttgaatccaaagcagctatcctgttctcatgacactaacattgggtttggatgacctgaagtgtttggtagacacgcatgtctaaactaatacaggcttgtgcagaatgtg

SEQ ID NO: 638665 - DNA, 443 bp, Homo sapiens
gagagatctagaggaatatgctaatcaatttatgtggtaatataccactgattacagacacggtcctctgacacttttaggcagttacactaagagataatctttctatgatagggagctgctgtacctgagcaagcccaactgtatgctttttgaaagagagacttcagcttaaacatttatcacttctcaccactctgacacatagagactgctcacaatatgctgcttatggggagaagaaatcaacgctcatcaatctgataaagttagctcagaacgagcctactgctgatctggaggatgtttagccactagcagaagatattactaacatgctctccaaaggctgatgagtatgcctctgaagattgcatgcgcgagctgcctgaacacacagtataactctgtgacaatttatccacatagaatactaagtttgg

SEQ ID NO: 638666 - DNA, 507 bp, Homo sapiens
  misc_feature (144)..(144): n is a, c, g, or t
gcagtgggttcagtcaatttctgtcatgcaataacattcatgacattagcagggatattggcttcataaggagttagaactggctttggacagttgtgacctctagctgtaatttccgtgcttctgctgtatgtctccgcatcntgtactgtgcgcctagccgtatcagcgtgctcttgatatgtattcttctcaagtttagtcagctcatcaagatttgatatcgtgtgagctaatttctcctcagggtttccaaacttctttccagctaagggccctgtccttcttcctacaattggaggtgcgcctatccctaggttgcgacaggggtatcggtcactcgcataatccgacatggcgtcaatgattgcggttgtcggggatccatgtatatagaaaagcgtgcgtcaagtctctgcaaatggcctagatgtcgccgaagccttgagggggcgacatcgtattatggaccaagatgacaccagccgatgctgcacgactacagac

SEQ ID NO: 638667 - DNA, 764 bp, Homo sapiens
ggcatgtgaaatcaagcttaaaaagtttgagaaaattttactgcgctgtgtgctaatggttaaagaagtctggtatctagtgataaatatacccagtttttttaaaagagatgctgttgtgcctatatcatgaagtacattaatttctcatgtagaaaaaaatagctctaaagattgtgtttcaacctaattggtaacctgagtttatatctggcatgaagttcattatggtgatagcacatatgtgaattcaagtacatttggagacagtattctaccattcagtaagtttggttaagtgatttgtaacacttctcagtgtattgtaatttcaaatggtttttataataggtgtatgctgctttgttaggacagatgtgttttgaatgtaccattataagaagaattctatgtatcttaaatatgatcttctgaaaattttatgttccgtaagtacttctgtggccgttgagtatttttaaaaaggctcaactgtaagcctcttagccagtgtggatacaagtattggggggtcacctagccagttgaaatgcaagaaagcacgtagtgacacagctttcccttcagagagccattggccgaaacatttctcaaacaggaaatcgttcttttactaatgtggacctatagatatccgtatatagtgtgtagactacctagtcaagaaatcttgatggcaggtacttggatctaggctggaatttcattcgaccaagtggccacagttaaatgcctttggaacg

SEQ ID NO: 638668 - DNA, 261 bp, Homo sapiens
gcccccccgggggggggggggggggttttttttttacaccccccccttccccccggggggcccccccttccccggggggccattttttaccccaaaaggggcctggggggggtttgtttggtttgggggttaaaggggggggggggggggggcccccccccgggggggggggggtccctccccttttccccggggggggggttttttgggggggggggccgggggggggcctttgttttaaaaaaaaaaggccctttttta

SEQ ID NO: 638669 - DNA, 251 bp, Homo sapiens
ccataaatagtgcttaccaaaaatgccaaagtgccgatctctgtcgtcgatcacaccatcgttgggtagtcccttagagttcatcgtggctatcagttggtgtcagtgcaattctcaagtcccaaataagctcttcgtctgacacggacgttattcaaaaaggagcacaaaagagcaagctttggggcatactgacaaacacttcactggttagaagagaataattgtaacaatcaaataaaattgaggct

SEQ ID NO: 638670 - DNA, 786 bp, Homo sapiens
tcttatatcttattctcccctccccccctttcaccattcccctcggaaggcgctataccccgggcaggggacagaggccggtctcctcaccccaccagcacacatcaccgaagacaacagaagaaaaaatgacagaaaaggaaagacacaaaaacaacaaacacgagaaaatgaacaagaaaagataaaaaaataaagagagacaaaacaacacaaacaacgacacacaacgcaaagaaaagaacaaaaacacaaaacgaacaacgaaaaaaacagaagagaaaaacacaggaaagaaaagaaaaaaaaaaaagagaaaaaaaaagaagagaaaagaaaaaaggaagagaaaaacagcgatacaacacaagacaacacaaaagagaaaaagaaaaaaaacaaaaaggaaaaacaaacaaaaaacaaaacaaaaaaagagaaaaacaaaaaagagacaacacaaaaaaaaacaaacgacacgagaacacaaaaaaaacgaactaaaaaaaagaaaaaacaaacaataaaagaaaaacacagcaaaaccaaaaaaaagagagaacgaacgaaagcaaagcagcaaagaccataaagaaaaacgcaacaagcatagaatccacaaaggtgaaagcgagaaaacaggagagaaagacgaggaaaacagaggaaacacgcaacaaggcgacagcaaagagtgacaaagcacaaaaacagaaccaaagaagcgaaaagcacagggcaagtcaagaaaacacacaagaccagatagggaaaaccaagaagaca

SEQ ID NO: 638671 - DNA, 851 bp, Homo sapiens
gcagaggctaaagaattaaccacgtcatcttcagtcaagcaaatcctctactcaccatgctgttcctcctgccattcatttctatctccttccccttgcatgcatcctaatgaaatagctgtttgagcttttaaatacatgatgtcctacagaaatcctttattcacatgtgcgttaaacctgttccagtcacaccccatgctagcaacagcacgttgaatcacatgccagaaatggcaggcagcgcatttcattaacactggactggatcggaacactcgggttcaagtgggttgccgtgaactgcgtaccaccaaatacatctctgatggccagtgcaccagtcatcagccctctgaaggagctggctgtgtgctggtcgagtgcttgcccctgccagtgctcccataactaggacttggaggaggctatggaacaaagtactgtgacgcagtgaggagctcccaggattggcggtgtgtcaatgacaaaacccgtacccagagaatccatgctgcagtgccgaagatggctgcacacgcacctacaaaatcacagtagttcactgcctgcaagtgcaatgaggtacgacccggacatcagcaaccgagtccagtcacaacgtttgacgagcctgtcatcctgtccaagcccagtccagcatcacgagagagcgtgaaaccgagccagcgaatcccgccaagcacagcactgagttagaacttcagactcccataggctagacttactagtaaaccatctgctttacagacttgacttgcttggcaagactcaagcctgccactgcctgttttctcgacttgaaaagtatatgctttctggtttgatcg

SEQ ID NO: 638672 - DNA, 87 bp, Homo sapiens
agattgtcgctttgtgcttcagtatcgttacctttgtagacttatttaatgaggagccattcaaataaaccaaacttgctttggttg

SEQ ID NO: 638673 - DNA, 770 bp, Homo sapiens
  misc_feature (362)..(362): n is a, c, g, or t
  misc_feature (406)..(406): n is a, c, g, or t
aagagatggagtcttgcactgtcacccaggctggagtgcaatggcccatctcggctcactgcaccctctgcctccggggttcagacaattctcctgcctcagcctcccgagatgctgggactacaggcatgcgccaccacgcccggctaatttttgtatttttagtagagatgggttttgccatgttggccaggctggtctcgaaatcctgacctcaggtgatccacctgcctcagcctcccaaagtgctgggattacaggcatgagccagccactgtacctggccccatttgcatgtccttttcaacaccacatgcctgtacgctctgacctggcctcctgaagataggccctgttcctgnctgagaggggatactggactgcagaacctgtgccctgtggtctntgctttccagctttggagtgggcactagacaataagcatgcagaaggaggcacgaacaaacacctaggaattcattttgacgtatatggtgtttatgaagtttgcaagctatataatgttgagcaatgtatctcacgcttgtcctcctcctccttgtatgttagctgtttttgtagcattgggtgtttgtgtttataggcatgtttccacttccttcctactaggatgaactattgttggagaaaatgtgttaagattccttcacttccttctttctcctctactcccactttttcaccctcttcctctctcattctccatgtagacacccacatatatatgtatgtaggtatactcttgcctc

SEQ ID NO: 638674 - DNA, 278 bp, Homo sapiens
gggctctccccccagggccttttccccccctttgattgggggtgggggccccatagctcaccccccctgtcccctgctgaatgggcagggctgatggggccctgaggagctgcctttggtcaaaggccaggctttgcccaccaggggacttgactcccccccccccggggggtccgggtccaaaggggagggccccccttggggtttggttcccgaatcagaaccccctccccccggggggaaattttaatttaaaaccttaaaaagggccttttcta

SEQ ID NO: 638675 - DNA, 399 bp, Homo sapiens
  misc_feature (12)..(12): n is a, c, g, or t
  misc_feature (30)..(30): n is a, c, g, or t
  misc_feature (81)..(81): n is a, c, g, or t
  misc_feature (100)..(100): n is a, c, g, or t
ccgttaccaaanccccctggtgggatgtgnaaaataacccttgggggaaatgtgtcccctagaccctgatgtgatgccatnggggacaaatttcccaatnccatttgcctccccaagaaaatgaaatgttacctaaataaaccagccgtcagggcaaggagcccccggtccctaaagaaaaaccttgcacagcatggtgaataaaattaataatggtgtattgcagattttaaaattgctaaaagagtaaatttcaaatgctctcatcataaaaaatattagtatttgagggaatgggtatgttactagcttaattgaattattccacattgcattcatatattataacatcactttgtaccccataaatttacataattagaaattgtcaatttacaa

SEQ ID NO: 638676 - DNA, 816 bp, Homo sapiens
gcttggacggaacccggcgctcgttccccaccccgtgcggcgccccatagccagtccctccgtcacctcttcaccgccaccctcggactgccccaaggcccccgccgccgctctagcgccgcgcagccatcgcgggcgccgccggctctcctaagtcgccggccatgacgaccgggtccgacctcgcaggtgcgccagaagtaccacccaggactcagaggccgccatcaaccgccagatcaacctggagcttctacgcctccatacggttaccctgtcccatgtcttactacttgggaccgcgatgatgtggctttgcaagaacctttgccaacatacctttcctttcacccaatgtcctcattgagtgagcagcggcacccatgcctgacccgaaacacctgaatctgaacaccgtgcaggacacccacaccgaggtgtggcccgacaatcttatccctatcagcgcattactccacggagcacccagcacctgttgcctagacctggcctacacaacgccggggcgcctggcccattgccacatggacgttgttgccattaacccactttgtggcaacaccacacccttggtgacatccacgtcacatcactggggagacctgggcaccaacactgggccagctgaccaagaattgacccccccaatttctgtgactttcccatttggcagaccaacatttaccttggaaatgcaggccaggctcgaacggccaatccaacagacacttgggtggacccacgttggaccccactttggcggcaaagaagcggaagacgcccgaaattctggcc

SEQ ID NO: 638677 - DNA, 659 bp, Homo sapiens
agggagtgaaaccatctgctataaaaagacaaaaatcagccggacatggtgggcgggtgcctgtagtcttagctactttggaggccgtgaggcagggagaatcgtttcaaccctggaggcggagggttgcagtgagccgagatgtattactgtactgcagactgggtgacagagcaagactgtctcaaaatgaaatgaaatgaaataaaataaaatattcatgaagaaaaaaaaaaaaaaaaaacaaacaaaacaaacaccagacgagcacaagacaggcggcgcggcgaacaaacacgagctcaaagacacccagggcgccctcgcacaagcacgaagaccgccaggcaccacacacacaagtccactgcacacacaacaggtcaacagaaccacacccacacccccgagcataccacaccaaaacacagagagagagcacgacacaaaacaaaaacaattaagaccacaacaataccgaaccccacacaagcgagcaacacaaccacccaccgcccactcaacagacaagaaacaatacaacaaaactacaaccaacaaacatccacacgacaccccaaacaacaacacacgacaacacacccgatccccacagacacaacacacaaaaaccgcacaaacacaaacaagcgcaacac

SEQ ID NO: 638678 - DNA, 118 bp, Homo sapiens
tgccttaactcccaatagggaatccgtgatggccatctacgacgaaatccgtgccagctccaagagctgatcgagctggtagaacaggacgcgcagtacacctctgctgttgctcatg

SEQ ID NO: 638679 - DNA, 448 bp, Homo sapiens
gactctgtcagtgcgctgtaattctgcactgtgtccttccagttgctggcccggtacaaaggcctgaatctcaccgaggatagctacaagccccggatttacacctcgcccacctggagtgcccttgatgacagacagtatcctggagtgcacaggaaataaaaaatggatctatcagtccagacgggggcctaatgggtcacataattctatctgattacttccaaggacacctctgactacaagataataccccctaaccagtccttccagactcaaaaataaccccagattacctctttccaggacaagagggtgtcctggtccctggtctacctccccaccatacagaagctgctggaactacggcttctccttgctcctcggacacgctcctgtcctgggcctcacaagtctggcggtcagatcgcaccatagactacgaaaa

SEQ ID NO: 638680 - DNA, 971 bp, Homo sapiens
  misc_feature (971)..(971): n is a, c, g, or t
gggtgtatccgctccagccgcgcccgctgcctctgcgagctgcagaggactgtcgggaacaaccatgtcctactgccggcaggaagggaaggatcggatcatatttgtgaccaaagaagaccatgaaactcctagcagtgccgagctggtagctgatgaccccaatgatccctatgaggagcacgggttgatactgcctaacggagatattaactggaattgtccatgtcttgggggaatggccagcggcccctgtggggagcagttcaagtctgccttctcctgcttccactacagcacagaggatatcaaggggtcagactgtatagaccagttccgggccatgcaagagtgcatgcagaagtacccggacctctatccccaagacgaggaggaggaagaggaggcaaagccagtggagccggtggaggagacagctgacactaaggtctctgcagccaaagagcaagggacaagctcttgaaggccacatggctgccactcaccatgggactttctgtacaaatgccttttggtcactttgtgaaagttctttccctctgtgcactgtaatatacaaaataacttattttaatgatcaggcgtctggccgtatacactgaagaaaagggcgtgtgtgcacctgtgtcctgcataaacctgtccttaaacattagtcactcctggatgtactactctgtgaatggcctggattgcactttgaatatgtgttgccacctctcaggcaccaaagtgtactcaggaaagttaccggaaaagcgactatcgaccatttgtatcctttggatttccccctttgaattagtatgatcaatctaaatggccacccaggaagggggcaggcgcgggacgagggtcgcctccacaatgtggccaccgcaaagggaggacgagccccaaagaggggtagggaaacgggcctagggcaaaggtcacaaccagcgttggcn

SEQ ID NO: 638681 - DNA, 115 bp, Homo sapiens
ggaggacctttgttttctgggagtcctggcggttctattaggctgttcatgtgaaagccctaggaggatgaagaggattgttctggtggcaacaaagtgtaagtgtgccgggatt

SEQ ID NO: 638682 - DNA, 329 bp, Homo sapiens
gcacatggctgaagtcatatggagagtatgctcatcagaggctattcactcaactgtgtggtgggatcccatggcatgcggcgagataatcgttgatgcaaaaattgctcgccttgacttcagcctgcaaaaaacaaaaatgaagcttggtgtacaggtggtcattacttaccctgaaaaaccggaccaaattatacagatagaatcagatatccccaacgagagaattcacaatatcctgtcaactggagccaatgttattctaaccactggtggaatagatgatatgtgtatgaaatattcttggaaggctgatgctatggcacata

SEQ ID NO: 638683 - DNA, 281 bp, Homo sapiens
acccttgccattgctattagcttcttagtaatgattacacatgcaagcatccccgttccacgtgagttcaccctctaaatcaccacgatacaaaatgggacaatgcatcaagcacgcagcaatgcagctcaaaacgcttagtctagccacacccccacgggaaacagcagtgagttaacctttagcatgatagcgacagtttgactgtgctattctaacccctgggttggtcgatttcgtgcctgccagcgtggtcactcgattaacccacgtcagtagag

SEQ ID NO: 638684 - DNA, 464 bp, Homo sapiens
  misc_feature (175)..(175): n is a, c, g, or t
  misc_feature (337)..(337): n is a, c, g, or t
tcagaagtagctgggactacaggcgtgtgccaccacgaccggggcgggtggatcgcctgaggtcaggagtttgagataggccatggccaacatggtgaaaccccatttctgctaggaatgcaaaaattggctggtcgtggttgcacatgcctgtagtcccagttgcttgtgaggncaaaatcacatcaaatctttgtttgtttgagacagggtcttgctctgttgtccggactagagttgcagtggcaacatcaaggcccgctgcaccctccacttcctcggctcaagcaatcctcctccctccctccctatagctgggactataggcatgcaccancacacctggctaatttttccttttgataaagtcttgctcttgtcacccaggctggagtgcaggatgtgatgattggctactgcagcctcaatctcccagacccaaagtgaacctcccaccttatctg

SEQ ID NO: 638685 - DNA, 524 bp, Homo sapiens
  misc_feature (82)..(82): n is a, c, g, or t
  misc_feature (86)..(86): n is a, c, g, or t
  misc_feature (89)..(89): n is a, c, g, or t
  misc_feature (94)..(94): n is a, c, g, or t
  misc_feature (119)..(119): n is a, c, g, or t
  misc_feature (177)..(177): n is a, c, g, or t
  misc_feature (195)..(195): n is a, c, g, or t
  misc_feature (207)..(207): n is a, c, g, or t
  misc_feature (249)..(249): n is a, c, g, or t
  misc_feature (274)..(274): n is a, c, g, or t
  misc_feature (340)..(340): n is a, c, g, or t
  misc_feature (351)..(351): n is a, c, g, or t
  misc_feature (357)..(357): n is a, c, g, or t
  misc_feature (372)..(372): n is a, c, g, or t
  misc_feature (374)..(374): n is a, c, g, or t
  misc_feature (408)..(408): n is a, c, g, or t
  misc_feature (445)..(445): n is a, c, g, or t
  misc_feature (455)..(455): n is a, c, g, or t
  misc_feature (485)..(485): n is a, c, g, or t
  misc_feature (500)..(500): n is a, c, g, or t
tgtgagcgcaggaaggggttcacagtttcagtcgttgcgcacggctcctcggagaccaatttttttatgaacaccatgcaanaatngtntgccnggcctggtccccagacaatgaacantttgcctccggtggcatggacatgatggtgtatgtttggaccctgagtgacccggaanccagagtcaagatccaanatgcacaccggntgcaccatgtcagcagcctggcctggttggacgagcacacgntggtcacgacctcccatgatgcctntgtcaaggagtggacaatcactattgaggagccccacccccgcctttggatggaccaatcagggantagagtttaantgcagnggaacatgtcatttntntatttttgtgaggggcccccatgcccccaccccnccacaagaggcaggagggcccagtcatgaccctggtntttgcagggngtctgtacacgtttttttgaaagctttagncagtaacagtttgcncatgaaaaataaagcgagccccta

SEQ ID NO: 638686 - DNA, 138 bp, Homo sapiens
aatttactggcaagttggtttagtaacccaaaaaagggaaggagaaaacagctgcctccccgcccagacattgttttgttcagatgtttcaatgcctcatgaaacaataaaaccccaaaaattttttttccagtttta

SEQ ID NO: 638687 - DNA, 260 bp, Homo sapiens
tgtggagactggggtctcagaaagacggccaaagaatgccccgatttacaccagggcgcggtggctcacgcttgtaatcccagcatttggggaggccgaggcaggtggatcacaaggtcaggagatcgagaccatccggggtaacacagtgaaacctcgtctctactaaaaatacaaaaaataagccaggcgtggtggcggacgcctgtagtcccagctactcaggaggctgaggcaggagaatggcgtgaacccgggaa

SEQ ID NO: 638688 - DNA, 333 bp, Homo sapiens
tttttaggggcccccctttttaaacccccccggggggggtgaggaaaacccttgggctcttttttttttggggggaaaaaaaaaagggtgggttttggggttggggggttacccccaaaaaaccccccgggggggggggtaaaaaaaggtttttgttttttcccgggggcccccccccaaggtcttttgggggggtttcttttttggggttttttggccccccgccccccctaaaaaaaaaggggggcccccttggggaaaattatttttgggggtccccggtttcaaaaaaggggcccctttttttccccctctttaggggcccccccccca

SEQ ID NO: 638689 - DNA, 185 bp, Homo sapiens
actatgccccagatctactgcacctgttagccgcttggaccgggacatgactagaataggactcagacagatgttcaggtacaggggcagtacataggtcctctctctaatcccaaacctaagacctataattcttacaactgcgattccatctaaagtggaagcctttgggtggcacaacagta

SEQ ID NO: 638690 - DNA, 1612 bp, Homo sapiens
  misc_feature (519)..(519): n is a, c, g, or t
tcgtaagctgactaatggctcgtactcgctcgtggttagaaggcatgattatatattatctaagcggcgtgcttatgcagtcttcacgccctcgctgtgatggatttcttgagccgtggtggaatgtatgcgacgtgctgtagtgtactaagtcgtgtcgtgactatgtgtgtcacgtcgcttttgatgacccgacgtgtggggagttccccaagttttcctgggggacaacaaacagtgggggcgtacgcagaaaggagcgtagagatggcctccgtatcgtcgcctttcttgcggggagaggctgttgtgttcctctattggggggccaaggacaccccccgatatgattggggcgagagtcacaaatctcgaggcgggctcaccttgggggagaagcaacaccgccctggtcctgcttggtgagaaacgtcgctgcgccgctcaaaaatacccggggggggaaaagttgtggggccttgttggggtgtccagccacagagggagggggcctcctcncgtggaggagtcacggggaacaatgtttgcgctgggcccccaaaaaaaggggtgcaccaaatgtggcttgaccgcccggttggccttgtggtggacccagaattgccgcccgccacaggaggagaaggtccaccctcggcggcgcacgagcccccccaaggaaacaacgctggggttgctctgggggggcgcgcgagaggaagggagccgccgccccccgttgtgtgtcccacagggccgtttataatgggggtatttctatgccccgccctgagagagtcgtgtcccacggggggggcaagccccaggggagaaaaatctcgctggaaggtgagagaaggggcaacaacgcgtgggatccacaaggaccctggggaggagacacacaagtggggagggcccacagcggagagagccaacggcctgggcctggaaaacacatggcgtgcaaagaaagtgcgtgcccccccgttgtgttcgctcgttgggggcgttgggtcaaatccccacgccacagagtggtttctgaacacaatgggcacagcaatcttaacacaacgcccgcgagaagtgggcttgagtaatttcaccacgagaggagaaactcttgcaatattctgcgccttttccttgggaaggggtggtccgccaaatggttgccacagtggttctcgttctcgcacagaatttggcgtaaacccacaactcgtgtgcaatccacgtgaaccccacttgctagtcactcaaacgggtgacacaaacgaagtcctggcctctgttctgtggaagacggagttatcacccttcccaacattgctgaaaaaggttcaaggcctcttcttggctgagtgccaatctgcctttgtggctgctgcccctcgtggctgctgccacaccacacgctgctccctgctgctgctgcacgccccacgctaaaggttgaaagccaaggaaagaagtcggaaggaagtcggaacgaaggaatattgggagatttggtctctttgactaatcacccaaaagcaacccacttagccagttttaatttgccaaaacaagggaataaacgcgcctacttttttataaaagtcca

SEQ ID NO: 638691 - DNA, 90 bp, Homo sapiens
ctcctcagtgactctggcttctatctctgtgcctggagtgcacacacatgggacactaggagtctcccgaaaagaaacattcagtacttc

SEQ ID NO: 638692 - DNA, 799 bp, Homo sapiens
ggcatgcatttatgtgtatgtgtgttacagtataaccgctgaggaatgttcaagggttattcatctttatttgtttgcaaaacttaatttatactgcagtttctgcatttttacggtttatttttctttagttagaacgtgattttctttatatcctggaaatgccttacacaatatctattcaataaatgttattgaatgaatgtaaataacataatttagagtttttaaacagtcataacatgcctaattttaaaaagaaaatacctcttttttttgttgtttttaagagagtattttgctctgtcacccaggctggagtgctgtggcatgatcttagctcattgcaacctccgcctcccaagttcaagtgattctcctgcctcagccatcagagtagctgggattacagatgtgcatcaccacacctggctaatttttattttattttatttatttatttatttttgagacagagtcttgctctgtcgcccaggctagagtacagtggcacgatcttggctcactgtaacctccgcctcccgcgctcaagtgattctcctgccacagcctcctgagtagctgtgattttaggcacctgccatcatgcccggctaattttgtatttttagtagagactggttcaccgtgttggccaggctggtcttgaactcctgaaccttaggtgatcaaccaccttggcctcccaaagtgctggattacaggcgttgagcaaccgtgctggctaatttgaatttagtaaaatggggtttccatgtttgcaggctggtccgaatct

SEQ ID NO: 638693 - DNA, 174 bp, Homo sapiens
actcactctgatgtcacctcggccagtagccattgtgatactcagcaggacgagcgcgagcttaagctaccactataatcacagcaaacaagtggatgccaccaacagcacgttttcagttcgccgattatcgctcactgagttcgtcatatagacagttggccatctatttgg

SEQ ID NO: 638694 - DNA, 521 bp, Homo sapiens
tcgtggtttgataggcaagtgagaatatgaagaattgactaagagataaatcaaaagtgtccaggaatggtaaaaaagggggggtggatggatgagtagtgaactctagcactgtcagagttcaatcagagaaacagaatcccttggagatggaaccacagttccagctgagtgaaactgacatacgacaaatccatcacaaccctgcatcacttttaatggaataactgaggctaagcaagtgtggagttagaattctcaaactaacaacgacaacaacaacaaaaaaaaacctgagggagggaaaaacaaaaacgggaaatataaatactaatttcctcaacttcatagtggagaggacatctgcctgaacctgataaatcaagaaatagaggcttgagtatatcacttaagattataaatgtaaatactacaagatctaaaaacacacataaacctttcaagttatcacagtgaaagcatgaaacacagaccaaagaaaacagaccctatcaaaagac

SEQ ID NO: 638695 - DNA, 785 bp, Homo sapiens
agcgggcttacggcctgcgctcgggtatcgcggcgggtcctctctatctagctccagcctctcgcctgggcgccactccccgtgtcccgcgtcctaggccgaccatggcgcggggccgcctgtagcgcggccgcgtgctccgtgctggccagtcctggccgtggacctggccgtgtagcccctgcggtcggctctcagtacccggtcgagcggccgtgtcctggtgcggacggccccgtggatcgccagcgtggagggaggagggtgtgcgtgcgtgcactgtgactttgacgtcggcgacgtatcaaggacaaggccagcaacgatatgtaacctagaatactccgacgcgactgcaggtggcagctgcgcccgcgatgcagatacgtatccttggggtgaactacttcttgtgaccgtggaagctgggccacatacctagcgtgttgcccagagacccgagggtgcagacttggatcaacgtgccccagttccatgacctagcctacgatctagcaccacagggagagcgattcatgctcgtttccagggatctacgctgttgccgttgtggcatggggcaccagatgacctgtggtcggaaagtcgcaccctgatccagcgacgccctcacggggggtcgtgtaacactggggcattgtgcctggttgccctaatcgaaccgtacttatgcacaacccttaccagggcgtctagtattgcctgacccaatgaaagtggagagacctcctggcctgaagagaaaagccggagttcaccatgcc

SEQ ID NO: 638696 - DNA, 85 bp, Homo sapiens
gcggccgcctactactactactactgctcgaattcaagcttctaacgatgtacggggacatgctataaaagtggacaggtactcc

SEQ ID NO: 638697 - DNA, 964 bp, Homo sapiens
  misc_feature (26)..(26): n is a, c, g, or t
  misc_feature (55)..(55): n is a, c, g, or t
  misc_feature (57)..(57): n is a, c, g, or t
  misc_feature (74)..(74): n is a, c, g, or t
  misc_feature (83)..(83): n is a, c, g, or t
  misc_feature (155)..(155): n is a, c, g, or t
  misc_feature (161)..(161): n is a, c, g, or t
  misc_feature (165)..(165): n is a, c, g, or t
  misc_feature (167)..(168): n is a, c, g, or t
  misc_feature (211)..(211): n is a, c, g, or t
  misc_feature (259)..(260): n is a, c, g, or t
  misc_feature (299)..(299): n is a, c, g, or t
  misc_feature (307)..(307): n is a, c, g, or t
  misc_feature (312)..(312): n is a, c, g, or t
  misc_feature (323)..(323): n is a, c, g, or t
  misc_feature (604)..(604): n is a, c, g, or t
  misc_feature (610)..(610): n is a, c, g, or t
  misc_feature (613)..(613): n is a, c, g, or t
gggagcggcgcgcgctcggacctctnccgccctgctcgttcgctctccagcttgngnatggcggctacctgcgnggtcgtgcngctcgctctgcagagcctcaggctcgcggccggctgggcgccggcggcctgacagccccactcgaagaagcngcgtgntgcnanntatgccgaaaaaggatcaaggtggcgaagccctgtggttggangatggatggtgatgagatgacccgtattatctggcagttcatcaaggnngaagctcatcctgccccacgtggacatccagctaaagtntttttganctcgnggctcccaaancgtgaccagatgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgtggggggactgtcttccgggagcccatcatctgcaaaaacatcccacgcctagtccctggctggaccaagcccatcaccatgggcaggcacgcccatggcgaccagtacaaggccanaagacnttngtggaggacaggacggcactttcaaaagtggtcttcaccgcaagaagattgcgagtggggtcatgggggtgggctgtgtcaaactttccctggagcggggtgagggcatttggatttcacagcgaggagtcatctattagtgggagaagtgtcatgattgcatcagagaaatggcggtgaagaatagacagaatatacaagtagagcaagatgggtcaccgggttatccggcgcttcgaagcgtaaagacagttagcaatatagttgatacaccgcaatagaattgcggatgtctaagctggtgtatgtggagaattatcgatgggacatatacagattcctagaaatacg

SEQ ID NO: 638698 - DNA, 223 bp, Homo sapiens
ccgcacaccaccacgcccggctagtttttgtgtttttttggtggagacagggtttcaccatgttggttaggctggtctcgagctcctgacctcgtgatccgcccgcctcggcctcccagggtgctgggattgcaggcgtgagccaccgtgcctggccccacataaagtttctgagcacttgaaatgtggctagtgtgcggctgaagattgggtaccgagctcg

SEQ ID NO: 638699 - DNA, 214 bp, Homo sapiens
ctagagatcccgcccggatagcgtgatctgcctagccgagtagggtctcttatcacgtggctcctcagctaaggcttctaattccttttgacatttaactttgcgagccagctccgtggatcaatcatataagatatgcgactgagacctagccgtcgtttcaaggcacgcatatctttggcccacatagttaaacgatcgtgtctctacaggt

SEQ ID NO: 638700 - DNA, 143 bp, Homo sapiens
ggcatcaagaacccagtgaacaagggcaccaccacagtggacggcgctggcttcggcatttaccggccggcggagttttccaaggaggacgcgagtattaggcgttcccaaagaggatgatgctggcctaccgttcggccaac

SEQ ID NO: 638701 - DNA, 406 bp, Homo sapiens
  misc_feature (257)..(257): n is a, c, g, or t
  misc_feature (320)..(320): n is a, c, g, or t
  misc_feature (355)..(355): n is a, c, g, or t
  misc_feature (361)..(361): n is a, c, g, or t
  misc_feature (393)..(393): n is a, c, g, or t
gttaaaaccgcagccaaagccctcttcttcctatttctcccgaaacccagatccagatggttttacaaatgaactcttccaaattttaagaaattgttaatgtttcccttattaagatattgtccttaaaaaatgagcttattctaagaggcttatgtaatcttgactccaaaatcaaataaagacatttagtaaactcattttaaaatttaagtgagggaataaaagaaaagaaaaatagcattccttttgatttngaattaattctaaataaaatgatattcagtccgatcttaagtgtgttaaaaataatatcatgntcaagtaagaattattccagaaattttaaaaggtngagttnaaccatcagggaaaatcagctggggtgcagtnggcttgattgccc

SEQ ID NO: 638702 - DNA, 148 bp, Homo sapiens
gacgctagggtagcggcatgtatcaggtactcacaggttgactgcagaggagaggaacacgctatacttgaccttaaagcagcaggatggtcggaatataagtgagagagatgccattctacaaagaattctccttccacaaatttta

SEQ ID NO: 638703 - DNA, 234 bp, Homo sapiens
agatggggcataaacctcgacgggtcattatacgcacaggaagagcaatccatggatgtgaaagtacgagtaacaaccagcgatgagaccagacaacgggcctggatgggtgatgacaactatctggcgaggctgagcccctgcgtggtgagggagcccaggactccttctaggatgtctttccagcctgtgtggagagggtgtcccctacgatgcggtgagaaaactcttcta

SEQ ID NO: 638704 - DNA, 281 bp, Homo sapiens
caccttgatcatctcatgactttatacaggaatcggagatagtgtacctttaaagtgataccgtcatgaaagagtcatctgaaatgactctcgtgctggaggaaaggaaagtaatgaaatcaacattcatggttatttaacatgccttacaagctaagcataatcatcacatagtacactccttttcctagtcataaaaatagtgccagaaactatatttgttcaaatcatcattgcaaacggtatcagaatacaaatcagatcattcaaaccagtggctc

SEQ ID NO: 638705 - DNA, 423 bp, Homo sapiens
gatatactttggatatggatttaaatggtctctaagagccgggggtagggggcaggaaaagtgggttgtttttgcccctcaaagtccacctacctagaaaccaagcccacggttttggcggtgaccctgataataaatgggttttttaagaggggccagcccctccctccccagccggaggggtcattttttttttgtaccattaaagggagctttgatgaagttggagagaagggctcaaggttttcgcccctcccctccctaacccttaccttcagtttccaccagcctgaagggcctcttaggggatcctcagggggcccccaccagggcacaccctactgtccttgtgcctcacgccccctcctcatcctgcaccccttccatccccccttccctttcaataaacagttgggatggata

SEQ ID NO: 638706 - DNA, 1598 bp, Homo sapiens
  misc_feature (1094)..(1094): n is a, c, g, or t
  misc_feature (1439)..(1439): n is a, c, g, or t
  misc_feature (1598)..(1598): n is a, c, g, or t
tcttctgtttcaatgggcagctctgtttcctaaagtggaatgaactgaaaatacaaattactaattaaaagataaattacccattaagcgtgaaaaaagagacagagagcaattcagtgtttcaatgtgttcaccattccgtgccaacccccacttcgtgtaaaatatactttatcacctactctcagcatcttcacacttttgtaaccacttaaacactttaaatataatttattatttcaatgaggagaatatcttatctttatgagtttcatattctcaaaaaaacaacaaaacacaacccaacaagagaaaccccttcacaactgtgtggttgtcgcaaacctcacaggtgtttttcaccacacagtgtggaccacaaacaaattttatattctccacaaagaggtgtgagagagagatctctcacaggagaggggtgggctattaccacccacaccacagtgggagacctctcagggagaagaggtgagaaaccacaagggtctgtgtttctccacaacccccccaaggggaagagtgtggtgtggcctctccccgggggccacaagggcgccagggggcagggaggacatcctctgtggggaggtctctctcccctctctctgtgtgtgggccccgaggggcccctcttgtggaatctacacaccttttctcactatttttggggcgcatatctctggagagcgtctaaagaggcacccgagatgataggaggcgcacgtcgtctcaacaaacaacagacaagaagaggggcgcccccccccaataactattgtctgtgacaaagcgcgggtgggcccacccagggggccgatacacgcgagcaaacgagggtggtcgttcccacaattattcggacactcacctcctgtgtacttacgcgcgggcgccaccgccaagagcaggctgtgctgttacagaaaagcgagtttgttaaccccgaaaaattattccgcaacgatcttcgtgacgctttctaaacgatgtgttgacgaagcaaccaataggacgtgttgctccaactcgatcgataagtttccaccagacatccgggacagaggcggggcccncggccctccttaagaaggttatctccccccttcaagaggggggcgccaaaaggtctatcacaggcgctatcacccacggttgttctttgggctaacgagggggggtgcccccctaattgaggaacggcgcgatcttatataacgagctaggacacacgtgtgccccagcgctgttttatcaaaccaccggctctcgtggtccttgtgtaggcaacacacaccgtccctcctgccgtggcgagaccctctcctccgtgacagaggagcccccccatctgcattctcgtggggggggcgagcccaactctgtgtcacacacaccagcactccccatcaacgaagaanatatacacggcctctacaccggacacaataacacacctttcagcgctggctatctctgttgtgaaccaaacacccgacacttacggtctcgcagctgaacgactcgtcgcgccgacgatactatctctaacatactgcgagcccctacctgacatctgn

SEQ ID NO: 638707 - DNA, 480 bp, Homo sapiens
gcggttagcgactcatagaggatcccccgatacaaggccgacagtgacaagaaaagtagctgtgatctagtgtctgcactaaagctgactttcctggcactcagaagtgcccttccagtgcctaactgcagaagggtggcctcagcctcctcctcctcctccttgtgctacctcctcacggatctgcaccagcaactgaaagaggattggggctggaccttccccagaccccggtaagccacagctgccaacgtaatggacccgctgtggttggacccggaaatgacctgatcatatgacgtggcctggtacacataatcttaatcaatgtgcccccttctctaccacctaactgtagcagaggctccagacgaatgacataagcagacaacattatctcacgggttcgtgatacgtgttccagaaatttgactctggtgcatccccttgagactctcaacgctcccaaacacctgctca

SEQ ID NO: 638708 - DNA, 852 bp, Homo sapiens
tccatgctgaggctcagacaggcctgtggtcacccataggctgttcgtgaagagttcttgccactctcaaaaaagctgcatgactatggatgagctgctgaccttctttgcagacagaactgtggacttggacatgtgaagaacgcacatctgatcacgctagtccgtgctctcaattggctctagcaggcgtcatacctaattaaagggtgacgtctgccttggcggcagaattgtgcagaggaagtgttgcgctcctcgagcggagacatgaaaggaaaatcaattactgattcacttcacacagatcttcatgcgtacccatagcttgatggcactggtgataggcaggcgcccaggtataccgagctaccttgcgtgatggccgagttgcaggaagagggcaactggctgcgagagcctacatgagcaagtgtactacggcagtggctgaggcccagcgagctgtatatcctgtgcgggagatcatccatgagcttcagagaaagatcagtcttaatactccttggatggctaaacttgtgatccaacaggagcaatagatttactactgatgaggagctagttcagcgacggcgaaagtgaaatacagcagaaatacaaggcacgaagtggcaaagcgtttcaatgttccgcccacggggggaaccagggctccggaatgaagacggtttccaggctacgtaccacgcacctggcggcggtaaagcattgccgaaagcagagacacagggtgacaaacttggggcacccatgcgtaagttctcgggtgcacggtgtacccggcagcaagcctcagcgggggtggacgcagagcgggagacacacccc

SEQ ID NO: 638709 - DNA, 960 bp, Homo sapiens
  misc_feature (228)..(228): n is a, c, g, or t
  misc_feature (237)..(237): n is a, c, g, or t
  misc_feature (264)..(265): n is a, c, g, or t
  misc_feature (267)..(267): n is a, c, g, or t
  misc_feature (320)..(320): n is a, c, g, or t
ccacgcgtcgcccacgcgtccgctaggcacccgggctcttctgggggctccagaactaagccacccagacaccatcatcccgaaaaccccagcccttctcccatggcaggctacttgccccccaaaggctacgccccttcgcccccacctccctaccctgtcacccctgggtacccggagccggcgctacatcctgggcccgggcaggcgccagtgcccgccaggtanctgcccagntcccggttcgccctcttcccctcgccnngngcccgtggccttggggtctgctgcccccttcttgccactgccaggggtgcctnctggcctcgaattcctggtgcagattgatcagattttgattcaccagaaggctgagcgagtggaaacagttcctaggctgggagacctgtaatcggtatgaactgcgctctggggccgggcagcccctgggtcaggcggccgaggagagcaaatgctgcgcccagtctgtgctgtggacgcccgccagggaccgctgacgatgatccagcctggccgaccccgggagacgtgcaggtgctgcagtagactaccgaccgctgcaactgtggctgcacgcgtgctgccgcctgtggcctccaggagatggaagtacaggctccagcaggcaccagcattggccacgtgctacagacgctggacatcccttcctccccaagttctccatccaggatgccgagtcgccagaacagtcttgccaagtggtggggcctgctggacctgtggctgtggcacagacaccaaactttgagcgtgaagactcgggatgaatcccggcagtgtgggccgattcagtaagcaatgggtgaggccctgatccgagaaatgccctagagcatccgacttacattggcttacagtcccgctgacctgaatctaaggcgaaggctggcatgctgagaacaaattctcactggccac

SEQ ID NO: 638710 - DNA, 838 bp, Homo sapiens
gctacgagctggccgatggtcaggtcatcaccagtggcaatgagcggttccgtgtgtccgtcaggcgctgttccagcctcaccttcctgggtatggaatcttgcggatccacgagaccagcttcaactccatcatgacagtgtgagtgtgcacatccggaaagaccctagtacagtcccaacgaacggtgtgcctgtacggggctggaaccaagcaatgtatcacgggcaattgctcggataggatgcagaaggagatcacgcgtcctgtggcccagccaccatgaagatcaaatgatcaatcggctaccctcacagtagcagcgacgtactcgagatgtagggatcggatggctccatcctgtgccatcactggttccatcattcctagtcaggatgtaggatttagcaatggcgcggcagtacgcacgagtacgggcccctccatcgtccaccgtcagcatgcttctaaacggcactcaggcgcatgcgtagcgatttagctgctatggggttaacttcgtagacatacgcaatattggcccctggcaacatgctcacgcctcatgctagcctcacgaaactggaataagccttcgaaaagagattgtccttgaagctggtatctgatatcagcacctggattgtagacacttgtcgctgattttgaccttgtattgaagttaactgttccccttggtattcgtataataccctgtacatatctttgagttcaacctttagtacgtgtggttgttcacttcgggtaaggtaagaacgtgcttgtgggagacaagtctgcggctcggtgaggtccgtgtggccaggagctctgatct

SEQ ID NO: 638711 - DNA, 199 bp, Homo sapiens
ggttcccctaaaaacatcaggaattagattctcataggaatatgcaacctggatccctcgtgtgtgcaattcacaacagggttcatgctcctataagaatctaatgatgctgctgatctgacaggaggcagagctcaggcaggactatgccatacttttaatttagggattattttctatgctttacttttactttaag

SEQ ID NO: 638712 - DNA, 356 bp, Homo sapiens
taggtggaaaggatgtgctgatggcatgagacacatggagcagagggacgagagccgtgggtccaacgggggccttgtgacaccatgtgcaatgagacaatgggtgagcacagagtccacgtgggggacacaatcaacttattcacgaatactgtgtgttcgcatatccgatgcgcagatgcgcttggggagctaccatattttgcagaaaagaacatgcaccagcagatcatatacaccccctacttttcttgccttacgaacgtgtgctgtgcttcacctttctcctcctgttcgctgctcccagctgctcccctcctatcacgcgcgcaccttttcccttcagctcacgagca

SEQ ID NO: 638713 - DNA, 462 bp, Homo sapiens
  misc_feature (1)..(1): n is a, c, g, or t
ngactgtcacaataactgtacctggcgtctccctcattggaattgtcaagcctatctattcatctgtgaactgttatttgaagttgatctctgtgtacatcatgcgcatcaaggtatctcacggtggtgatgcttagtcgcctagggacatacatgatcccccgtcttagccaaatagagcgaacgtgctctgggattggaagtgagcttggtcgtcgcataagcgtgttctcagttgtggctatagttgcgtcgcagccagaaggtcatagtgtaggtgatagtgataacggcaattcccgagaatgttatgcatagtcatttgcacaatgtgtcccggttggacatgagtgtaggcttcagtgtgaggcttctaatacgtatatcctgttagcgataatgctattattcaagtggtttgatagtaaggtggagtgagttggtgccgaattcctgcagccc

SEQ ID NO: 638714 - DNA, 416 bp, Homo sapiens
gatccatgagcactgccacaggcctgatgactgcactagatctcaggaaaacagaagatcttcctattaccacacactaactgaaaagtgacacaggaaccaactccttaactttccaaattactgagaactcagactgccaaataccgtacctctggacagatggggcctgcttggtctttctatcaagggaagggaggccaatgggggagtaatgcctgtcatttccaggggaagcagaaaaaggacagtaaacaactttactaccataggccccagcgcagagccgtagagggagaagcaccttcctctctagcataacaagaatattcacaagagttttttatatagtgttttttaaacacacgataccaatggtcctaaacttgggtcagtcaactggtgaagataaccta

SEQ ID NO: 638715 - DNA, 984 bp, Homo sapiens
ggttcgctgtggcgggcgcctgggccgcccggtctgtttaacttcgtcttccgcgtgtgtcccatacgtgatacttctgcatgtgacccagatagcatcactggtttacttggccgtgtgaacgattacccaaggcacttgacggaccgattgcctgcagaacgatctgctgcgtggtacgatgcctcgtaggtaaacacacattagaagtagctgcagccgacggttccacgcgcaaggtgttatcgtggatattgccaaggaaggaagagtgcaacgatcatggactcaggaacacacagacctgccaaccgttacgactcagtggcttgtgcctcgccctcatgggtgccatagactcccggtaatccactatcttgtagtccaattgatagccatatggtcactgcgagatgaccccaacagcgctattccagacaacaacagatagatcatgtctatcttcggaagacgcaacagaaggcagcacgcagtcaacaacaacaagcagcatcagcagcagccagcagcagacaacgagcaacagcacgcagcgagcagcacgcagcagcagcagcagcaagcagcagcagcagcagcaagcggcagagagcagctgacagcccgacacaagcagtcaatcgtaccccagacaaggccacacacgagaggcaaacctcaacgaccaagcaaccaccagtcttcttcagaactccacaagcactactcacaactagcacccttgctcgagaaccaactatcaactgtaatccacttcaccaccaaataaccataccaaatcaaccacaccaatcaacactcccgtgacccaacaaaccactacttaacgagatgacattactgcgtacactaccactccaccagtattcacaacacaacacttaaacatacaaccaaacatgaaattatataagtacaattaccaccttgccacctaacagacacattttgccacataccccc

SEQ ID NO: 638716 - DNA, 382 bp, Homo sapiens
atcaaagtcggttgggacaacagaggtccacatgcaaagaattaagttggacccttatctcgccatgcagaaaatgtaactcaaaatggatcacagatctaaattaaaagctaaaattataaaactcttagaagaaaacatatgtataaattttcatgaccttggattaggtaatgctttgttagacatgacagcaaaagcataagaaaccaagaaaaaaataaataaattggacttctgatatggtttgggtgtgtccctacccaaatcttaacttgaatttaactcccacaactcccacatggtcgtgggaggaacccagtgagaggtgattgaattatgggggtgggtctttccagcattgttctcatggtagtgaatg

SEQ ID NO: 638717 - DNA, 484 bp, Homo sapiens
cgaggtcaagggctgcagtgagccattatcactccaccgcactccagcctgggaggcagcgtgagatcttgtctaaaaaaaaaaaaaagttcatttctcaaacctccttctcggccagtcctttgcaccaagaattttttctgtccgtggggattggcctatacggaaagggcgatttgggacactaggggtgggagggaacagtcattcccatacatacacacaccatccttagtagtctcccgctccacagcactagtgaaatagtggtgccaggcttggtgtgtcccgcaagacctgaaacatgcatggtctagcccttaacagagaaggtgggctcgacccttgttaaaatcactcattaagagtgaagggatggatccatcctctggggggggggccccgacctctaactagtgcaaccaatattatgatgaagatcggccgagggtgggaaaggcctctcgcgggctagccaggattg

SEQ ID NO: 638718 - DNA, 185 bp, Homo sapiens
  misc_feature (76)..(76): n is a, c, g, or t
gtggttccatggatgatggcggtttagcagattccaaaaaaggatttgtacagcatcctgggagcagacccatctncaaatatatcagacctaaaacaaaaatatcaaaaactccatattaatggttcattgatgatgttacatagccctctgacccatgtgaactgatgacagaatagaggcac

SEQ ID NO: 638719 - DNA, 797 bp, Homo sapiens
aggcgtatgtagaagtagaggttaacgagggtttgttgtggtctggaacataagatgagccaaagggggccaagcattgcttcacacctgctaatcccagcactctgggtagagccgaggtgggcagatcacctgagagtcaggagttcaagaccagcctggtcaacgtggtgaaacccgtgtctctactaatgaataccgaattacaatgaataaacagataattataatcacatggggtgactttgcggggccgctatggtggagtccccttgacttaggtggctgtgtggagccaaggtaaaatcgtattgcacaccggagtcggtagttcgtgtatttgtagcccctgcatggctgcaccctgttcctcctattttgggtgtctaatgagactccttcaaagcaaagcaatgacaggtgggtgcgtgaaagggtcttgcctcgaggggccctagtatgtgccgtgtcccctttgtttgctttgctacagcggtccccttctgggctcggtgatactcagcctcccagcggtctttgtacacctgctctggatgggggtctcatggcctccacgtagggaatctcttgtgcgcgaggtggtccccctttttctctgggtttggcgtgacacttccttgggcccacttccccttgggggggcttgttaggcctttaggcgtaagatgttgacctttgaggcggtttaccgggcgttacttgccgatttgtcccgttgtgaacacttttgcttcgcggggttttgcctgctgactttttccccgagcggagtcgcg

SEQ ID NO: 638720 - DNA, 354 bp, Homo sapiens
atgagctcgtaccctgtgtctgaacttaggtatagaaaggttagtatacttgcctcctagagttattacagtgggtgaatgggctgggattccaacccaggtcgtctggctcccatgtggataggtctggacccacaggtagaggggacaagacaaattgccaagcctcaggactgggtagagcaagacaggatcaacaacctctccagtagttggctccaacctagcaggtgtgggagaggacctgtgacaggggcgggagaaggcttagtggggccggcagtccacccactcctcccccaagacagtccaaagcaataggtgacagcaagccccccctaagttcagagccgg

SEQ ID NO: 638721 - DNA, 144 bp, Homo sapiens
gcaaacccactccaccttactaccagacaaccttagccaaacctttacccaaataaagtttggcgttagaaattgaaacctggcgcaatagatatagtaacgcaagggaagatgaaaaatttttaaccggctaatttgacaggg

SEQ ID NO: 638722 - DNA, 116 bp, Homo sapiens
cctatgagctggacaaagccttctccgcataggaacaccatttcatctggctagttcaccatcacaactgcattaccaaaaggggatgttcgaaaacgaggagaacgcgtcaagat

SEQ ID NO: 638723 - DNA, 188 bp, Homo sapiens
catcgcaagagtagatcctcaggagtagtgtagcgagcaaatactggaaagtagtcctcaatcttcgatttcccagcaagaactttctcagcgagcagatctatgcttgtagaggaacaggatcacagagatggtgcgcaacattcgtgttgttccagatgctcttgaagaggttctgagcctcttga

SEQ ID NO: 638724 - DNA, 204 bp, Homo sapiens
tgccgactgcttctcacccggtggccacgtgggcgtgtgtctttgaacaccacccaccctctcacacatttaggcagaagctgatatcccagaaagactatatatgtttttttttttttttttttttttttttttttttttttttttttttttttttttttttttttttttgggggggagcggggggggggcgggggaccgcac

SEQ ID NO: 638725 - DNA, 218 bp, Homo sapiens
cgtcgatccttctgctctatttagaccacggtataaaacaaatctatgccccttcctcggggctgagagaattttgagcgctagccgtctctcgttcgccagctaataaaggactcctgaattagtctcaaagtgtgacgtatctctataactcgcttggttacaacaaactctatctctagaaatgcacaaaaatgcccgagagcagaaggtcgacg

SEQ ID NO: 638726 - DNA, 593 bp, Homo sapiens
cattttttattaatagaagcacggcgagacgaggcttattgtttaaccaaatcaatgatgcttagacaggcagttggctctctctatcgaagctgatagaccgttgatttactctgctgagcttcatttgctcatgcttattaaaatggaaggctgagacgctcaaaaatgtgacgttatcagcctaaggccgcttgactagccacaacagagctttttacccttctcgaacaagaacatctacttattgttagtcttggagcactaatctacaaacgctgcgaaatgctctataacacgctttcaagagctcttttgttgacatgagcttgcggtgtacgagctaaacaagtgcagactgtaaattgagtactacttgcttaacagaaagcgtgcatatatatggatcggacgtgaaaggttaagaagtaaactaattgccaacgacagtactagtcgaatacacagctgtgaaaggagggaagctcgttatctaagatgacgtgccacatttggagaacctgggacttaatggagccttatgaagacccacacatgactgatgaggaccccggatggagagggtagtgaca

SEQ ID NO: 638727 - DNA, 137 bp, Homo sapiens
atggagaggcatataaaggaacatccagacgtaatgggtgagagagacataaagatggattgatatacaaaaatggaaagtgagggcaaacttcatttatgagagcttgcggtaccagccgtgtcgtgaagtgggtc

SEQ ID NO: 638728 - DNA, 1038 bp, Homo sapiens
  misc_feature (17)..(17): n is a, c, g, or t
ggtaccggtccggaggntgttatggatgaggttagaattttctcggagaaagacaggcgggcacgaggaaatacagaaacaagccgcgagcaacatctaagcccttgagagaggatcctgagagaggggggaaagggaaaacagcagacaccagcccaagcacttgtgtcttctgccccttcccacctatcttgcccaccccgaacgcgagacccacgctgccgttgggacatgtgtagagagtctgtggccgaaggacgcgtcactacagtaatcttcaaaagaatagagtcagaccagcccgtcgccgttcccagaacacagccgcaaaagttcacgtcgatccaggcgttgtacgttttgttgcaatccagcttccaggagacctgttatgttcctgcgaaccaccgccgctcaccgtagaagtggagatatggagtgggtggggagaaagtgaaatacgtgagatttggaccgtatatagtgtatttgataacaaagactatatattagagtccacagtgaaggcacaccccgtagaacataagtttgcagattagcaggggatcacatgagaataagggaacatgggatcgaagaagtcaaagaaagtaacagccgatccccaaaaacagtatagagagagaccacacagtaccaccaaccaagtgcaaggaccccagaaagggggcgggccttggaacaggatacagacaggaaagaaaaacaacagtctggggacattaaagagagcacacaccagtcgaaatggggattcaggagggattcccgcgaagtaagggaaataaaccggaaaggaggtacagcttatgcttcgaaaggaggggcccccgtgggtaaactagggcatatcccagtataaagacacggtaagtaatgtgggaggaaaaggtgtcaaagagagaggatggttgggaattgggaggaatgattaggcacacaagagaaactcaatttgtcaaggagatgttggaacttgtgacaggtgaaaggcctacgggagacagaggaatggta

SEQ ID NO: 638729 - DNA, 114 bp, Homo sapiens
cggtgtcgccagggccgcacccgcagcagccaaacgaaaagtgctcacggccagaccaccctccaaccagacagggcggaccagacggcgcccatggctgagaggccgcggccg

SEQ ID NO: 638730 - DNA, 913 bp, Homo sapiens
ggacactgcatgatcacaggagcagccctctggcccataatgacggccctgtcttcgcaggtggccactcgggcccgtagccgctgggtaagggtgatgcctagcctggcttatagcgccttcctttgggcaggtgtggactggtcagcgaatcttcatcattaggcacattgtcccatcagccagtgtgactaggcatggacctaagtaactgagcgctgtcctggagctggctgaatgactccccgtagatgcctactgggagcgggatgctaacgcttctattggtgttgaactgcaactggcccatcatcgctaggcaccacgccgtcactctcattggatcgcctcgtttacagcgtggagcgtggactctattctatggttccaatcagcgctaggccattcacagtgggtgtagagcggcctgcagtggactacacgtggattacgcacggcctctttgacctgccctgatgccgtgagcgtcagtgggctgccctgtggcctgggccattgccttgcactactccctgactatgtcccagtgtgcgtcgggcacgagtctgggaacatggccagaaggatagcctgccttgtgctggccatggggcttgctgggacccctgtgactggctggggccaacccctctcagatcagcctcttctacagttttcaatttcctcaatgtacaccctcgtggccagtgcctagtcctgggcctcgtgcccggggcagttgcacgtgttcagtgcccgaggaagcaccggccatcacatcttcctgacttcttgtgtgcctcccggttgcctttccactcccacaagggcaacgagtctggtgagcatcagattccaggaggggcagcccgattccattccagccaccttaagtcaggcgcttcccctcccg

SEQ ID NO: 638731 - DNA, 400 bp, Homo sapiens
  misc_feature (105)..(106): n is a, c, g, or t
  misc_feature (261)..(261): n is a, c, g, or t
  misc_feature (282)..(282): n is a, c, g, or t
tgccgcatcttattttattttttacaaaaacgtgctcatttaatagaaatgattgattatataaaattgtttacacatttgggggaggggggagcacgtatatanntaaccaatcaaaatcatgctttctgttagaaaagttaacacttctgtgaatagactggatgacttccttttagtttggatgtctgggtcagactcacgagacgctggggttggggtgtggtgcttgacatcggggggggggaaacactaataaanagaaccccaaaactaactttntacacaaataggctttccatagaggcattacatttgccttgtccaaaggaaggaaaactgaaaagtgggggcgtactggggggctcggctttgagaaattgtgagcgcggggaagagg

SEQ ID NO: 638732 - DNA, 855 bp, Homo sapiens
  misc_feature (740)..(740): n is a, c, g, or t
gattttccggcgtgtggtgacgccttgccgcctaggcgtctttaggctccgccaggtcccccattgggcaagacaatctggggtataaaaccaataggggccaccagctctgcggtcagaagggacgcacgggccagcgccccgaccagggattgcgtccccgccctcctgcgaggagttcccgtagacacaggtcctaccattttgggagcatgggccgctcaaaactcccccgggccagggtccgcacgcaagagtctcttcccgggcagaagccagcacaggtggtgccccgccccgaaaggcaaacatgcctcttgccacaatcgcgccccgaccgcagggggtggcccccagccgtcaagagacctaggtttccccccatgggggcagggacaataacaacatcccgagtttttacaagtgggcacggacgacagaaacacacaattgtggtggattgcctccagaaaccgccagtgcacctggaatgggcataagttctcccggaccccccaccgagaagtgtccaaaatacatcaagttgttcctcaggaattcctataaacgtaacaccagcgccaaaccacgccctcttgtactgtgggtgcacaaacacaaatccacgccatagaccatttgttgtgaaacagttcacaacttctcgccccaaaaatagccttccctctgaggagtcactcgcccctgagaacattcggcaagaatcctcgcatccaacntgatggttgcgataaacccacgtatcacccacggtcccgggatattaatcctgttataaagaatatttgggtccggccaccctccccgacccctccgaccccccccaaccccaca

SEQ ID NO: 638733 - DNA, 919 bp, Homo sapiens
agcggttgcagtgagccaagatcacgctactgcacttcagcctgtgtgacagagcgagactccggctcaaaaaaaaaaaaaaaaaaaaaacttggctgattattttcttgcggtctttatagattggagaatttagggagtagagacggacagactatatttacctcaagactttgaaattgccatagtttatccagagatcatacatttcatttacttgaccaggcattatgagtgctttctctctagaaagcattttggtcatttggaattaaaatacgtcttcggtattttacctttaattgaagtttgacaacttttcagaaggtttccaggggtgaagataaccttgaattaagggagatacctttacacaagcagaaaaagcctcatctcttcgggatccctttaatgccagttggtcattcaccaggtgtagatcaggtcaccttttacccagggctggggaccaccaccttctcatctacgggtgtgtcacctttagcaatcttctggcatctcactgtcagccaacacattttctcctttccaagcctctgcagtctcatggagtggcctggaaattacttcttttaacctaccttgctaccttagccagcctggatctcataggagaattacgtgaaatactcccagattggggcctttcctgtgcccctgttttcctgtgtaccctgggaaaattctcagacccaatccagtcttggggtcctactctgtattgaaagggctaaggaaaaaggcaacaaagttcatacagattaaccctgtttgaagtttcacgtatttcattatttcaggcctcatgtgactcccctgctttgcctgatgccttttgattgccttaccctggttaagtcttcaattctttaaaaaacttaccaaatcttctctgccc

SEQ ID NO: 638734 - DNA, 682 bp, Homo sapiens
  misc_feature (659)..(659): n is a, c, g, or t
tatttgtagctattggaaataagattattttcttggtttattttctagattgtttgctcttggcatacagaaatgctgctgatttttatatgctgactttgcatcctgcaattttactaaacctcagttctaacagttttctggtagagtccttaggtttttctaaatttaagatactattgtctgcaaacaagggtaatctaaatttttccttccaatttggatgccttttcttttcttctcctgtttaattgctctggctaggacttccagtaccacgttgaagaaaggtggtgaaagtgggcttccttgccttcttccagatcttacaggaaaggcttttagattcccccctcatgatactagctgtgggtttatctgtctgtggcttttattgtgttgaggcatgttccttctacatccagttgagtttttatcatgaagggatgctgaattttactgaatacttttttggcatctatagaaatggacatatggttatgtccttcattcttttgatgtgatgtatcgcatttacagatctgaatatgtattaggtggttctcacattgctataaagaaatacctgagactgggcaatttatataaaaaaagagttcattggctcactattctgcaggctgtacagcaagcatganagcatctgccttggcttctggtg

SEQ ID NO: 638735 - DNA, 94 bp, Homo sapiens
tagagtatcccccgcgggtattgttactgctgtagctctattacgacctatgccggggaacctccatatgccgcaggtgcggccctaaaaggac

SEQ ID NO: 638736 - DNA, 645 bp, Homo sapiens
  misc_feature (46)..(46): n is a, c, g, or t
  misc_feature (591)..(591): n is a, c, g, or t
actgcacgccggtatgtacaacacagacagtctctccctatgcgcnatactaatctaacttacgtctctatggactgcctattctggtcctttcttataaatggaacgacgcaacatgcagcccatgttttctggctgctttcactgagcataatattttcaagattcacccatgttgtaacacatatcagtgcttcattcctttttatggctgaataatactccattgcatggacagaccatatttgtcttatctgttcatcactgacagacatttgggtttgttccatttttgggctgtcatgaataatgctgtcagcatgtatgtatgtacgcggtttccttagtttttatctaatgtcattttcctgttccaggatccccttcaagataccacattatgtttagctgtcatgtttctaggctcccttggctgtgacatttctcaggttttcattgtttttactgaccttgacagttttgagttctggtcaagtatttcatgaaaactccctcaattatggtttatctgatgttttcctcatgattaagctgggttatgtatttctgggaggaagaccagagaggtanagtgccaccgtcatcacatcatgtcaggagtactaaccgagcgtgtaatgggga

SEQ ID NO: 638737 - DNA, 312 bp, Homo sapiens
  misc_feature (142)..(143): n is a, c, g, or t
  misc_feature (228)..(228): n is a, c, g, or t
aaggaggtaaaggatgagggttgcatcatccctgccctgtcctaaggaagctaaaaggcatggtccctgctgtcccctccctgtcctccacccacagtgggagagggtctacaaaggaggtacaagaaccctctcaggtctnntcccaagtctcccaagagcttccagagctctgacccacagcctccaagtcaggtggggtggagtcccagagctgcacagggtttngcccaagtttctaagggaggcacttcctcccctcgcccatcagtgccagcccctgctgctggtgcctgagcccctcagacagcc

SEQ ID NO: 638738 - DNA, 309 bp, Homo sapiens
  misc_feature (227)..(227): n is a, c, g, or t
  misc_feature (259)..(259): n is a, c, g, or t
gggcattttcagtacctatttcagccttgcatctctcactgcctgtctgtcatcagggtcatataatgagtttagagttccaagggggtagagtggtctcatggcatttaactctttggatattcctctcatcatttattgtgtatcattcgagtttggtgaagcccaatgtctggatttctaccacggtcatgcatctgcaggattgagctattcttccactgagnttttcaacacacatcctgtctaatttgacccngttatgcagataccaacgttttttttctctttttctccttttatagggtt

SEQ ID NO: 638739 - DNA, 180 bp, Homo sapiens
tccccaacacaaaaaatttaaaatcagctgggcatctgtaataccagctactcaggagctgaagtgggaggaatcacttgagcccaggagtttgatgcagcactgagccataatcatgccactgcactgaactccactccagcccaggtgacagagcaaaaccttgtctcaaaaaaaaaa

SEQ ID NO: 638740 - DNA, 626 bp, Homo sapiens
  misc_feature (517)..(517): n is a, c, g, or t
gttcgacggagactctcacatgtacatcagcaaattgcaacaagggtgccaagacaattcaatgaagaatagtcttcatcaataaacgggctgggaacactgaatagccatatgcaaaagaatgaagcctaactcctacctcataatgtacaaaaattaagtcaaaatatacaaagacccaaatgtaagagctaaaaccattaacactctatgaaaaaaggtagaaatctttgtgaccttggattaggcaatgctttcttagatatgataccaaaagcaacgaaagaaaataagaaatgggagttcatcaaaatcaaaaacttttatgcttcaaagtacaccataaagtgaaaatacagctcacggaatgggagaaaaaaatggcaaaccacgtatctgataaggaattggtactggtatatatagaacccttaaaactcagtaattaagacgactcaatttaaaaatgggcaaaggatccaaataaacatttctccaaagaagagatacaaagtgncaatagacacattaaaatttggtcgacatcattagccatcaaggaaatgcaaatcaaagccataaggagataccagttcacaccactaagatgggtgtatccagagcag

SEQ ID NO: 638741 - DNA, 382 bp, Homo sapiens
  misc_feature (329)..(329): n is a, c, g, or t
gtcgcccaggtgccgacggaccccggccacttttcggtgctgctagacgtgaagcacttctcgccggaggaaattgctgtcaaggtggtgggcgaacacgtggaggtgcacgcggccacgaggagcgcccggatgagcacggatatcgtcgcgcgcgagttccaccagtccgtaaccgcctgccgcctggcgtggaatccggctgccgtgacgatccgcgctgatcccccgaggaggtcctgtccataccaggccgcacacagcgatcgcccaggccccacacgccagccgcagctcaagtaaggaggagggctggccgcgcccgaatncaacgcgcctcctcaggctccctctattaaagccgatctgactccgcccaaaa

SEQ ID NO: 638742 - DNA, 879 bp, Homo sapiens
  misc_feature (4)..(4): n is a, c, g, or t
  misc_feature (136)..(136): n is a, c, g, or t
  misc_feature (149)..(149): n is a, c, g, or t
  misc_feature (151)..(151): n is a, c, g, or t
  misc_feature (185)..(185): n is a, c, g, or t
  misc_feature (188)..(188): n is a, c, g, or t
  misc_feature (199)..(199): n is a, c, g, or t
  misc_feature (207)..(208): n is a, c, g, or t
  misc_feature (219)..(219): n is a, c, g, or t
  misc_feature (221)..(221): n is a, c, g, or t
  misc_feature (232)..(232): n is a, c, g, or t
  misc_feature (238)..(238): n is a, c, g, or t
  misc_feature (243)..(243): n is a, c, g, or t
  misc_feature (257)..(257): n is a, c, g, or t
  misc_feature (263)..(264): n is a, c, g, or t
  misc_feature (272)..(272): n is a, c, g, or t
  misc_feature (295)..(295): n is a, c, g, or t
  misc_feature (298)..(298): n is a, c, g, or t
  misc_feature (300)..(300): n is a, c, g, or t
  misc_feature (302)..(302): n is a, c, g, or t
  misc_feature (315)..(315): n is a, c, g, or t
  misc_feature (317)..(317): n is a, c, g, or t
  misc_feature (324)..(325): n is a, c, g, or t
  misc_feature (327)..(327): n is a, c, g, or t
  misc_feature (343)..(343): n is a, c, g, or t
  misc_feature (345)..(345): n is a, c, g, or t
  misc_feature (440)..(440): n is a, c, g, or t
  misc_feature (526)..(526): n is a, c, g, or t
  misc_feature (535)..(535): n is a, c, g, or t
  misc_feature (539)..(539): n is a, c, g, or t
  misc_feature (544)..(544): n is a, c, g, or t
  misc_feature (560)..(560): n is a, c, g, or t
  misc_feature (575)..(575): n is a, c, g, or t
  misc_feature (609)..(609): n is a, c, g, or t
  misc_feature (614)..(614): n is a, c, g, or t
  misc_feature (717)..(717): n is a, c, g, or t
  misc_feature (719)..(719): n is a, c, g, or t
  misc_feature (726)..(726): n is a, c, g, or t
  misc_feature (796)..(796): n is a, c, g, or t
  misc_feature (843)..(843): n is a, c, g, or t
catnaccttagctatgtacttaatgaaccaaattacccaaacaaaataaacatggcaatataaaaatgttaagaatttacaaagctgtacaaaataacttaaaatttaaaaattagactgatacagtctgtaaganctcttcgagagancngtccaattacagatctatatacttttcttcaganggncaaagaaaggntgctttanngcttctctganantcattcttttngctggntcatnctccaccattttcngactgnngtcaaagngccgctcatgttcatcatcttgnggntncntaatttccttcgntngtttacnncntcttgttacatatctncnggctgatctgtgttcatcccagtctaatcgatcgtggtgaaaatatttacgtttcctggttttctgtatcatatgttttggtagcggtccacgantcctttccctccttgctaaatgctccttactatcgtgtgttggaaatacggtaaacccaagatagtattcaataagactgcccccnccgcccccncccnccccnggcttgggcccccccncgggcccccctcccntccggtgctctataatgtcttgtagataccaatntactntgatgttcgtcatcatatgttgcactaccaaagtctacaactttaatatctggatttattaaggtgcgttcatcacgttttattttgggattatacgcctctntntagtcanactgcacaaataagatgttttcaggctttaagtctgtgtgagtcaacttattactgtgccaaaaaattcncagacttgcatatctgatatgccatctttctgatatgatccagtcgnaatggtagaaaccattttctttaatgaagtcgtagt

SEQ ID NO: 638743 - DNA, 1157 bp, Homo sapiens
ggcgagaggcgagtagctgtgaacggcctagaggttgatcgcggcgctgttttctcggtgtgacaatcattatagagcaagaacagccctgtctgcggacatgactggtcgaagggtactctagaagagccgccgagacgtataagccgtgttgcgtgtcaaggaaggtgtggacaagaagcactcacgctctcagcagaaggtgagcccagtgatagagagagggcagaggattgcctttgtatgcccagggcaatggaggcgttattggatcgggaagcagaggtggttatggtgtgcaagactagatgccgaatttttcgctggaatagaaggctaattaccgacaaagagaagatgggtgcgtaagggctgggagattgtgttgaggcctaaaggtggaaggatcccagagacggatggcgttgggcctagttgaggacgatgcaacgtattttgatagctgggagaggagataacgaagaggaagagggccattgtgtatcgcagttgtaaaggttggaggaactacttttatcttgaactttgtgaacgaggaacatatggtgaaggccatagaaggagttacccgagggagagcccttagggttacatgtgtatattccttaacggcaaggaccagaaaaagaacggaagaagtcaaggcaggaacaattggggtgtgcggcagggtgaataggaggtcaccacggggggaaccccgattgtgggcgccaaccggtgttgcgcggggggggggcccagtgggtgggaaccaggccctgtgggacacatgcgctcgttctcgaacagagggacacgacgggagggggcaatgggaaaaggcgagggggggggggttcttggacacccccaaaataggtcagcgggcggggaggttgaaaggacgcgagtgggttaatggaaacccagcaaccaccgaaatggggtacattttacgacgcaccgacaatcgtgggggtgcccttaaggacaggggaggaacaccagggggaggggggccccactgtttaaatttgcgcgggggggggacagaggggcgggccactgcgccacaggggtcacacacctgtatgtaggtgggagcagctcggcaccagagaattggaaacaacgtgccctaagaacagaagggg

SEQ ID NO: 638744 - DNA, 116 bp, Homo sapiens
tcgacctagaggatcagctctaatttcttttgactgcggtgtggtggtgaggctttttaagtggttaaccttcatctaaatttttttctcccactggatttatagatcctctcgaa

SEQ ID NO: 638745 - DNA, 690 bp, Homo sapiens
atagcggggcggggggcgccacggaccgggcggcgggcgcggaccgcccgcgctcgtgcgccacgggcgcaggtgcggggagccggcccggagcgcagttccagtggggccggggttcacccgggcccgctcgttgaaccgaacccgacaaatgggcgcagacgatggagagccggacccggactgctatctccgtcgcctcaaacaggagctgatgtccatgaaggaggtgggtgatggcttacaggatcagatgaactgcatgatgggtgcactgcaagaactgaagctcctccaggtgcagacagcactggaacagctggagatctctggagggggtcctgtgccaggcagccctgaaggtcccaggacccagtgcgagcacccttgttgggagggtggcagaggtcctgccaggcaccacaagtcatgttacacacactcggactcaaaacatctctttggccagcaagcaccaagtttccatcccataggagtgtctgtggaagggatatagcccccttgaccaggacacagtcacatcaacagctgtgctcagcaggggccagagcgagtggaaccggatgactggactccacagtgatgtcccggggccggaatccgacagctctggtgtcaggggacaacgtcctgcacgacctggtgggccattggctagaccttgacaga

SEQ ID NO: 638746 - DNA, 495 bp, Homo sapiens
ccatgaggaaaaaacaccgtccaggaaaaccaaactaatgacaacggttgttccttgagaaaaaaaaacctccagcggaacacctaacaatggggaggtttgaaaaaggagcaaacacccccacccccagaaaaacgaagagattgagcagcctatccagaatgaagagaaagaccgccctttgttaggagttgaagtccaccagcctgcaggaaatcgacggcgacaggctcgccgacttgcccctaattttcgatgggccatacccaataggcagatcaatgatgttatgggtggagatggagatgatattgtaaatattcatggaggagatgagagaaatcagaagaaaacttagggagctgcagctgaggaattgtctgcgtatccttatggggaagctctctaatcaccatgaccatcatgatgaatttttgccttatgccttgactcctgccatatatcatgagattaatactgtgattcccgccggaa

SEQ ID NO: 638747 - DNA, 209 bp, Homo sapiens
cagctgacattgtccttcggtgggagaggagttcagtcaggctgctttccactgcgttaacccagccctgagggaggcaaagccccggaatctatgccccttggcaagaactcccagggttccaggcaggactgcccccgaacgtccgaggcatcaggcccagagcagttggctgatccaggtgccgtccttggggaaacaccaaccac

SEQ ID NO: 638748 - DNA, 350 bp, Homo sapiens
  misc_feature (3)..(3): n is a, c, g, or t
  misc_feature (10)..(10): n is a, c, g, or t
  misc_feature (26)..(26): n is a, c, g, or t
  misc_feature (28)..(28): n is a, c, g, or t
  misc_feature (49)..(49): n is a, c, g, or t
  misc_feature (59)..(59): n is a, c, g, or t
  misc_feature (109)..(109): n is a, c, g, or t
  misc_feature (123)..(123): n is a, c, g, or t
  misc_feature (197)..(197): n is a, c, g, or t
  misc_feature (199)..(199): n is a, c, g, or t
  misc_feature (221)..(221): n is a, c, g, or t
  misc_feature (229)..(229): n is a, c, g, or t
  misc_feature (233)..(233): n is a, c, g, or t
  misc_feature (247)..(247): n is a, c, g, or t
  misc_feature (258)..(258): n is a, c, g, or t
  misc_feature (264)..(264): n is a, c, g, or t
  misc_feature (272)..(272): n is a, c, g, or t
  misc_feature (277)..(277): n is a, c, g, or t
  misc_feature (340)..(340): n is a, c, g, or t
tcnaactccnaggttaaagcaattcncntgcctcaggttcaaagaagcngggactgcangcgtgagaaccaacacgccggcaaatttttgcattattagaagaggcaangtttcaccatgttngcaaggctggtatcaaacttctaacgctcaagtcgagaaaccccgccttggcctcccaaagtgctagcgattanangcatgagaaaccacacccagcntggcttcnctcnatgaatatgtaganatatgcctttngttatnactgtaanaattnaataatctgaaattttaaagttggagagaaaaaggcatttaatttgtctagagaaaatctggnataatggttc

SEQ ID NO: 638749 - DNA, 497 bp, Homo sapiens
  misc_feature (129)..(129): n is a, c, g, or t
  misc_feature (174)..(174): n is a, c, g, or t
  misc_feature (210)..(210): n is a, c, g, or t
taagggttggaggggggaatgggggaaatggtagaggggggatattgcggaaaacatgtgttcatatatataagtataagtggcataggggtgaggtggataggaaagtttttttcacatatagcgcangggtgtaagtgaagtgtggcggccgataaggcgagaaactgcganggggtatagtggcgtgttgtctgcgaaaatctctcnatataagagaaaatagcgaggggggaagaagaggttgttataagaaaagaaggtgatgagggggtggtcttcatttggtgggaggggaggcacaacaccaaaaaacaacaatatgtcatgatctggtgatggatggcgggttgggttgattgaacggaagcaaaggcatctctttcattccacggacgggagggggggacagagatgtaagagaactgcaaaggcaggcatggcagcccggcctaatttccacttcatgcattaatggtatggtgggttgggatgga

SEQ ID NO: 638750 - DNA, 883 bp, Homo sapiens
aatatataaagagtaatcttgactttcagcttcgagagcggcatccctgctggctactgcaccgtggatatatcatacagggtcgccagagtatagtgaacacactacatgagtatacaattcagtgaaggtccactattcatacacatctgtatctgtcttgccactcatgtttcctgcgtatgtgcggacccgttatcaacagaaggagtgctcactgtgcactattaatgccctaccaaattatagagatattctctcagagtaccaggctcacaatacacttactcttaggaaagtaactcagtgaatacttaaggaggcaccgttcctcttacgtgtcccagaaggaaataggactcacgaaaccacgggctgctaacatatggggcaatactcatcagaggattggggtgcagaagagatagcatgcaactttatgtgcagtcatcgagaacgcaaagatgacaacaaaaggtattggtacgcgagagccatgggagacaaaacgacgatagagtgcgaatccctatggggaaaaacgagaacggagcgtacctaagcaagaaacgaatcacagaggacagatgaagcagaaacatatgaaggcgaacacgcagtagataggacgcggccgtatctgtcgcaccaagctaagaactaagcggttggacaaaagcaccactttgcacagatggcggcacaaacactggggggacaatcaggcaggagaacgaccgggttcatatacaaggccgaaataggggagagaaacggttcctgcgcacgaacggaagatgtgaacattccatgttgacctcaaccctaaaagtccactccttgcatgggaacaggtttggccctgaaaagggaactggccatc

SEQ ID NO: 638751 - DNA, 131 bp, Homo sapiens
  misc_feature (93)..(93): n is a, c, g, or t
cttaaaacttcagacacgtagaccctcccgctggggcactgcggcaaccgcattgaactcacatcgtcgagggaaagatgatcaagtcgtctnccacgtacccggacgtcctgtacttccagggagcacta

SEQ ID NO: 638752 - DNA, 230 bp, Homo sapiens
cggcacgaggtttttttatagagttcgagaccagcctgggtaacattcaagaccctaactctataaaaaaatgttaaaaagcagcctggatggtggcatgcacctatagtcccggatactcaggaagctgaggtgggaggataacttgaacctgggaagtggaggctgtagtgagatgtgaacatgccactgcactacagccttgagtgacagtgtgagaccctgtctta

SEQ ID NO: 638753 - DNA, 104 bp, Homo sapiens
tttggtgagtgcaggtcttggtagagggcagaagcaggaagcgcgttcttggtgagggcacgaagcagtgaagcaggatcttgcatgagggcagaagcaggaag

SEQ ID NO: 638754 - DNA, 319 bp, Homo sapiens
tatctcctctccccctcccagagcccttcttctgcagcgcccctgccccactagcggcctcctcccctcctggcttcccttcccctctcggcctcccgtctcagcctccccttccctcttcttccttctcggcttcctcggctttccccgacggcctcccctcactgcttctcctcccccaccgccttcccgcctctcctcttctctccccacagcctcgccgccgcacagcagaaagccggactcccgcggctgcccgagcgcggaggagacaccggggccccgcgcgcagccactccttgaggccccgcagcggccg

SEQ ID NO: 638755 - DNA, 275 bp, Homo sapiens
gcttcccgatagccgacagagagccacgggtaagaggtccaggctgaggccctgtgcagaagaccatgacaaggcatcagccactgagcctctacccctgccgggaggacaggaccagctcctctcagctttctctcccatggaccctatgactcggtgcgtggtcctgtgcttcgaacatgaagccccatggcactgtggcaggactggaagggaatgtgctgagctggagcttggtccatgtcgaggctatgtcggggggggtacctgagctc

SEQ ID NO: 638756 - DNA, 265 bp, Homo sapiens
gcttcctcttgccttcggcacccccgctgcctcggctgacgcctatcctatgcagcattacttctacccgctgctcaaaggatggatccagttttgtttctcaccgctgcagggcccgccgtttgtcggctctgacacccagcgttgcctcctcctcgccaggcagtggtatttttgagtaccctctgagatttggtgtgtagcgaggtagatgcgtgccgtcagcctcaatgtacgtcttttacccatagccatcccatgagga

SEQ ID NO: 638757 - DNA, 967 bp, Homo sapiens
  misc_feature (551)..(551): n is a, c, g, or t
  misc_feature (591)..(591): n is a, c, g, or t
  misc_feature (636)..(636): n is a, c, g, or t
  misc_feature (654)..(654): n is a, c, g, or t
  misc_feature (775)..(775): n is a, c, g, or t
  misc_feature (967)..(967): n is a, c, g, or t
aattctctccctccttcctgccgtcccccgcctgagggaggggagcggtgcagcagacatccgagggcagctgggaccccctgactcagccgacgggtgagtcaggctccctgcaggccacaccggacccccccagggcggggatttccccaagatgagaaatcagccaccggaagtcacgccggaccttggacgggcagacagaggctgggaggagttctgggtgcagagccccccaacctgtgctctcatctcttgctctggggtaagccagtggccatgctataaggacactcaagccaccctatgaagaagcccacatgaagaggaactgagatatctggccaacagccagccagtcactgagcctgccaaccacgctgtggcaggtacctccagccccagacacctgcagcctccactgaaagctcaatggcagcctcatgagaccctggaccggaaccacccaacgaagcggctcctgtattcctgattgacagaaactacgggatcataaatgcttgctgttcagtctgccaagtgttggcgtnatttgttaaacagcaaccagtaactaatacgccacccatngtgccgcgttcctgctgtggggccagcactattccatgcttagangctccatcaatacctgtnatggactaaatggcacggtggctcacacctataatctcaccactttgggaggccgaagtgggaagattgcttgagcccagaagttggagaccagcctgggcaacacagcaagacccctgtntctaccgaaaatgaaaaaaattagctgggcatggcagtgtgcacttgggagctactcaggaggctgaagcgggaggatcacttgagctcaggagttcaaggctgcattgagctatgatggcaccactgcagtccagcctaggagacagagctagaccctgtctctaaaaataaataaataaataatctcggn

SEQ ID NO: 638758 - DNA, 854 bp, Homo sapiens
aattctctccctccttcctgccgtcccccgcctgagggaggggagcggtgcagcagacatccgagggcagctgggaccccctgactcagccgacgggtgagtcaggctccctgcaggccacaccggacccccccagggcggggatttccccaagatgagaaatcagccaccggaagtcacgccggaccttggacgggcagacagaggctgggaggagttctgggtgcagagccccccaacctgtgctctcatctcttgctctggggtaagccagtggccatgctataaggacactcaagccaccctatgaagaagcccacatgaagaggaactgagatatctggccaacagccagccagtcactgagcctgccaaccacgctgtggcaggtacctccagccccagacacctgcagcctccactgaaagctcaatggcagcctcatgagaccctggaccggaaccacccaacgaagcggctcctgtattcctgattgacagaaactacgggatcataaatgcttgctgttcagtcaaaaaaaaaaaacaaaaaaaaaaaaaaaaaaaaaaaaagggggggagcacgcctaagaataccccgaaggggggccaagaaaagcagagaacaccacgagatatctagaacaacaagggggccacatagagaggaccccggttgagacgcacaggcgacccggagccgccacgacattgacgacgccgccggaacacgcggcaacaaagcgcgaaacacagcggggcacaaggcggaagaagagcaccgcaaaaccacggggggggaacccaagtgaggggcgcgacgccccccacgagacatagacccccgggggcaca

SEQ ID NO: 638759 - DNA, 1060 bp, Homo sapiens
gcttgtactactggcggcccgcttcgttctttgcaactaaatctttctactggttactcttaggcgtccgacatgcctgatgatgagctataagtagctctaccgcgaacgtctgcagctacgctcctgaagtgagcgacgagccatgagcccactgggaggaagaaacaagtccagatgcagcggccttaagagctgtaacattcaccgccgcaaggtcctgcacggttcacctccctggagccgatgggtagtaccaggaacccacctacgaaggaaagaaacgtcgcggaaagcacatcctagaactatcagaaggagagcgaaatctcccaggagcgtcgcaagctttgtagtagttgcgtacaatctagcgccgctagaggtgtcccagtgggttcaatgtgttccacttgtcgggcgacacatagaagaccggactacacaatttcgggtagcttggctggcatgtggcgaactgcctgtgggattgaggtctggagcaaaaacggctagggaccccgtgggtccttccagaggcagaccaatattgcacagcgccggattggttcgggagacccacgccttgcaggaacaacaatacaggacggtgggtacacagggtgctccctcatgagaactcctgggggaaattgatatattggtcgcctcaagagaccgtgggacggaagtaattggaaatatagtctgtaggagagatgtgaagagctgatgcttgaaatataggtggcagagctgaagtgtcaggaaaaggttgtggagacatgcgttgtgaaggctaaacaatagcgtaatatagggggggggagaagggggaaaccattcggtgggcccgtgtccagagagcaggcggatattggggcctgagagaaggggtcggttgctgaagggaattcacaataataggaatgagatgtggaaggcgatatcatggtgcacattaggggaaggtgcttccatgcaatgcaggtagagagaaattcgccatgcttatgttcggtaaaattggggggcacaattccgtgccatcggaaaatgg

SEQ ID NO: 638760 - DNA, 546 bp, Homo sapiens
  misc_feature (354)..(354): n is a, c, g, or t
  misc_feature (546)..(546): n is a, c, g, or t
aattctctccctccttcctgccgtcccccgcctgagggaggggagcggtgcagcagacatccgagggcagctgggaccccctgactcagccgacgggtgagtcaggctccctgcaggccacaccggacccccccagggcggggatttccccaagatgagaaatcagccaccggaagtcacgccggaccttggacgggcagacagaggctgggaggagttctgggtgcagagccccccaacctgtggcacggtggctcacacctataatctcaccactttgggaggccgaagtgggaagattgcttgagcccagaagttggagaccagcctgggcaacacagcaagacccctgtntctaccgaaaatgaaaaaaattagctgggcatggcagtgtgcacttgggagctactcaggaggctgaagcgggaggatcacttgagctcaggagttcaaggctgcattgagctatgatggcaccactgcagtccagcctaggagacagagctagaccctgtctctaaaaataaataaataaataatctcggn

SEQ ID NO: 638761 - DNA, 581 bp, Homo sapiens
  misc_feature (529)..(529): n is a, c, g, or t
  misc_feature (532)..(532): n is a, c, g, or t
  misc_feature (549)..(549): n is a, c, g, or t
  misc_feature (555)..(555): n is a, c, g, or t
tagtttcttcctacccccagaagactaagaaatatatgaatataataacacatgtaaggcatattcccgagaggatatctatacttggtgtcctattgagaaatgtacagaaaatagtccctcaaatatttattttttgttaaacaccagcatatatttttgttacatgcataacctaatttagaattttcaaatgacaagatgtgacaatatcttctaattgctatgtcgcaaaaagaaaagaaactgccttcaacttataagtacttcatctgctattgagatgaaaaacctttctcaaacaggtttttttttcttttttttttcctggaaagttgcttctatatccataattgaccaaacttgaccaaacccatcttttagaaatgcctactttttaccacctggtcttgtataagtagccccacccaacaaactggatctgactacctgtccctctggaatgaggagctgggtgtatttccaaaggacagatgaatcaagcgtgtccctcgcacacaaaaactgnttnctcttccacatacaggnacactnaactaacagggaaaatcgaaaatgtg

SEQ ID NO: 638762 - DNA, 649 bp, Homo sapiens
  misc_feature (262)..(262): n is a, c, g, or t
aattctctccctccttcctgccgtcccccgcctgagggaggggagcggtgcagcagacatccgagggcagctgggaccccctgactcagccgacgggtgagtcaggctccctgcaggccacaccggacccccccagggcggggatttccccaagatgagaaatcagccaccggaagtcacgccggaccttggacgggcagacagaggctgggaggagttctgggtgcagagccccccaacctggtaagtacaatgatcccanggctaggacaccaacgagattttccaaagggcagacgagcttcagcggttcctccgaccccattccccacgtgtgggagccctcctccctagcggccccgtcctgcaatcgtccccctgcgcgaagacttccgtttatctccagcatggatggagggaaagtcaagctcaaacacaaggtccccatcagcaatggaacccaatgatccgctgggggttcaacattggggtgtcaggcacgggtgtctctggagcccagagaaaaatccaagattctttgaaatggcaaaagcccccaaaagtgactttcttgtattgccacgatgaactggaactgcctgaaaaattctaaaaagatagagaccttaataaatggtgtagagaagaa

SEQ ID NO: 638763 - DNA, 118 bp, Homo sapiens
gcggccgcctactactactactgctcgaattcaagcttctaacgatgtacggggacatgtttatgtcgtagatgtagttttcgcatccttgaattaaactgccttaactcccaaaaaa

SEQ ID NO: 638764 - DNA, 416 bp, Homo sapiens
tagaaaatattcgcaatctatctatctgacaagggattactaaccagaatatataagaaggtcaaataactcaaagagaaaaaaatgtaataatctgatttaaaaatgggcaaaaggaaatgtcaacaggcttttctcaaaagaatacaaattgcaaacagacatataaaaacatgctcaatagaaatgcaaatcaaaactacaatgagataacaccagttaagatggcttttatgcaaaagccaggcaataacaaatgctggtgagaatgcagagaaaaggtaacccttgtacactgttggtggaaatgtaaattagtacagccactatgcagaacagtatggaggttcctcagaaaactagaaatagaactaccagcaatgccactgctaggctgataggtacatagcaaaaaa

SEQ ID NO: 638765 - DNA, 379 bp, Homo sapiens
tcaagagcgtggtgtttgatcgggatgaaaaacaccacttaaaggaggcatttgcttatcagcgacaataagcaaaagcttgacgggtatgttattctctcaatactacttctccacttcgcaggcatatctattcaggagggcatcttgaaagaggagcagggtcacccacgacttcttatatctcctgcagtgcactggccaagtgtgtgtgtattgatatgcttgaagcccctagggttctcaacatgccaaatcacaaaggggttcaatttgtggcctgcaacattgcccccaagcaagactgtcatccagtccctaaaagacttgaagcctggcattgctttggtctacctcatggatcaaagtcctttcaggc

SEQ ID NO: 638766 - DNA, 107 bp, Homo sapiens
ggtcgacaaatgaagggtgtggctgtgatccaatataacagaaattctttctgcgactgtaagggtctgtgtgacccagccttttgtttgcctttatcattgaatct

SEQ ID NO: 638767 - DNA, 184 bp, Homo sapiens
ggactttctaagtgtgtgaagctatatttgacatttgcaagctgattaatatatacattatatctttatgtcacagtatattctctatgttggtgggcattttagttgttgcgatatttgcttttataaaccgtgtaagtaaacatcgactcctactgtacatatcaagtgattgttccccgct

SEQ ID NO: 638768 - DNA, 183 bp, Homo sapiens
  misc_feature (152)..(152): n is a, c, g, or t
  misc_feature (168)..(168): n is a, c, g, or t
  misc_feature (181)..(181): n is a, c, g, or t
acctgtgatgcctacgtgggaatgggacctcgaatgtgggaccccagcccctctccagctcgaaatccctccacagccacggtggacaccctgcacctattcccacggtgacatggctggacccagagactctgtgaccctggggcctcccncttgatgtagagaccnctgccctctgacntt

SEQ ID NO: 638769 - DNA, 139 bp, Homo sapiens
tcttctcccctgacactcccagcacaatcggaaaaataagaagaacaaaacaaaagaaacccctcctacagcacatttaatctttaccagatacaacatatgttctttagccccagacaaataggcagatgaaaataaa

SEQ ID NO: 638770 - DNA, 1639 bp, Homo sapiens
  misc_feature (13)..(13): n is a, c, g, or t
  misc_feature (880)..(880): n is a, c, g, or t
ggtgcatgcatcncttgtgtttcgtgctgtgtagctagcatcgtttttggttgtgcgctgcgctctccctccgtggggggatgttgtctgtgctcttgatgtgtggtcagacgtgggtcgttcgttttctcactaaccgccggctaaatttctcccctcgcgttattcgacgcggattttgggtgggttatatctccccggggaagtgtcttttcgccaccatacctaagccccccgccgcgttttataataatttgctggtcgctcttttgtggcgttttcacacctttgttcgccccgcttttttggggggaccgcaactgctggtgttggactgtgcggcgtgagagactcactcttgtgttggaggaccccagttgttttttctttattggggcgtgtcttttattccctccctcttaatcccgcggggtggacgcacttctgccacaagtggaaagcggttttgtgcaaaacaagatatccacaccagacgtgggggctttttaccatggggcttttctaaaaggcagctctttacccctgtgaaactcttcttttatctttgccccaggaatgacctccctgcttaaggcgaagaattttttttcccttgcggtccaagcctgtggtgctaacaacacattggggtgcccttgtgacaccttccggtgtccgcaacacaattggtccttggggaagaccttttcaccccctttgtttggggaacactgtggggaaaatcctaaatttctttaagagaacaatttggtttcttttttttatgggggtgggccttacacccaatgagtgattatttgttgggtctggcaaaatattttctcttggtgtccccccacacgagtatgtcctccccccnccgctgggtgttgtatagtatgtttaacgacccaacattggtgaagagagtgtactcctccacggcaaaggagggatattttttctctctctgttgggcgccaacgatttctctcttgtgtggttttgtggggaaaagacaacttctctgagcactcttataatttcttttctctagggtatcctgagcctcgtttgggtttttgggccccctttgccacaagagcgccacgagaaatttctctgagacagcctgtgagatttctcacgctatactggaggaaacgtttcacaatgttgtttatgcctcgcgttatgagaattcgcctggtttctgggacacatccacatttgtgcgttattacttcacgggcactttattagaatgttggagaagtttcacattataatttttcacgcgctcttcgataaaggtgtgaggcggagaaactcttctgctctttttcacggcacccacgcctgctgagaagaaagagaatcctcaccacgtataactaaaagcgcacgagttctttcttaaaaaaggagaccacaagaaaattggtgtgagaatgggaccacttatacttcacaatgtagcacgacttcttccccggagatataaaaagagaaattcttcactaatgaattataaactatattgaattaatgtcccccacagaaattctgcttttctactatattctttcagcacttagagatttttttgtttttgtaaaataccgtctgtgctctttga

SEQ ID NO: 638771 - DNA, 375 bp, Homo sapiens
gatccttcagatatctctctacgtggcgtagtttcccccagataccgtgttgcactaacacctaattcaactcatggctcaaatctcacttttttaaaagaggcccaggccgggtgcaatggctcattcctataatcccagcactttgggaggccgaggtgagaatcgcttgagcccaggagttcaagagcaccgtaggcaacatagcgaaaccctgtatctacaagaaatacgagtgggatgtagtggcatgcctgtagtctcagctactcgggaggccggggcaggaggaccaactgagactgggaggtggaggttgcagtgagccaagatcaccccactgcactgcagtctgggtgacagagtgagaccctg

SEQ ID NO: 638772 - DNA, 278 bp, Homo sapiens
atcctcctgccttagcctcccaagtagctgagatcataggtgtacaccaccacacccacctatttttttattttaattaattttttgtagaggtgggttattgctatgtcacctaggtttgttttaaactcctgggctcaagtgatcctccctacttgacctcccaaaatatggggattataggtgtgacccactgcaccttggccctctctaggatatttcaaggggaaaaaagaaaagcacagaacagcatgaatatattatgctgccatttaaat

SEQ ID NO: 638773 - DNA, 294 bp, Homo sapiens
ctagaccgcagagctctcattctaagctgaatcggaggagaaccagtaagctaccctttgagcatcatggacaagtagcatccgtagtatacttcacaacaatcctaatcctaatagcaagtatctccctaattgaaaacaaatatactcaaatgggcctaaatcctaatatgaataatgtggctgattgaaaacagagtactcagacatggggctcgatcgacgaccgcggacaatgtacaagagcacgagacgtactagtggacacgtgagccgtgcaccttacgcttggca

SEQ ID NO: 638774 - DNA, 235 bp, Homo sapiens
  misc_feature (29)..(29): n is a, c, g, or t
  misc_feature (168)..(168): n is a, c, g, or t
  misc_feature (173)..(173): n is a, c, g, or t
gcacacagataccatcccaccttgctttntgacaggccagccacacaataaccctttccctactcactaaagcatccctaggacaccaacaatgaggacaggcagacttacccccgccatctagagagaatgtcgttattacccataaaactcgaccacccccatatncactnttgggtaaaaacaaacgcttaaacctgtgagcctgccattcctttttacgtgttaatcaatt

SEQ ID NO: 638775 - DNA, 449 bp, Homo sapiens
  misc_feature (62)..(62): n is a, c, g, or t
gtgtgttgagagctctcagactaccaccttggggtcgctttgctgttcgtgatattagacanccagttgcggtgggtgtcatcaaagcagtggacaagaaggctgctggagctggcaaggtcaccaagtctgcccagaaagctcagaaggctaaatgaatattatccctaatacctgcccccccccttttaatcagtggtggaagaacggtctcagaactgtttgtttcaattggccatttaagtttagtagtaaaaggctggttaatgataaccatgcctcgtaaaaccttcagaaggaaaggagaatgttttgtggacccctttggttttcttttttggggggggcagttttaagttattagtttttaaaatcaggactttttaatggaaaccacttgaccaaaaatttgtcccaggattttgaggccccttaaaaaagtttaatga

SEQ ID NO: 638776 - DNA, 153 bp, Homo sapiens
cggtaccagcggaacagcagtgagtctcttaatggaacaaagtaagagcatgtcaattaaactttccttcaaagaaaggaaagaaacctaaatctgtgatggcaaatttggaaagataaatatttcctaagtcccatacatatgtgttatgtg

SEQ ID NO: 638777 - DNA, 159 bp, Homo sapiens
gctcgcagcgcaggcaccaaggacgcaggcaccatcacggggctcaatggtgctgctgcatcatcaccgagcccacggggcggccatcgcctagggcctggacaagaatgggctgcgcgggcggcgacgcagaccgtgctcatactttgaccgtgggcg

SEQ ID NO: 638778 - DNA, 1471 bp, Homo sapiens
gccagataagtttttttctctttgcaacagcatagcagattaataccaactacttcaacacaaatcatagtccacataggttactcaagcatattgcttagcgttcaagtttttaacgtcaattttcacatcagcttcaagcattttcaagcagcacacacatcatgcacagcacttagcaagcacgtcagccatgcaggcacaggcacacacagcatcacccacaggtttctcaacaaccatgaccggcaggtctcgcagatgcacagccttcttccatggcagtcaacaaaacatgtcattttcacaccagcaacacttgcaggagcacaaggcactaccaaggaagccccccgtcaatttaatcacgcacactagcacaggggccacatggcctctgccaccattcaacacatgcacagggtgcaccttcaagacgaagcttcaacaggctttctcggctcttcaaccaagttctgttcacggggtggatttacaacagtacctcatgcaacgggccggactcgtcttgtcaccacacaagaagaattctaaacccggaaagggttgcacttcacccacgaaccgtttggcaaacatttccattgcaccggccagggggcaggcactagggccgtctccatctccacacagacccctgacgttctcacaacgccaactctttcacgtctaagacccgccacgaactggaacgaattcgtgcccaccgcattcaacctctggcgtgcacgctcgcgtccagcgcactggagataccaactgtttgggcagcaacgattcgcaccgttccgagcacgccttgcgaacacacattgtgaaccacaccagcaacgtacaggggaacacgccgaacgaaccagcaactcagacgcccgacaccggggcacatccgcacgcatcagacacaccaacaccgtcagagagcaaccacgcgcatcccctccaccacacaggacacacgactggcacgcccgaaccaaccccagaaccacctcacgcaactccccacgccccagcgcccaagcgccacccgcgcgcacgcccaccgggcgcgcactgctccaggcctcgacatcgaaccacatcgcgacgcaggtcacggtcgacgacagggagcccgcggtgcaacacgcttccaccacagccgcaccacgtcacgcgacacatgttcacgccacaggcaccacacaaccccccccgacaccgtccgacgccggcacagcgagcagagcgcggacggcattgcaggctgctcgaacgacgcgggtagctcaagatccggcaggacgagcacccaacagcagcaggcgcttcgcacgtacagccgagccggcacggacgcacgccggcgcccgccgcgacccaggctgcgtcgctggagcggcaccgcgaaggcataagcagacgagaccgtccgccgcgcggcggcgggcaccctgcccgccgcgcc

SEQ ID NO: 638779 - DNA, 557 bp, Homo sapiens
cctagtccccgcgtgctcatgcctccggtgttatcatcaatacgtccagtctctgcagcacgttccaggtttcacgagcattgtagcttcactctctctggatctgaacacctgtgattctacggctctgcaatcattgctcaacttatcttccccatctcttcaccttgcgaggctccctatcgcgagaatgacataatcttctcagaataaaaatcctctgtcatagtgaaaacgtccagatagtcaatatcaggtgaaccagggcaccattactagaatactttacgaagatcaaaaaaagaaatagaagcatacaggtaatagtacatactactaggaagcctcaggatgcaggatttgcctgccatgaagctgcccctcagtacagagacagccggaagtccctactcccatattcagttccctgctcactgactggttaaactgtcggagggcttggtccagctgcgacgccaagaccaggctttcgacgtctattttagtatcttcttagcagtcctccgtcagttccccaactgatccggtctacactg

SEQ ID NO: 638780 - DNA, 134 bp, Homo sapiens
ggatttgctggtgcagtacaactaggcttaatagggattggatttgctggtgcagtacaactggactcgaattcgagctcgaattcgagctcgaattcgagcaagcttctaacgttagaagcttgaattcgagc

SEQ ID NO: 638781 - DNA, 680 bp, Homo sapiens
gttgaagccagtcaggagccctcatcgtagaggggacctttgagtttcattagcatggacactgcacaatgggtattgcggggcccatcccctccgtcagcgacctccatgagccttgggctatctgcagtgtctgaagtggctctacgggtttctgccactggacaacattgccttctcctacactgaggacatcatgtaagccagaaacagaagttgccttcgggattcattcttaaatggtaagctgggacattatgtcatcgccaagaaacaaggctcggtcaccgtcagcagtgttgcagtatttccgacctcctgcccagttcctcagtcgtggttgacccagatatctccgttatgcagccgcctccgggggacacaccgtctcctccctttgagtcagccacagacagccatacattgacggccccgctggcccccacaattccactgaactgtgcggatgccacagtgacaccctctcaggcacagcatgacctcctgaagtcgagcctgcttgctttgaacactaccagtgaagaatctcctcaaaatgtttggatacacagctccataaggccccatcacaggccaccgagctacactgacacagtgtgcgtgctgtgtgtgtgtgtgtgtctgtgtgtgtgcttggatagggcggggacgtcacctca

SEQ ID NO: 638782 - DNA, 368 bp, Homo sapiens
tgttttgtccttttgcattctaaagtctttaggtggatcttttggatatgattcttcttgcaataaattgccaagaaccagggtttcatttctgtacagagcaatttttaaaacttttcctttttaaacttttcctttttcctagttactaaactggcattttaacctctttttctccttttagctttgaatctgtctttcttaaacttgtcttttactctttttcttctcatatgtattaataactatagtcagtgttttatatttagtttttagtactcagcgggaggtcatgtaactaattgtcataccagggataaaactaataaggtgcccattttttgtaagtaaaaggaaccacggaagat

SEQ ID NO: 638783 - DNA, 682 bp, Homo sapiens
cgcggcgcggctggctgctgcgctccgccccggctgcattgctgcgctcccgtgcccaagggagccacgctgccgcgttcgcccggcagccggccgcccggaggcagcgcagttcctgctggcatgggcccctgggggcgccccgagctggggctccgtggctgaggcgctaaagcctgccctcccgccctgctggtgccccagcgtcccgttgcccgtccgccttgcccgccctgcggccatggcccgtccggcccgcgctgtgcgccaggcgcttcctgggcattacgtcctcgccgcttggctccggcgggctcgggtgcccacgcagagtgccaccgtggtcaacccagtgccttggtgccaatcccggagctgtttccccactttcctggtggagccccgaaggatgtgtccatcggtcaagcaaccaaggccagtgctgcttgtgttgcaaggccgtgcccgccagcgcacgatcttcttcaggtgcaacggggagtgggtgcgccagggtggaccacgtgatcgaggcgcagcacagaacgggaccagttgagcttgccccaccatggagggtccgcattaatgtcttcaaggcagcaggtcgagaaggtgtcgggcctgggaggacatacttggtgccagtgcgttggcactggagctccttcgggtcgcccac

SEQ ID NO: 638784 - DNA, 160 bp, Homo sapiens
aacttctagagagaaattagtctactgattggtataggtaaatggacattaaacttttttaaagtaaaggagatggtagataccgttagatatagtcttgaggttcatgtgaagccagtggtgttaaccttactttgattcctgtcagtcaggccctgga

SEQ ID NO: 638785 - DNA, 264 bp, Homo sapiens
tcaaactacccatcaggcactgtccttgaaccggatcacggtccacagtgagataaccagaacaatcagagtggtatttcaccaacgactccaccaccactagcgtggccgcatcaacgtctcccacctatcctacacaaaccgtcccaatcaccaataccaaactatagtaaaggtcccggggtctttccgtcctgctgcgcgtaacgagcatctttactcgtaatgcaatttcaccgagttcatggtggagacagtagggaa

SEQ ID NO: 638786 - DNA, 788 bp, Homo sapiens
  misc_feature (21)..(21): n is a, c, g, or t
  misc_feature (317)..(317): n is a, c, g, or t
  misc_feature (383)..(383): n is a, c, g, or t
  misc_feature (394)..(394): n is a, c, g, or t
  misc_feature (476)..(476): n is a, c, g, or t
  misc_feature (495)..(495): n is a, c, g, or t
  misc_feature (520)..(520): n is a, c, g, or t
  misc_feature (523)..(523): n is a, c, g, or t
  misc_feature (566)..(566): n is a, c, g, or t
  misc_feature (591)..(591): n is a, c, g, or t
  misc_feature (633)..(633): n is a, c, g, or t
  misc_feature (678)..(678): n is a, c, g, or t
  misc_feature (692)..(692): n is a, c, g, or t
  misc_feature (700)..(700): n is a, c, g, or t
  misc_feature (718)..(718): n is a, c, g, or t
  misc_feature (721)..(721): n is a, c, g, or t
  misc_feature (741)..(741): n is a, c, g, or t
  misc_feature (750)..(750): n is a, c, g, or t
  misc_feature (760)..(760): n is a, c, g, or t
  misc_feature (773)..(773): n is a, c, g, or t
  misc_feature (782)..(782): n is a, c, g, or t
  misc_feature (785)..(785): n is a, c, g, or t
ccccccccctttcttagtgtncatttccaaaataacgatagtcctgtatccatacattgtttcattgaaagaattctctattgcctcttcttggtagagccagagtccttaaggaaaatcaggaaaatgaagaaaatgatggtgccatcttgaccagacttctgcacagtaatttaacgctatcctagggagacttggttgaatgcacagttctgggatcagggtctaaatgtgcagtttctgagaaccttcaagaccactcactgggcagggctctgtggagcactggagctgtttggattccccagccctttggncatatcctggaattccgtggaggctgcagaacttagatgcagctgttttttacagcacctattttngtcagattggnaaggaaacactgagtcacagaatacttaagaattggagactccagtaatgtaggatggcctgagaggacgtccaagtcccanggggtggacacggcatgtncctcgggcacaggctcagtgggggnctnccccaggcgcagctcggcccacctgaggaaagggtgtttcggnagggcgcagccacaacacacagggntggcaggctcacggtcacgcccatcactccctgcccccactncccttgagaagttagtggtgtcacatccttagtcttattggcagnttgggattggttgngaggacancagtccactcttttttanatnatttcacacctcaatttaantggtttttnagggttttcngtttcccctcagntttacacgnttntct

SEQ ID NO: 638787 - DNA, 157 bp, Homo sapiens
gtacccacctgcagatgatagaaagtgatgggacaattaaacttaaaagataaatcgcttattacagccaaacttacacagataagttccaatatgccttaagccctgatagctcttctgatccctccactggatctccgggaaaccatggtaatca

SEQ ID NO: 638788 - DNA, 883 bp, Homo sapiens
gaaggacaaccctaagttctcgtttctgtttggaggcggacaaacagcagaagattgcccggctcctgcagctctgggaaaagaacggctactttgatgactccatcattcagcaactgcagagccctgccctgggacttggtcagtatcaggcgactctcatcaatgagtactcgtcagtggtgcagcctgtgcagctggccttccagcagcagatccagagcctcaagacacagcatgaagagttcgtcagcagcttagcccagcagcagcagcagcagcaacaacagcagcagcagcagccgcagccacagccacagccacagattcagctgcctcagatggaagcagatgtgaaggccacacccccaccacagcaccaccaccagcctcagcagctgcccccaccatcccaccaactacccagccagatgacaacaagcctcccatccagatgcctggctcttcagagtacgacacctctgcaggtgtccaggatcctgcagctgctggcctcgaggtcctggccccatgagcagatcccgcaaacaagccccttggtttgatcagcctcacccagttgccccttggggtcaacagcagcccctgagcaaccccatatccacacaacaaggtggaccaccgccattgcccaccctggaacaacaggccaccgaggcatgtggggttgaagcagcggaggggacccctggtgggaattgggcccaacaatgccgtgggacaaccaggccagaaatccattggattacctgtttgacgggccttgtaacatacagtaaccacgctggggtgtaccaaaggataccccttttatttcatgccccacactgggggagccacatttcacaaaaactacacgctc

SEQ ID NO: 638789 - DNA, 159 bp, Homo sapiens
cgcgcagaggtcctggagacggtggagttagcagatcagcttgaagaactatgatccccagaaggacacgcgcttctcgggcaccgtcagtctataaagaccactccccgcccataagatactctgtgatagtgtccgtggggggacaccagcagcact

SEQ ID NO: 638790 - DNA, 687 bp, Homo sapiens
cctggggaaagtccctttggattaaggaaagtaagtatattgtgttacgcgccgcgagtgtatgaaaatagcgtgtccatttatagctccaggatggcacatccaatgtttgttattattaagtagcgcaagagttacctatcccacgggtataattaacatggggggaaacacccccaggtatctaatgaggattaaatatatatgttttttaggcgttatatatttttcatggttaacataacgtatcaagaacgtatatttgttcaaaggagcattccccccgaaggcgcccccaaaacacacctgggggaactacaccccgcaataattcccccgtcaccacttccgagggacccactagtagggacaggaggtattgcgttctaggagagttataggggctgtcttttgggagaccacacgcccgtcgactcacacctagggcacaaagacacccttcttgtatgacgcacaatgtcttaaaatttcacgacgcgcgcgtatggttgtgactcccctgttaggtaccacagacgatatgcacctgacggtgccgggtgggggaggacattattactaggaggttctccctgggcggcggtgaactagacgcccaccatcctcattccgtgcccttggtacacagatatggcgagtctccctcgtcccatcaatagaacagag

SEQ ID NO: 638791 - DNA, 1038 bp, Homo sapiens
  misc_feature (773)..(773): n is a, c, g, or t
  misc_feature (807)..(807): n is a, c, g, or t
gctaatcccagctgggagcggcatccccagcccgccggcacggccgcctacgaactggtgctgatccggcacggcgagagcgcatggaaactggagaaaccggttcagcgggtggtacgacgccgacctgagcccgggggccacggggaggcgaagcgcggtgggcaggggctacgaggatgctggtcgtagtgcagttctgcatgatcacgcgttgcacctcagtcgctggaaagagacgcggagtccggaaccactcatgggatctggtgtctcaggactgtgcagtatgcatcagaaatgttggtcttgctcattctgcgatggaggtgatcgtgtggggcgaccgtctacatgaagctgggatcttttgcgtggggtctgagacccgcgtcgttcacatcatagagcgaagtgacacgtgctcggcgaaagacgatggtgtgacggtcgcccaggatagaaaggatcgtggacggactgcctgctctagttgagttgtccaccactcaactctcacgggatgggaggcgccgcgagcacaaatactcggtttgcattagcgaaggccaagcaagttcaagctaaagggagttcgtccagaggtaggtgcagtagcgcctcaagcaagtaagactcgagacttacgcccgtccatggtagagtacgctcatggagaatggagtgactaattgggccaagacggctgcatgcctcccttgcatggaagaactgacacgagacatacgtttccgccccagcagtgcgaaggnaccggcggaccagagctgttgttacttgattttngcgggagcccaagtgtggcaaagcagggccttccggggggtcgattggtcaaagccacttctgggatggcggtcttctcctgaaaggagtggctattcaatggaaggctgaagcttttgcggacctgggtatttccccagttgctctattgaatttgggccaggaaccttggaagcgcctattaagagcccacatgccaagtttctgggggaaatgaaaaggcccgttgcc

SEQ ID NO: 638792 - DNA, 144 bp, Homo sapiens
cgctagcggattaagtgaacgggttgactcctgcctgcagttcaagactcacagtccaggaggtgcctttgctgagaaacactcactaacatctccaggctgacttaaagatcccctccaggcgttcacttaatgccgctagcg

SEQ ID NO: 638793 - DNA, 250 bp, Homo sapiens
actacatacttccgcaggcggactattcatgctcaatgccgatctgcatgatcctcccacatgtgcgctaacggccaacgtttcttaatcgattctcgtacacgaagggttatatcgtgtggcctattgcgtactgagttgttttaccatgtcaacaacacatcattagttgggtaaaactaacctgtctcacgacggtctaaacccagttcacgttccctatcagggggggggaagtatgaagtcagaa

SEQ ID NO: 638794 - DNA, 964 bp, Homo sapiens
tactcgtgttaaatcttaccccgcctgtgtaccaataaacatcactctagtcagtcatcagtatcataggtagcgcctgcccagtgacacatgtttaccggccgcggataccctagagcgtgcataggtagcataagtcacttgtaccttaaatagggaccatggtagttgaagtggcatccgactgtatggtgtttcaaaacgtggttcgtcgtgtgacctttgttaaaccaggtgagcatatttgacccatgtggccgtcgaagaggcggcccgcctataacaacatgccacccacgagaaggacccgtatgcgccgctttaatttgagttgaatgcaaactagtactctaacaaactccaatgaggtcctatatatctaacacacgctctactccaaactaaacgtacacgatgcccagatatcaataggctcaaaggaccaagataggacgccaaaaactaaaagttaataacgtgactgaacgtcagcacctatgtatgcactctgtatgtgagccggcgacagacagaagtaggtaggtcatatacggccccaggggaggggtactgcccaccagaaatataatatattctagaggcccaatagcgtgttagtcatagggaagtgaacttgactcactgagtcatatagttttgcctgcaagtaatgtaaactgtagcgacactacactcttgttgtagggcacggagtcgaaagccgcctcaaagaacccggcacggagagcgcagtggctaagaccgtaaccgtaaagaaacaagacaataagcctcgaggaacaagcgcgggtcgcgagtgtagccgaacctaaggtggtccgcatggactatgatacgggtaggatagcagactttaaactaaaccgtagccctggggggaaagggcgccctggccaaagcaaagaaatcagagggggcgacgaccataaaaagtccccgaagg

SEQ ID NO: 638795 - DNA, 512 bp, Homo sapiens
catggctttaaaaaggaatactttaaaaaataggtaaacagtccagctgaatatttcgaggtgaattaactgaactgaagagctgcaataattaaactcacttagggaataacaatatatctgattaagccagtacatacctaaaaagttacgtaagcaactacaagtatacaagaatatatatgagattattacctattcctaatctgagcctcattgttcggtgcattagcataacatcgcgaaactgactttcagtagttgcatgtacattactagttatgtcttgcgtatgacatacatacaatctaatgaactcacatgcaatctagcaactgatggtgctgagaaattatctcttgctggctgggcgtggtggctcatgcctgtaatcgcagcactttgggaggctaaggcaggagaattgcttgaactcgggaggcagaggttgcagtgagccaagatcgcaccactgcactccagcctgggcaacaagattgacactgcatctc

SEQ ID NO: 638796 - DNA, 341 bp, Homo sapiens
gtgcgttatgaggctgcagtgcattccacgcctgtgctaagagtgatgactctgtctccaataaaaacaagaaaacaaaacaaataaaagaataacaggctgggcacagtggctcatgcctgtaaacccagagctttggaaggccaaggcgggtggatcgcttgaggccaggagttcaagatcagcctagccaaaatggtgaaaccccctctctactacaaatacaaaaattagctgggtgtggtggcatgcacctgtggtcccagctactcgggaggctgaggcaggagaattgcttgaatctgggagatggaggttgcagggagccgagattgcgccac

SEQ ID NO: 638797 - DNA, 159 bp, Homo sapiens
gtttagagactgctgaacaaccacatcttgacgtcagctatgtgtgctgaacgccatcgcttgcggggctgtctgtagagaccctggagggcacgacacgtggaggtgggctgcagcaggggacatgctcactaatcaaccgggaaggcgactcatctc

SEQ ID NO: 638798 - DNA, 238 bp, Homo sapiens
tttttagaaagggtttttatggaccaatgcaccagttgtcagtcagagcagttggtgtttttaattgtttaaaatgtcacctgtaaaatgggcattatctatgttttttttcttacattcctgataattgtatgtattgtataaagaaagtctgtaaattgggttataacactagtatatttaaacttacaggcttatatgtaatgtaaaccacaattttaatgtactgtaattaaaa

SEQ ID NO: 638799 - DNA, 297 bp, Homo sapiens
  misc_feature (29)..(29): n is a, c, g, or t
  misc_feature (146)..(146): n is a, c, g, or t
tgggagtcccaagctccctcgcccatttnactccatgaggataggaggggacagctgctgacgacctggcagagaccctgcgccaggccccaccccaccggcaccctgatcttgcacttccggcctcgagaatgcccccgcccggnagggtctgagccaggcagcctccccgggagccggtgctgacacggccagagaaaccattccagacccggaccccactgtccccaacaactgcgggccagtgactcagggcggtggagagagccaagaggaagtggaggcttgagtggccct

SEQ ID NO: 638800 - DNA, 242 bp, Homo sapiens
caggtactttccaaccatttccagatttcacctgggggcagcttcccgcccccaggaatcacctacaaactcacgggccttattgcaaccctcccccatttttttcaccttttcaccccctgccttcagggactttcttgggtttcccaggttttttccagccttccccagattttttccacagtcagcccttggcacccaagcatttcccgacaaagggttttaaacagaacccttttgga

SEQ ID NO: 638801 - DNA, 208 bp, Homo sapiens
aacagcaagcagtccaccccttcagcctcccaaagcactgggattacaggtgtgagtcactgtgctgaggcaagttatgtttctgtttagaccccagtagtaaatattttaggctttgcagaccatgtggttgtaactactcacctctgccattggagaacaaaagcagccatagacaatacttaaatgaatgggcacacatatggag

SEQ ID NO: 638802 - DNA, 287 bp, Homo sapiens
gaggacctctctttctccctttaccatctatactcagaggtttcttcattttatctgtgacctggcttatggtttcttgactcatctcttctataatggcagtctcaactcaagaaactggtttggaccacctatctttttttttttttggaaataaattcgtcccctgtcccccaggcagaagtgcaagggcgcaaacccggcccactgtaccctcggccccccgggttcaagatgatacacctgcctcagcctacggagtagctagaataataggcgggtaccac

SEQ ID NO: 638803 - DNA, 989 bp, Homo sapiens
tctgtgaaggaacttgaagtgatgcatgtgtgaatttaagataccgaagtcttaaagtgacctggacgtgaaggaaaaagtaagatgagaaataaagaaagccttggtaagggggttttaaaagccttatatgcaaacctttataatctgttgtttctgcaattgccatccttgtacagtgttaagagggtaacatgggtaaccttgtgcaccagcttcagggttaagctacacccggtaccttggaagcacccatgtcagtattagaagaataggcagcagttccttagttaacatatgtaggtgcaatatatttctggtacttatatggtacataaatttggtacagtattacaccaaacggttttgggcaacaaaaaaactttttcttgggcattcatttaatttacaggtcaaataacattttattacatgggggcctcatttgatatgttcctaatttacattaattgccatacgtgtagtgtaccagcattattagtctctctcaatataatagcatataattaaggtaaacaaagggaccttgccgttgcaccattggggccaaattttcacgctacagacgaaccagcatctatggggttgggggaacacttaaattgtgacatggcgatttgccacatgtaacataatgcgaaatactaggggtatacttacccgaatcagtggacaatttccaaaattggggaaagctttgcgaatacgatactgggagcacaccacgggaatatataccagacttgaaatatccgccatataaatacaaacggtggacgcaacagctaaaaaaaacgggggacggggcagcaaatacaaagggattgaatccccgtgcaaaaaacgaacttcccccgaaaagggacaaggggcaaaggataatacgttagcagaacaaacaagagaagagtcacatcgggacagcggacacagcggcggaagatcacggttggccacacctacaaaag

SEQ ID NO: 638804 - DNA, 364 bp, Homo sapiens
  misc_feature (73)..(73): n is a, c, g, or t
  misc_feature (78)..(78): n is a, c, g, or t
gaggcttgcataataaactcgccaatgattccctacagtgactcagatcattgcttatatactgaaagatgtnttatnatatacaattgttaacagaaatatcaattacgttatttatgcttatttaccattaactagtctataatgagggaagcaaaagtatttattcatttttaactggctcctttcttgtgccatgccatgttgaaatatattattgtcacttactggaaattctgttaatccctatattgttttcataataatgcattctatgctccagactttacattcttttgaccaccctttggctaagataacttccggtgctctattatgttagagatacgggtaccgagctcta

SEQ ID NO: 638805 - DNA, 96 bp, Homo sapiens
  misc_feature (4)..(4): n is a, c, g, or t
  misc_feature (25)..(25): n is a, c, g, or t
gaanacgggaaggcgaagaaaagantagagaagatagggaaaagaagataaaaacatacagaagaaaaaagataaaaaacctgaaaagtaggaagc

SEQ ID NO: 638806 - DNA, 244 bp, Homo sapiens
  misc_feature (30)..(30): n is a, c, g, or t
  misc_feature (66)..(66): n is a, c, g, or t
  misc_feature (77)..(77): n is a, c, g, or t
  misc_feature (83)..(83): n is a, c, g, or t
  misc_feature (86)..(86): n is a, c, g, or t
ggcgtcttggcgattcggcccgacgagctncgctttcgctacagcatggtggcctacttgagacangcttgactcanctacanccnatactcccagatctgtgcaaagcagttagagatgcacttaagacagaattcaaagcaaatgctgagaagactcttgcagcaacgtaaaattgtgaagtaagaggattattcaccccgactaagcttgaatgctacatcccagggaagtgtttggccaa

SEQ ID NO: 638807 - DNA, 160 bp, Homo sapiens
ggtcggtactggcatcgtagtccacaagttgctgtcttttctgtcccctcagtgcctagcctagctctgcctccacatcctcagaaccttcactccaacttgaaactgccctcttagtccacaatttcctgtcttttcttgtcccctcacggcccgagag

SEQ ID NO: 638808 - DNA, 200 bp, Homo sapiens
aactattatgcaatgggtattgatcatgatacaacctgcatggagccccttcacatggatggatgatgccccatgaccctgtagaaattgaaatcctgctcacaacattgttaggacttcattactaacctaggaccgtgattgagcccaagaaaccaggaactaacgcatatggccaatgtcaaaagaacagaactttg

SEQ ID NO: 638809 - DNA, 942 bp, Homo sapiens
ctcgccgaggcgcgtatcagtcggaattatggggagccaaccgcgccgtctgtccctggcaagccagcggcggtttaaaggaggtggcgggaagcctgtgtgtgcttcaaatcgtcaccctcatggtcgctccgatggcttgtgctggaggacaagcaaattgaggacactggcaacggagtgatcaaaatgatacgatcatgacggcctacaaactgaataaggaaacgaagagaagtggcagaggctgagaacagaaagagagggtggcaggggctgtaactcttgaagattagggtatacatatgagtatactgggtaagaattggaacgaatcgtgtagcgaggcagtagtcaacacaacgtagcaacgcagtcttggaagcagctagttaccaatatcaagagccaggtggctacccaggtggcagctataggtcattgaagctcaagaacactgagtctctagggcattggttaacgtcatctgtctagacttcacagttgtctaggatgataattcacgaagactgatctgtgccacaagtcaccaggtatacacgactgaaaacaacatagcaacaataagccaagatgtctgtggatccaatgacctacgaggcccagtgctcatggcttcaccgccaacaaaccgtgcatgctgtcggatctcaccatcgcattccaagacttacctattctgacgctgactccacgcccgtctgcaacaggtacttctcgacgaacgctggaatggcatcccacgactgtggaccatgtaggccccagctgcagattgcgcacaattgtctccaataagattcttttgctccgcgcgaacaggacataccggatcaccgttctgaggcagactaggaacacccggaagtgcgaccgtcgacgcaccgatcccctcacgaccacattgactctccaacccca

SEQ ID NO: 638810 - DNA, 90 bp, Homo sapiens
ggatttgctggtgcagtacaactaggcttaatactcgaattcgagcattcaagcttctaacgttagaagcttgaattcgagcagtagtag

SEQ ID NO: 638811 - DNA, 318 bp, Homo sapiens
actccaaagttcatctgacacgaggcaagcctctctgcctataagcctagaaaattgaaagcaagttagtatacttccgtagatacagtggggctacaggcattgggtaaatatacctgttccaaatgggagaaattggccaaaacaaaggggctacagcaggccccatgcaagtccgaaatccaatagagctgtagttacaccttaaagttccaaaatgatctcctttgactccatgtctgaatgatagcctttggacctgtaagattcatgtggcttgtagaaaatataaaacttcattgtgcctcgcattatatc

SEQ ID NO: 638812 - DNA, 187 bp, Homo sapiens
ggttgcaggcctaccaagaccctggaagagacagtttgtcttaggaaggctaagtttaaggctgaaacgagcagcccaatcaaatttgaagagccaccagtttgactctgttccatttccctgctacttcttctggggctgggactggccgctgaacgagaacgcctggccttgtactgatcttttc

SEQ ID NO: 638813 - DNA, 338 bp, Homo sapiens
taattctaaagatctcaacaatgacagcttcaacgagtggagtatttcactaccaagtttatacactacattcgtgcaaaggcaacatctggggatcacgaatagatatagactcaccaatatattgtgacagtggtaatttatcaatttaccaaatatgccacttcctttttttttgagacagagtttcgctcttgcaccctggctgcagtgcgatggtgcgatctcggctcaccgcaacccctgcctcccgggttcaagcgactctcctgcctcagcctcccgagtagatgggattacagacctgggccaccacacccggctaattttgtattttt

SEQ ID NO: 638814 - DNA, 171 bp, Homo sapiens
  misc_feature (1)..(1): n is a, c, g, or t
ncaagtggttcacagaaattttccgtcgacaactatcgttgtatggtccgccgaattccaaatctgttatacgctacagcattgcttgcattcactgctcggatgggatcagatcgactatcggtgctgtgtgcggatctgcctctccagcatctcgacgcaggttctata

SEQ ID NO: 638815 - DNA, 163 bp, Homo sapiens
ttgactcttagaaggatccccattgatatgcggatgagggcacagtaattacaaacttactatactgccatcccatacattgtgacagacctagttcaatgaatcttgaggaggctactcagtagacatgtcccaccctcacactgattctttacctttcact

SEQ ID NO: 638816 - DNA, 313 bp, Homo sapiens
  misc_feature (179)..(179): n is a, c, g, or t
tgagcaagctgtgaatactgggcacacaccaccatgcacagggagatatgagacatcaatcaatatatgtaagatgtacatcagtttcgtcgggaaggatgggacaacatgaagcagggagggggctcccgggtgacagggaattttctggtgggcaaatggtgagggagttcctggtncaaaaggccaagaaccgggatgactcatagtcaagaccctccaccagtaacatatatgggcgagccagccaggagaccactacaggaaacactccatttattccacctgacttcccagctggctcagaggggta

SEQ ID NO: 638817 - DNA, 243 bp, Homo sapiens
atcatcccgttttcctgtgtcatgcctgaatggcatctaatataaaatataatgggagtgtggggaggattggcacgcgtccttccttatctaagaaaaaggcactatcattatctggatctttcacacaccaattctacttctttcccttagacaaaacttagccacaaagctattcctagctgcaacaataatcagaaaatggacaccttaaactttataaattgtcacactgaggatgaa

SEQ ID NO: 638818 - DNA, 1725 bp, Homo sapiens
  misc_feature (649)..(649): n is a, c, g, or t
  misc_feature (998)..(998): n is a, c, g, or t
  misc_feature (1356)..(1356): n is a, c, g, or t
tcgtcgttgtctgacggtcgctatcatgtcctttgggcttttagtggtgttctgctcgatgtgcgatacctgtcctgctgtatgtatatcgtgtttgatcgtgcttctgtgtgtgccggtcgttgctgttgttttgaccattgtcgtctgcggtgctgtgcgtgtgctgttatatagcggctgttagccgtcagtgtcgcgggagcccatcccccgtggtgtgccgctctgatgggaagctcggggtgcattcatcctcgcggtgtttttatgctgtgcccccgggggcgtgataccttgtgttccccccggagcccctgctgggccccctgtggacctctttgttggggcgaccctcatttaggacccactggttgttgacacacgaaaataccggcggtgggtggctcccgtctctcggagaagtttccgcccgggagttttttgtgttggcgacctcactcgcggttttctctcactgtcccgccagtggctcctcccatgatagagggggggccctcttttcatcgccctctctccttgtgttgtcgctcttccgcccgcctatacgcaccatgtgtgggtggttgttatccatcgttgcccccgctccctctatgtttgcagccgctgcgtcttactcaagttnctttaagggccccgtccttcttgttgtgctgcgatgaccccgccgccgtgttgtccccacgttggtgtcgcccccatttgagttgggcgcccccgcaattgtgtcataccaccccgcgggtgtgtatgggccactcctctttgtcgtcacagggggcgcacgtacgcaagcaagccgagacccgacaccttgggttctccccctaaatagggccccctctttttcctgagtatttccccgcgcggggatatatctccccctcggttgtttaatgtgtactcccccctctcgcaagaagagggggttgttgtttttgctttttccccccaaaggagggagtttttttttntggaccgccccttgttgttaatcgcgctcgtgctacactgcccttttggcccccttagtccgcccccctccacttatatagagaggagcggcacacttggcgcgcccacacactacaggggtatctcacccccccggctgttttatattcgcccctctgtagagaggtgctcccacgctctctttgtgacacacccactccccgtgtgtgtatcatctctcgcctctcccgggagtgtgtctccaactctccctctggggcgtctctcccccaatgaggtgttatattaaggatacacccctcccgtgtacacccctagttatttctctagccacttgcggtttattcaccacagttnttactctgggtgcttctcttatatgttcacccgctcctctctcacatagcccttccagaggattccttcctggagattttctcgccttctcaccacatttctcggccggcgtatgtttccggcgtcacaaacttgttttgtgaagcccaccagggtttccccggagtttcaccgtgcacttattgggtcgcacactgtttcctccacctatgttgggtttcactgccccccacctagatagttgttccctcttacactacccacaacatccacctcttgtggcttttgaaacccccccctgatactggccttttgtaaatggggtttgactattttgcgtatgtttcccttttttgatagagggtttta

SEQ ID NO: 638819 - DNA, 124 bp, Homo sapiens
  misc_feature (20)..(20): n is a, c, g, or t
gggacatgaagacatctttngaaatgatgagattatttcctgtatgcagtcatttctgaggctttcttgcatcatagccggtaacatttcctcttagaaatattacactctacaaaattgtttt

SEQ ID NO: 638820 - DNA, 154 bp, Homo sapiens
gtggtgggtccacaacacgtatcaagtcggtcctccggaactgatacgtgttgtggatcccgcgtcggcatctggtcacagagtgttggtcgggtggttgattcctatgctatgtgattcgagtgatcgtggtagttagattacgattcatcct

SEQ ID NO: 638821 - DNA, 537 bp, Homo sapiens
  misc_feature (2)..(2): n is a, c, g, or t
  misc_feature (34)..(34): n is a, c, g, or t
  misc_feature (37)..(37): n is a, c, g, or t
  misc_feature (62)..(62): n is a, c, g, or t
  misc_feature (66)..(66): n is a, c, g, or t
  misc_feature (155)..(155): n is a, c, g, or t
  misc_feature (234)..(234): n is a, c, g, or t
  misc_feature (396)..(396): n is a, c, g, or t
anccttcagggttttccaaagttaacctggaagnggngcccaggaaaacgggccaggaaaangtanatttggtgagacaagttttttccacaggggtgatgtattgaaataaaccaatagatttcaaaaccagggcaagactggaaaatgtgacnttgaattcagatggtaccaaacatactgtggggagtttctccatttaaagtatcaagttgtattttaaccttgaatccntcttggagtgtgccagggacgtggaatccagcctctgtcacatcttggtcacgtgagttcagaacagtgtagcctgaatgacggcatggtctcatgggcaccctgagtccatcctggctcccactggccatgtgaatttcatcgccctcagcctcagctttntcagctatcaaaagagagaacacccagctcaaggcgggtgacaggaggatttaatacaataacatacatagtgttgtcaaagcttaatactttgttattgattgttgctattgttatcagtatagatactatttaaaccag

SEQ ID NO: 638822 - DNA, 163 bp, Homo sapiens
agaagtagacaaatgctagcttattttagcagaagacggtgataatagaatttagatactgttagtgatggggaataaaaagaaggactctatggaccacattatacatttaattatagatcatatcccacatgtgccataaagcagtagcatttaagcacgg

SEQ ID NO: 638823 - DNA, 976 bp, Homo sapiens
catctgtgtcactccctgcttgtgtcgacgctatgttccattctagatgcgtcgtgtcctctcttataaggaatgctgtttccaacaccggcctcctgtttcttacaaaaggcgcccctggtataactgccccgcgctcctttataggagggtgtcttgcccatatctggtgtttgcccgttgggcgaccgttttgtgggcaccccccaaccagggggttgtattcccacaagggaggtaccgcctcggttccggcctgtttgtccgcgactctagatggtgagcctcctcgttggggctcgcgatgtgaggtgtctccccccctgggcagtgcaggaagggctggtgtaattccctgtgtgcacccccacagcggggttcctcccccgtcgcagttaacggcaacccatgaatcccgggctaacccctccccaagggcttgggcgtccccccaacccgcatctcggggcgaaataggaggagcacaacaaaagcagagaacacacccggggacaaacgggcaaaccccccacactaaggtgttccctccgcgaggataagaataagtcgtccgtcccccctctggaatggtcggagacacacgaggaaaattccccacgcgaggtcccctcataccgcccattacatatcttctgaagagtccccaaccggtaaaatatgcggcctccagtaggcgctcgtcccccgtcagccacacgggggccacccgagaggagccccccgtcagataaatgccgtgtagtgtagggccggttggggaaacataattggtagccccgcgactagtaatacgatgattgataattccagtctcatgttatttcgggcaacaaaagtcgttagatgagtaatccccgcagaagtttgctttggtttgtgcgaaagcagatgaaaaatatcaacttctccttcccaaaaaaaaaagggaaatttttcaaccacaacaaacaaaaca

SEQ ID NO: 638824 - DNA, 400 bp, Homo sapiens
  misc_feature (26)..(26): n is a, c, g, or t
ggagtccgggtaggcagcgcgagtangcatgagatggctgtaccactgagggctccaccacatggtggctcagctgaatgagtgccaccagatgtataacggcgggtctcagggttgtcacggtctgcccagtctgtatacatgaacttgatggtctctcgccagggtgtccttaccctcaggatagccatacagattgtccacacaacactggagacggaacagccaaagccagcgccagagacaccatccctcaggttccaccaccccttccacaaacctgagaccctcgcccctggccgacacctagccatgatgctcactagctcgacgcgaactcgccccctgcctccactgagccactctcagggctcactcacggacctgaccatccccactc

SEQ ID NO: 638825 - DNA, 812 bp, Homo sapiens
gacgctgtgtcaaaaaaaaaaaaatgtttttaaaggcttttggtagaaatgagggtctcacagtttggcccaggctgatcttgaactcctgagctcaagagattcccccaacctgtggtctcccaaagtactgagattacaggtgtgaggcacagcactcagtctgaatattttcttttttaaaatggctgtacaatattctgtggtattggaaattatcataatttaatagatttagcattgcattacatttcttatttttttggcatatggtacagtaacattcatattttgggctttaaatgttatatgtttttatagttccaattctggacgtctcttatggggaattaaaggttttctaccatttcacctaaattatttttggttaaccaggtaagatacctttgtgacagcaattatggggtgggaaaattccttttaaattcttccaacttttggatcctttaatttggttctggccccaagcctaaatttgggcaacaattttatggtttaagcaaacactatttcggattcaacatctttctcaaagatattccaaactggctttcccatcagaaacaactcctttttggaactcattttcagagggtgtccagaatttacaaaattcaacagttttaacacaacgtggcaaaaagcagatacagaaaccaaggtacaactggatggggggataacgcataagtacctacctctcatcgcggaatcatccagagtctcggcgccatattacagcattattccccccatttacaactatcattaaccttttccagaaagcgaag

SEQ ID NO: 638826 - DNA, 392 bp, Homo sapiens
  misc_feature (315)..(315): n is a, c, g, or t
atctgcccgccacggcctcccaaagtgctgggattacaggcgtgagccaccgcgctgggcctgggcttctttttttttttcccaatcctgagggatccaaaacctgaggggagaggaagggacttaaaaaaaatctaagctcaactcttctctttccttacccttgactcagatcagcagttcccagagtgtcccacaggacacagtacagacattggggtccggtgggccggtgtggtccaccctcatccataattggattcagaatcaaaaaggggtatcgggataaattgtgggtatggtcacccaggtggnattgcagtgacaggacctcagttcagtgcagcctaaacttcgtgtgggtaaaagaaatcttcccatttaagcctctt

SEQ ID NO: 638827 - DNA, 1290 bp, Homo sapiens
  misc_feature (335)..(335): n is a, c, g, or t
  misc_feature (873)..(873): n is a, c, g, or t
ggctgtcccggctgcccgacctgacagccattgacgcgtccactgcagttcaaccgaaaggtgcccctcagtacgggactgtcgtgcacgtagtgtctagatgatagcacggccttccgtgctcgcgatgactatggagcgcgcccagaaagggagggcagagcgtccgtgactctgggatcggaggtgactcatcgtgccgtcgtccgatcggtacccgtgaacttccagatagggctctgaagggaatcgtgcatcatactcgttattcgcacacgtcagtcgataacaacgcctataggccggggcatcctgtcacaccaagagattcatancgcgacatccaatcgcaagaaagcattgtgctacctattgcatattgaaagacatcctggtccgaagcgatttcacttcggaacaggcacgcatgggatgctatcgtacacggcgctcattgatacgccctagtaggacaccttgtttgcaggacggcgccaaacgggcatcgtggtattatgaagaagttagggtgaataccatttgcacatggcgagtgtgcccacgggtggtacttgcttcttctcagcccacctggtgctgggcgaaaggggctctataggaccgataaaggggcgatgctatagcaacgaaagctaggcggggctgggagcaaatttctgaggcggttcaaatgttacgtcagggacgaatacgacatgagaaggcggagataaagtctttcggaactgaggtagtcgaagcctaaattgaaaagtgcgttaggtcgcaaaggatgcggagttcgacatccgggggcgccttgccatggaacttgtggggccaaccccaaatcagaaaattgtgcggcccaangcacatgggtcaaaggtgcggattgaaccattggcttcccgggagacaggcattgaagggccaacgggactgaacatgggcgcggtttggaaccccttgggggaccggcggtgcaagcatttggcatctttgaggcccgaagaattcgcggcccccacatggtgaccttccaaaggccctgggggcggaagcaggaaggcaggaagaaaccttctttggtcctttagaaaacgacaaaagacacagaaaaatatccccatatatgaggtgaggtgatgtttgtggaacttggcgcacagcttattagcaggattatctgattaccctagaggcacatgtgtctcaggaagaaggaccctttgtggaaagatcacttcatggtgggagaacaggaatttatccattcaccgatgtttc

SEQ ID NO: 638828 - DNA, 171 bp, Homo sapiens
tcgagtacgcaggcattctcttaaggaaaggttaagtaacatgctaaaaagaactcagccaatcttaccccgtcctgtgtaccacaagacatcatctctagcatcaccagtattagaggcaccgcctgccctgtgacacatctttaacggccgctgtacccttactcgtat

SEQ ID NO: 638829 - DNA, 616 bp, Homo sapiens
ccgtaggcagccatggcgcccagtccggaatggcatggtcttgaagccccacttccacaaggactgtgcagtcggctgcgtggccacgtggttcaaccagccggcccgtaagatccgcagacgtaaggccctgtgcaatgccaaggctgcgcctgatcgcccctgtgcccctgcgtcgggtcccatcctggcccatcgtgcgctgccccactggttcgggtaccacacgaaggtgcgcgccgtgccgcgggtttcagccttggaggagctcaggggttggcccgggcatttcacaagaaggtggcccggaccatcggcatatctgtggatccgaggcaggcggaacaagtccacggagtcccttgcaggccaacgtgcagccggcttgaaggagttacccgatccaaaactcaatccttctttccccccgaggcgaaaggtccccctttccggtggtccccccctgcaaaagcaaagcggcggcaggaaccacggttttcacttggcttgacggggacacgcttgaacaacccttgtgtcccgacccccaggccttgaaccccgggaacccggggtcattgcccctgtcccggaaaccggtcctattcaccaccgg

SEQ ID NO: 638830 - DNA, 253 bp, Homo sapiens
ttcacccctttggggggggggggggggcaaatttcttgagcccaggggtttgagcccagcctgggcaacaaagggcattcccgtttttccaaaaaaaaacaaaaattacccggatgggggggggtttgccggtggtcccccctccccaggggggtggggggggggggtcccttgggcctggggaatgggggttcccttgagtggggttggcccccctgccccccagcggggggggcaaagacccggtttccca

SEQ ID NO: 638831 - DNA, 317 bp, Homo sapiens
ggaatttccttcgtgaccctccggctggcgtgcaatttaatttcgactttgatcagatgtaccacgtggccctagtcatgctccaggaggatgagctgctaagcaagatgagatttgccctcgttcctaaacttgtgaaggagaggtgttctcgaggactactgttaccgcgtctcctgattagcagtcagccagctcacggcctgctgccaacagcaggccgcaggaaggaggagaggacactgcagaagcagatttccgctgcagagcagtacgcccaaacgcaccgttgtatcaatctagcttaaactagagga

SEQ ID NO: 638832 - DNA, 322 bp, Homo sapiens
tggacctgaaaagtcctataatcttgtgattttaacatgttatatagcagtgcgttaccttttctatgttaggtatgttggattctttgtttgtccgtttgtcgtttcctctgaggagtctcactctgttgcccaggctggagtgcagtggcgtgatcttggctcactgcaacctctgcctcccaggttcaaacgattctcctgcttcagcctcccgagaagctgggattacacatacgtgccaccatacctgactaaattttgtatctttactagagacggggtcctaccgccgctaggccgcgcttctctccaactcctg

SEQ ID NO: 638833 - DNA, 443 bp, Homo sapiens
  misc_feature (224)..(224): n is a, c, g, or t
  misc_feature (266)..(266): n is a, c, g, or t
gggttcaggtgattctcctgccttagcctcccgagtagctgggactataggcgtgagccaccacgtccggctagtttttttgtatttttagtagagacagggtttcaccatattgaccaggccagtctcgaactcctgaccttgtggtccacccgcctcggcctcccaaggtgctgggattacaggcatgagccactgcacccggcctcatttttttttattgnggtaaaatacacataacttaaaatttagcatcttaacaattngttttgttttgttttgtggtagtgatgtttttgtgagatgaggtctctatatgttgctcggactggtctcgaactcatgggctcaagtggttctcctgcctcagcctcctgcataactgggactacaggtgtgcaacactgcacccggctctatcttaaacatttttaagtgtatag

SEQ ID NO: 638834 - DNA, 667 bp, Homo sapiens
gcaacacttccacggaagccatatggaatgatctgctgcaatgctctgagccctaggaatcatcattcttgttcaccgtaggtggcctgactggccattgtattagccaactcatccactagacctcgttactaccacgacacgtacataccttgtagctccactgtcccactatggtcctatcccataggagctgtatttgcccatcattaggaggcttcattcactgatgttcccctattctcaaggctacaccctagacccaacctacgcccaaatcccatttcactatcatatatcatcggcgtaaatctaactttctttccccaccaacacatttctcggcctatccgggatgccccgacgttactcggagctaccccgatgcatacaccaccactggacgatcctatcatctgtaggctcattcatttctctacaacgccgtaatattaataattttcatgattttcgaagccttcgcttcgaagcgaaaagtcctaatagtagaagaaccctccataaacctggagtgactatatggatgccccccaccctaccacacattcgaagaacccgtatacattaaatttagaccaaaaaggaaggaatcgaacccccccaagctggtttcaagcccaccccctggcctccatgactttttcca

SEQ ID NO: 638835 - DNA, 301 bp, Homo sapiens
tcgcgatgtgcaacttgatgctgcaagtcaactctccacggatcccccctggttgatcaggtctccaggcaggcggatcgcttgagtgtctaggagttcatgaccagcctggccaacctggtgagaccctgtctctgctaaaaatgcaaaaactagccgggcatggtggcgcacacctgtaatcctagctactcgggaggctgaggcaggagaattgcttgaacccaggaggcggaggtagtggtgagcaaagatcgtaccgctgcactccagcctgggtgatagagcaagaccctatctc

SEQ ID NO: 638836 - DNA, 988 bp, Homo sapiens
gagccagcttgtccccacagcccctgagccccatcctaccaccgtccacagaccagcctgaccaacatggagaagccgcgtctctgctgaaggtacaaaattagccaggcgtggtggcacaggcctgtaatcccagctacttgggaggctggggcaggagaatcacttgggcccggaaggcggaggttgtggtgagcccagatcgtgccattgcactccatcctgggcaacaagagtgaaattccccatctcaaaaacaaagagataggtagagctggccgtggtggctcacgcctgtaatcccagaaggctgagttcggtggatcacttgagatcaagagtttgagactagcctggccaacatggtgaaaccccatctctgctaacacacacacacacaccaccacttccaaaacattcacccgggcatggcggcccggcatctagtacatcgcagcttactcgcgagaggctgcacggccaggcgacaatcgcctgacaccccacgagtgcaaatcgttgcagctgaactcgcaaccgccatcccagctagtctccaaacgaaacacagcttaacgactcagagttcgcttattaatcacggctccttccctccgtcggcctccctacttacaccacctacaacacgctattttcccgatgttcacacgagtttacttatccgaccgcaacttccccaagtgggtaccaccttcagaactattcccaagtagcgggcgacaatatcgcacgagccctctactccctggttcaggagtagcacgtcccctttatccgtgcgcacataacggccacccacaggaaacaggaacaaaacacaacccaggtagccgggctcccctcaggccaaagcgaagacccacgagcaacaacacccatccccccccacaccgacggcgacccagcacggaccccccacccccccgccccgcccacccacacctaaaccccccccccacccggaccc

SEQ ID NO: 638837 - DNA, 394 bp, Homo sapiens
  misc_feature (72)..(72): n is a, c, g, or t
  misc_feature (140)..(140): n is a, c, g, or t
  misc_feature (151)..(151): n is a, c, g, or t
  misc_feature (169)..(169): n is a, c, g, or t
  misc_feature (190)..(190): n is a, c, g, or t
  misc_feature (202)..(202): n is a, c, g, or t
  misc_feature (205)..(206): n is a, c, g, or t
  misc_feature (223)..(223): n is a, c, g, or t
  misc_feature (237)..(237): n is a, c, g, or t
  misc_feature (257)..(257): n is a, c, g, or t
  misc_feature (262)..(262): n is a, c, g, or t
  misc_feature (276)..(277): n is a, c, g, or t
  misc_feature (289)..(289): n is a, c, g, or t
  misc_feature (291)..(291): n is a, c, g, or t
cgtcgacagatcatccctggtcatccctactgcctctgatctggaggactcactaaacagagaacatccctngtcatctactgcccctgatctggagtactcactaaacagagaacatccctggtcatccctactgcctntgatctggagnactcactaaacagagaanatccctggtcatctactgccnctgatctggagnacnnactaaacagagaacatncctggtcatccctnctgcctctgatctggaggantcacnaaacagagaacatnnctggtcatcccnantgcctctgatctggaggactcactaaacagagaacatttctggtcatcccaattgcctctgatctggaggactcccgaaacagtcgacgcggccgcgaattta

SEQ ID NO: 638838 - DNA, 125 bp, Homo sapiens
catcaaaaaaaaaaaaaaaaaaaaaggctgggcacagtggcctcacaccttgttaatctctcaagcacttttggggagggccaagggccaggttggattcaccttgaggttcaaaagtttcaaaa

SEQ ID NO: 638839 - DNA, 322 bp, Homo sapiens
tgcaaggagccacacagcaggaggtgagcggtgtcgagtgagggggtgagggaagcttcgtctgtatttacagccactcccctttgctcacattcccgcctgagctccaccttctcagatgagcagcagcattagatgctcataggagaacgcaccctgttgtgaaccgtgcatgtgagggatcgaggttgcgctgtccttatgagaatctaatacctattgatctgtcactttctcccatcacgctcaggtgggaccatccagttgcaggaaaacaagcttaacaacgcccactgattctacattatgctccttggtcgtg

SEQ ID NO: 638840 - DNA, 552 bp, Homo sapiens
  misc_feature (186)..(186): n is a, c, g, or t
  misc_feature (412)..(412): n is a, c, g, or t
  misc_feature (458)..(458): n is a, c, g, or t
atggttataaggaggatataattcatgaacatttgtaaactacacatataacctggggcacacattatttccgcccaatctatgatactggtagagaaggaagcagcattgaaacttggagctgccatgaagatgggtagtatgcggagactgcagggcccaggcaccggttcctgtcttagccgntagcaaggtagaaccaagaaatgcagtcccaggctgtaagaaaggaaaggctgaagcctaatgcggaactgctgcagtagggtcacattacattacacatattctgttatggaaaccacgccttttggagcaaggtcaaaagcaaattatggcatgtctgggaaatgtcaggccttggagttttccaagattttccctcccttcttcctcatatttatattgcagnctgtggctgcctcaaaaccccagctttcttgaagaggggaaagaanaaaacctacacccaatcattagtaagtctattcaagtgcatatgtagttaattaggtttcttcatcggtctttcacatggggacctcactctgg

SEQ ID NO: 638841 - DNA, 274 bp, Homo sapiens
  misc_feature (48)..(48): n is a, c, g, or t
  misc_feature (90)..(90): n is a, c, g, or t
gggggatctagaggatcccgtactgtgggtaccgtgattccatctgtnaatgtctcatttgatgtgaacgttttcctgatttcatgaatngtctgtgttttcttgtagctcactcagtttccttaaaagagttttttgaactctttagcaggtaaatggcagatttccatgtctctgggttaggttaccaaaagattattgtgatcttgtggtgatgtcacagtcccttgatttttcatgtccttggagtttcgtgttgttgtttttgtatctg

SEQ ID NO: 638842 - DNA, 270 bp, Homo sapiens
tcggtacccctagttttagaagttcaatagcacattggaagccatgagagggaacgtgctgaaagacagggcgtgcatgtatagaggaggcagaaaaagaactagatctggagaatgactgagtcaaggtggaggcttgtgggaaggcttaagctgtgggcagtgaggtagggagaacgtgggatgacctaagaacagttacatgaatagtataggttaagagagcttgtgagtagggaagcgtatagaaagaagttcagtgcttagagg

SEQ ID NO: 638843 - DNA, 132 bp, Homo sapiens
aaggactaccccctattccttctgcatttgaattatctagaatatacttctgcatggagaaccaatgctagacccccgataccagacgagctacctcagaacagctattagagcacacccgtctattttgca

SEQ ID NO: 638844 - DNA, 942 bp, Homo sapiens
  misc_feature (340)..(340): n is a, c, g, or t
  misc_feature (358)..(358): n is a, c, g, or t
  misc_feature (430)..(430): n is a, c, g, or t
ggccgagcgcgccccgtccctcgcgcgcgatgctcccctggatggctctcggcctggaccctgatgcttgccgtgtctggggcttggcagcgtgagcgcgctgctggatcggtcgggcagtcttcataggagagcgcctggtgacgatcaaccaggatggtgcaacttagttcgatggcacccgtgcactgtaggcgcaaacgtttccatgagatgcctgatcacgtcgcgacgtgaccctcgagaccccgtgtccgagaaaagcagcctgcctagcgtttgatggtacgatggaatgatcctgctccatcatttgatccaatgtagccttgagtggcgncatccatcttactcgaancgcctgaatgcgtgttcgacagacaggcactccatatgaccatctggtacagagtcactggtccatgccggnttctccgtgcctgtggtcgctaggtccaacctccgtgtcgtgatctcggacaggcaccctcggggactagctaggttctggctggacggctgtcttccccacgtggcccagtccgtgggagctgcaatgacgccagacagctgccagggaacctggccacgggactggactctggtgcctggcctcgactccggacatcgtgactagcgactgtggcgctagtgcctgagtccaacgtgcgcctccttgaggccccagatcctgcgggtgcgcacgcggccggtgaggcagggccgggggcttcgggccctggagtcgggggctgggcctggcccccactgcagctcgccgcctccccgccccagaggaggccgggccaggagcgcatcgtcatctcccacgcccggccgcgcagctccgcgtgagttgggccccatgtgctgggctcagccgcggcgctcggctaccacgtgcagttcgggccgctgcggggcggggaggcgcagcgggta

SEQ ID NO: 638845 - DNA, 1759 bp, Homo sapiens
cttttttttattgtttttaaggcgaacaattggttataatgaaccagaaatacaagattccactgaaactagaacagttgacagaatatggttgaacttaaaccttacagagggaaacaagggcaaaacaacagcataagtgaggtggaaaagtccaagaattcagctgtgggcataacacatgcaggatataatgtgcatttaagcagtggcctactctttcgtgcaccctcttctccagaccagtccgctctgtgccactcatctcctcaccttcgtgacaacaccataccacaattcaacagtggacctctcgtgaatccttcataatactgtcgcagcaaataaaccacaacccaataatagtatacgcccttcgtggactcaatgtactacaacaccccagagaaaaggcgacacactcagtgctcacaactcctccctatcacccacagcggggcctccacacacagcgtgtcacaaaactcgaacaccgcacaacacaacgaccgcgcgagtcaaagaggggccaataagtagtgtggccctccactccacaaagtggtcacccagtggctcaaccccaaacttaatgcaactcgagacagcccccgagacaccatgggttcacccacccaactggaataaggcacacaacccactcctaatatgtgccgtgccaccagtggataagcgtgcatagtgttaccacaagcgctctcgctacaaagagtatccaaatgtccaacaccttctcactcaaacgtcgggtggcgaaaaaaaacaccggaccatctgtccttgaagaaaggacacgcccaacgagaaccccgcacaccataacaacacccactctcgtccaacaacccaaaggcgcacacaactgccgaaacacagaccgcgcacgctggataacaacaaacgaaaaacaccacccctaaaaccacaccacaggaagaaaccacccaaacaacggaggaacatccacgaggccacacgcagcacacggcagagaccaacacacccggacaccccacggagacacaaccacaccgggcggcgaccactggcctccaccccacaagcaaggagaggaccccacacacacaccacacgcgcggacactatccacacccccacacaccacgacaccacctcgagctcaacgaccccatcgaccatcccccacaccacaccatacactgacacacacaagaccagcacgagccgcaccaacacaccgccaagcacaaacaaaccaaaaacaaaaccacgagacgaccaacacaacacaacacgcacaccgacaggccatcacagagcaacaatccccgccgcatcccccaccgcacacgaacacgcctcacgccgcgcacaacacacacgagcagcgactagaaaacagcacccgcccccgactagctccccactgcacagaacgcaaagccagacaacgacaacaaccacaccaccaaacctcacacgagcgacacaccaaaaccggacgcaacccacacacacaaacacaacgtagacacacaacagacaacccagcaaaccacaacaccgacgacccacagccgcagcgagaacagagcaaacaacccacacacaagatacgaactaagcagcaacagatacagagacaacaacaccaacaccacacgacagaactaggacgcaatacacacacagcacacaacgacacaatcgaagaaaaagagcggcaacacaacaacaacaacgacacgcacaaaca

SEQ ID NO: 638846 - DNA, 252 bp, Homo sapiens
tgttttttcagcaagctagccgtacaaccattgtatctctttctcttcaggatggtttagagcccagagcggttagtaggctttcgttgtgttctctttcgatacatgtacatctttactgtttgaaaagtggtacagcgggcaaagggtcttcatgaacctgaagataatttcttgtgaagttgagtggagagtgtacggtcattgatagtgtttatatgagaatagcaggagtctgcacttttgctacct

SEQ ID NO: 638847 - DNA, 146 bp, Homo sapiens
tagtttaacttttcctttttttgctgtctagtcatcctcgtcggtcattctgctactgggaatcgacatcgtcatcctcatcatcttcagctgcccgatatgcccgaagctaactcagcttcctcatcttcatctccatcctcttc

SEQ ID NO: 638848 - DNA, 171 bp, Homo sapiens
ctgtataccagtgttttacactccaggtctcagagcactgggttgttctctgcctttcagcttgcttcgttggatgcatctctgcaacctgaactcccaggttcaagcacttcttgtgcctccgcctcccgagtggctggcattgcaggcatgcaccaacacgtctggctg

SEQ ID NO: 638849 - DNA, 534 bp, Homo sapiens
  misc_feature (5)..(5): n is a, c, g, or t
  misc_feature (31)..(31): n is a, c, g, or t
aaatnattgtattcaccttctcctacaaganggctcagcgagatctgggctatgagccacttgtcagctgggaggaagccaagcagaaaacctcagagtggatcggaacactagtgatgcagcacagggagattggaaacaaaaagtcacagtgatatgaagagggagaggacatggccctgggtgttattaggtcctccagaaagggacttagaaacaatccaactcttaacaattccattttacactctgtccaacttgtctttgggtcaccagaagccttgcaagtcactggcccagttgcaacccttcagctctaagcacttgtccagcaatgcacaagatgtgcctcagctgctgtgacccaaggataggtggctgatagtgagttgcctggaacctcttgtaggttagaatttcatcagggcttcctcatctcctttccatgtgccaacgcatttcgtgtctgagaaaattcccatacctttatgaagctcaaagaaaagaacaataaaatcttttaatgcttaaaaa

SEQ ID NO: 638850 - DNA, 350 bp, Homo sapiens
gatattcttccatgaacattatatcaaatatttctttgcccattactgagtggataaggcccaactctagagccctgtgaggaatattgtcatctggtgcccttagaattggacagataatcctcgtagaggctagccttatcggttccgagactggtccctgcacgagacggtgcatgcacctatctttgtctacgatcttctttcatggtggctgaaggaatctgctcggcggttgataatcaccaattccctacctgagggcttacaggcactcaagggtgtacgatccaccatgcaggaggagctgtatgcagctcatgccataactactgtgtgggcttgaccgc

SEQ ID NO: 638851 - DNA, 248 bp, Homo sapiens
ctcaggagcagttagtgaggctaggtgtggcatcggacgactgccagtctgagctggtcggagtctcagttaaagcttgtgaggacggggtgaggttggcagtgcccgctggagacctcaagcgaggagggatgagaatggcgctgagagacgtttggatggtgagttcaccagcactgacgttgaagagggccggacgcggacggttgttaggcagttgagttcccagacatcgcagctcatcaaag

SEQ ID NO: 638852 - DNA, 252 bp, Homo sapiens
atccactcaaaaggatggtagcttgaagaggcttcaaatcatcccgagccactgcaggtgtgctcgataggcattagggaaattctatcagaggatacagatggggatggactatctcaggtgggtcctggctaggaactagtaacgactactgtcacggaaggggatcaccacctagcacattgcctttgagtgcccagatgtgcctgcactccagacagtgggcttccggctagtcagacacaggcggcg

SEQ ID NO: 638853 - DNA, 825 bp, Homo sapiens
ggaccactgccttcaggaagcctctcgccggctacaagtccctgcggttctggggcagcgtgggccctgccagagtccacctggtggggcagggagccttccgagcactccgggcagccctcgctgcctgcccgctccatcagcacacttcacccccatgcgaatgacgcgggtccttcggcacaggcaccatggccacagatgtctgcaggagaggagtggtgtcactgagtcaagtcctgcaagcaagggcacacgaatcgcgcccaagaaagacaccatacgaacacgcgtccacatcataggggaccacagtgaacaggagatacggagaagacaataagaaacacaaagagcaacatgaagactagaagaccacagaaagcaaaaaaaacgcacgagatgacacgccagaacaaagagagcaccacaaaagacgggccgtagagacagcaaagcaatagacacgagagccacaatggacacgaccaagacgagcacacatacgacagcagcaaaagaacacaagcaagccaagagcaagaagaacaacgcacagagaggatcacccaacagaaagaaaacagagacaacaatagcagcaacgaaacagcacagcgcagcaacgagagacacagacgacagcaggtagagaccaacccaggagccgcgaaaaacaaagataggaagatcaaaacaagcgcaccaaaaaggaaccgggatgaaccacaaagcacacggggacacaccgacgcgagagaaaagacgcacaccacaagaacgagaagaagcaacacagagagagcaaaaagccctaacaagacg

SEQ ID NO: 638854 - DNA, 141 bp, Homo sapiens
taagttcttcacggaagcgatactctgagtacacagggacagcctgtcttatcaaagtgctcccagaaatatggcagtgcacagagagtgtgtctcattggagtacttgcgcttaattcatccaacagaaaggtactcttg

SEQ ID NO: 638855 - DNA, 726 bp, Homo sapiens
cccacgcgtcgcggacgcgtgggctttgctgggaaacagcgtggaagatggacgcacccatgtctgactacaacgatccagaaagagtccacccgtgcaccatggtgctccgtgcgttagaggtgggatgcaggatcttctgtgaagacccatgacatggtaaggaccatcactctcgaagtggagccgagatgacacgcattgagaatgtctaggcggaagatccaagacaagggaaggcatccctcctgacacagcagagagtttgatctttgctgggaaacagctggaaagatggacgcaccactgtctagacatacaaatccagaaagagtccaacctgacaacatggtgatgcgaacataagagcgatggagatgcagactcactcgaggacgacaccagaacctggaaaagcaccaatcaaacatagcaaaatggagccgaagtgagaccaactagccgaactgaccaaggacacaaagctcccaacgaaccaaaggaaacgggaaacccgacactggaacaagacagacaggcaagaacaaaagaccgagcacaacagacccggacaaaacagcgacacgacaccacggaacatgacacaaaacaaaaataaaagaaaaacaaaaacacaaccatgacaacacggagtgcaaccacaaaaaaaacgagagacaaccagaaaagacaaacgacacaaccccagcacagaacaaaaccaaa

SEQ ID NO: 638856 - DNA, 559 bp, Homo sapiens
  misc_feature (278)..(278): n is a, c, g, or t
gccgcgcctctgcaggcggaacagagccgccgccagggagccccaacacacggtccacagctcatcatgatggacttggagctgccgccgccgggactcccgatccagcaagacatggatttgattgacatactttggaggcaagatatagatcttggagtaagtctagaaggatttgacttcaatcagcgaccgaaagagtattagctggaaaaacagaaaaaacttgtaaaggctagacagagaacaactccaaagggagcaagagaaaggctttntcgctcagttacaactagatgaagagaccggtgaatttgttccaattgaggcagcccagcacatccagtgggaaaccagaggatctgccaactactcccaggttgcccacattcccaaatcagatgctgttattggtactaataaggctcagagaactggaaactgtggtggttaaggagccctggttggtttgaccgtgtgcaccagacaattcgccaggttgggaggagtattatacattccgtggtaaccagcctaatttacgacacgctggtgagcc

SEQ ID NO: 638857 - DNA, 208 bp, Homo sapiens
  misc_feature (77)..(77): n is a, c, g, or t
  misc_feature (160)..(160): n is a, c, g, or t
gccgggggcaagaaggtgaagaaggcggccaagccagcgtccccaaagtgcccaagggccgcaagtgagcgtgtcgnccggtcagagcggaagtgggcttttcggtgtttttgtttttctaccccaagtgacgtagattttagtacagctcacggaccanaacagtggtctaactaggaaaacccaaattaatttaactaaaccaaca

SEQ ID NO: 638858 - DNA, 707 bp, Homo sapiens
taggggctaggtaagctgggtttaattggacgaggcggcgcgctgattggcgcgcggtcagcggggggtgccgcgcgtatgggcctgcctaagtgccgagcgggcgcggtgagctggctgggtgagctgcagccaacatgtctggataccaaggtaaaagttgccgtccgggtcccggcccataaaccgactgagaactggaactgaacaccagagtgctgtaggtggagattggaagggaatcaaactggtcctgcaccctcctacctttctaacaccaaacagtggcagaaatgggaaacctcccaaggtacagtggaagtgtcctcagtcaaagcatgctcttgccttgcagaagcccaggtttcttgcataccccaggttggcctcagaatatctggcatagttccaagacccctacactttgtcataggtattatgtctatatctagggtcaagtattctttcctttcctgaggagccacatttgaaacacacacagggaataaaacacaacaggcatttctatcctccttatttgttccagtttatcgttactattcttggtctcgcttcgaaggaatttagtttcaggagagcgtatgtagttgttgccgaaggttagggagtagcgaaggcttaggagaggagatattgtatgtgagagtagtgagataggtggaagggaaggtgagggatattaagag

SEQ ID NO: 638859 - DNA, 1617 bp, Homo sapiens
ggcctctcaagcttggcgcttcgtccggtggggtcacacgcgggcttcaaccactgcgtatcgaacaagctgcttacttctcttgcttcggggcccatctatcctggaccacggcactgatgttcgctccgcacaccgactcgcacaggacgtcacgactccgcacacactctacacactgctcactaacacaaccctctcaccaccccgacacgccgcacacctccctcgccccaccgcctcaccgcctgcgctccacccccgcccctccccgcgccacacccgccacgccctgcgcaacccgcacccgcctctacccgcccgcgccacatacacccccacctctccgacacctctcgcaacaaccaccgctccccaccacctcgacaccacctacctcaccactacaccacgcccgcacgcacgccactacctgcgcccacctcacaccacaccctaccctcggcacctcgccgcaccccgcaccccgcacgcaccgcccccccccacccgcacaaccccctccgaccccacctcacccgcacacaggcccgcccacaacaccagccccaccacacctcccacaccctaccccgcaagaaccacccaacgccacctccgcacccccgccacaccacacacctcaccaccggccacgcccccccacccacccacacaccggctcccccacgcgcgaccctcactccccccccaccgaatccaccgcctaccacacacgcacccacacaccagcaccccgtaccccaactcacctccaacctcccccgccacgaccccccccctcccctcacagcacgcccgccaacacccgcgcaacacaccaagccccgcgaccccgaccaaccacacccgcgcctcaccccgcccacgccaccaccccacccgcacgcgcaacagctgggacaccacctcggcaccaagcccaccggcacctcccctcctcacaccaccacaccacccccccaggccccaacaccacacaccagcccgcgccacccccgcactgcctcaccccacctctccgccccccacgacggcccccccctcgggcacaaccaccccactgcgaccaccctgcacctcacaaccccccacgccgcacacaccctgccccaaccccctccaccggcgcccccaccctccccacaccctgcccacccaacgccgcgccacgcactaacacacaacgccaccccactgctctatctcccgtagcccatatggtccccaactaccatacacacgaacaaacgacacttagccggcactcacttcaccacgcgacacggcgcaaccgcggaccctgcggccacacccaccaagccagcgtccaaagacacctcgctccacacacacggcacatcagcaagtggcagacacgtaaccacgactacgacactgcgtatcagtcaacaccaccacctctcaccctgtcgatccgccacgcactcgcacaccccgccacccgtcgtcagacaccccctcccccccgggccgcacacccacatcagcgccgacccacggtgccccgcatacgaccccaccacagtcgcgccccacctaccaaaccaccggctgcccaccacaccccaacgg

SEQ ID NO: 638860 - DNA, 259 bp, Homo sapiens
  misc_feature (6)..(6): n is a, c, g, or t
  misc_feature (165)..(165): n is a, c, g, or t
ctacgntgcgatgacttccgcactgacccaagggctggagcgaatcccagaccagcttggctacctggtgctgagcgaaggtgcagtgctggcgtcatctggggaccttgagaacgatgagcaagcagccagtgccatctcggagttggtcagcacagcctgtgnttccagttgcaccatggcacgaacatccctttcaaacgcctgtctgtggtctttggtgaacacacggctgctgggtgactgttttaaggacaga

SEQ ID NO: 638861 - DNA, 477 bp, Homo sapiens
aggggaaattaaactgatttaatcagcacacattatatacatgtttcaaatttcacactccataaatatgtttaacttatatgtcatttaaaaataaggataaaattttttccagattcaagcgccttttgtagcgcttcccacagtcctcacatttggatgggttttctccactggggtctttttgttggtctttacagtatgaccggcatacaagcctttttccacagtcttcacatttaaatggctttttttggcaggggagttttttatgattcaaaatactaaaagcttgtttaaagcttttcccgcagttatcacagttataagatctctctcccgggggggttctaggggggaagtcaagacctgacttactaatgtggcccttcccacactcctaaaatttgaagggcttttctccaggggggcctcgttgggggaccaaaaaatttggggccctttttgaggtttttc

SEQ ID NO: 638862 - DNA, 214 bp, Homo sapiens
ggacttcagaatggcaagcagagaatgcagaaagcgaatttagctgccacggatgtatacctgctccagctgtgccactcggtcatctgtgcatgtgactgtgatgaaggacatctggcagatcatgttgtcctctgcttcaatgagcttaccccgatatacctcacaggtggtcgtctcacatgtcacaatgtgcccctcggcctctagtcgc

SEQ ID NO: 638863 - DNA, 236 bp, Homo sapiens
tcccgggggggcccccccccccttttttttccccccttaaaggacccggggggggttccccccccggtttttttttttgggccggggggggggttccttttttccccggggccccttttttccctttggccctttttgggggccccttttacccctttttttcccaaaaacgggggggggggggggcgggttttccggggttttttttccccccggggcccccccccgggccccga

SEQ ID NO: 638864 - DNA, 129 bp, Homo sapiens
cgatatagagatcctttgcgatgcaattgacctagagtaatgctcactttgctgaacttggctatactgcatgtccagacactcctgcagctccagttaatcattcacagtggattgccaacgtcgttg

SEQ ID NO: 638865 - DNA, 187 bp, Homo sapiens
cagcgcgtaccgggtctcatgacaccatgtgatctctccccagtgggatgcgtcggtcctgggtactgcttcagtttgtgtgggcggacggaatgaccgaagaagcatgctcgccctggtgctgcgatacggcgtacctggcgttggtcccctattaaagaagatcaagaagggcatcgtctccagt

SEQ ID NO: 638866 - DNA, 468 bp, Homo sapiens
ttggctcggggaaaaattcggttttttgccttcctgcacctcgcaaagtggataacgtggaggtcattcagtttacacctgtccttgccgactcagtcctgggcgaggggttatcagggtgatgccttagcgtgttctgagccattaggagacattcgtcatttggtgcactggcgaatcttacaaatggcgtttgtgtcagaagatctgcgacttcattccagctgctgcagatgctgacagcccctgggcggttggtgtgttgtagagacgcttgagcacctcatgtcgtggcttaggctggatgcctcagaacgagcagtccggacttgagtgaagcagctaattctttacccgtaaactccagttggaggtctgctttttgaaatgtccagcctttgcccaatgtgtttcagatcatctcattcctgcaggctttggcaggacatttaaaaaggttggcggccg

SEQ ID NO: 638867 - DNA, 351 bp, Homo sapiens
gtgtgtgtgaatgtgtgtgtgtgtgtgtgtgtggtgtatatattgtgtctgtccaccccagtggtagctgtagcatggcctctatgcatgaaatatgcactctatgggcactgggtgttgtcgggggatgtggccaccacattcactatgcataatcaaacatttgcttcatgtacatatgcatgtgttaaaaatgtcgagtagtaacattggctatctggtctgattgtgttgtgtatatacatggctgttgtctgcatgcaactcgtatagcaccttccctctgtcttacatttatgctgcatgtgccctgcatgtgggtaatcgtatatgtgtatcatgggtgcggca

SEQ ID NO: 638868 - DNA, 138 bp, Homo sapiens
ctatattcgcaatggtaggttaggtaggaagacggggggccgggtgaacaaaaaccacacggtctctatggaaatgtgtgagagaactgagagcgaggtgtggcagaagcaggcccggatgccggagagagggtggct

SEQ ID NO: 638869 - DNA, 168 bp, Homo sapiens
agtactataaaagcttgatcaaagattgaaaagttacactaataaaaaaactgaggcttacaaattaagtcaattttctcattgttctttaaacccaagatatattttttaaagttattgttataaaatgttaatactattttccagcctgaccaacggggaggaacg

SEQ ID NO: 638870 - DNA, 212 bp, Homo sapiens
ctctcaagagatagaagcgtggtcggtctgtcccagacatactaagctgctccagaatatccagcagtggttttaatttttctggcactgccttatctaccaggtcctctatgagaagttcccgctggggacctgaccaattggcaaaccagtgaagaatacacttcatctcctgggaggtgacgtaagacatcagaggaggggaagggtta

SEQ ID NO: 638871 - DNA, 590 bp, Homo sapiens
  misc_feature (2)..(2): n is a, c, g, or t
  misc_feature (66)..(66): n is a, c, g, or t
  misc_feature (497)..(497): n is a, c, g, or t
  misc_feature (500)..(500): n is a, c, g, or t
  misc_feature (553)..(553): n is a, c, g, or t
cngccggaggtctctgtggactgatgacctgttgatggaccagagagacgcgagcagctcgaagcnctgagcattgctccctgctggcgttgttcagctcccaggccgtcgagctgatctcctccgaagttcaggatactgctacgacacatcctttctgaagcctttcagagattgtggttctcttttataagctgatgttctgagcgagagcatactgaatggtataggagcactgttgctaaggcaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgtgntgngtttatatggagccctgaggcatctagctattatacttgggactctacctctnactcactatatgctaactcaaggccattcaacaagga

SEQ ID NO: 638872 - DNA, 624 bp, Homo sapiens
  misc_feature (599)..(599): n is a, c, g, or t
cccttagcacgaatgttgaccaccgaatgtactattcgccctggcgagcagttgcacgtcggcatggacttcaacatcagccggatggccgcgacggtgcatgtcattcgtgacggtctcccgctgctactcgaagaagccacgcaccttttcgacacgccggcgatgatcgtcgagctgaagcgccgcttctcggggcacagcatcacggtctatccggacgccagcggtaagaaccgcaagagcgtgaacggcagcgagtcggatcacagcctacttcgtgctgccggcttcatggtgatggcgaacccgtcgaacccagcggttcgcgaccgggtactggccgtgaacgccatgttcctgaatatcgaccataagcgccgctacctggtgaacaccgacaactgtccagtaaccacccaggtgctggagcagcaggcatacaccgaaaacggcgaacccaacaaggacggcactgaagacccggtcgacgcactcggttacttcattgtccagcgcttcccgattgcgggcagctatacactcgcaaacgtgagcaactcatgagcgcattcagctacctgaaagacagcctgcanaacctgtcgcagacattcgtgctaa

SEQ ID NO: 638873 - DNA, 147 bp, Homo sapiens
ccgtaccgggtaaggctgggctgaatgtggctatagagactgaatgaatggagcattatcatgatggaacaatgtctacattttgattgtggtgatgattccatgaatctacacagtgtagaaacatgtagattaacacctggactc

SEQ ID NO: 638874 - DNA, 1197 bp, Homo sapiens
agcggctgtctttctgcatgcaggaaccgcgcgtctgctggacaagaggggtgtcggtgagatactgacgctattgtctccggcctcgtcgtgaagacacaggcgcatctccccgctgtaggcttcctcccacagaatcccgtttcgggcctccagagcgtctggtgagatgctgttgtcgctgctgctgctgcttcccaatgtgctgggccgccggaggtctcgatggccccggggtcgtctccctcacctggggctcatgttgattggccccgaccatcgactcagttcacgtgccagtgaagtaggtgagcaaggctacgggctggctggcatgggccccaacctgttccatcgacacgtgcgcgctcctgtgcgggaaagagaccatggtgaccagcaactcactagagcgccagtcgctgacgagtacgctcagtggacgctgactggacgcgcagccgttctgtcccggagctcaccgcctggaagcgactccaccgcaggagcggaccgatgacgagctctagctggatgggcgccgagaacctcacgaaggctgaagcctgctcttgccagtgccgtccacccgcccctctgggcctgtctgtggctctgtggccctcctctgctggcggcaggacctttgtggggcttcgtgcccctgctctggggcccaggcggggctgggtccacattcccaggccccaacaagtcttcagcgatgggtaaggagcttgcctccccttgggacggagaggggggtgaggcgcccagaaacgggtaaggaaaggcaaacaccggagaggcatgaagaagccacgaaaaagccccaaaaatacagacggaaacaacgatcaagacacgaaagcgtgacactacatggaccaaagagagaacaagagccagccgacaagccattgtacagagaccaattaccgtaacctgggtgaaaggagggagacaaggagcaacgagacaagacaaaggaagcacccacagttagtaacacgagaaccagacgaaggacggccaagtcaacaggacatgtcagatatacaaatgaaaatagacaaccgcacacaacaaagacaaaaaacaaagaaagacaaggaaaacaaaaaagcaaaaggagaaaaaacagggaagaaaaaagaagagagaacgacaagaagaaagaaaacaacaacgaaagat

SEQ ID NO: 638875 - DNA, 572 bp, Homo sapiens
tgaggtcggcttcgctatgacagctcttctactgctccttcattttttagtccataattggaggagtgtgtagatgcaagggccgtgtacggatctaatattctttcgatttctctaaatcttcactccttctatcagcctctgttgagccctcattctggactgggccctgccttcccagtggcatgcacaaggaaacatggtcctcacttctgctggggcttctaggttagtggggagaagcatctatgaaatattcgtatgtatagaggtaaacctgcacctgtgggctgtggaagggggcctgtgaggttgtcaggtgcaacaccagaaaaacattctttgctgcaaatccattgctttagaaaggaccctcctgggtagtgatttgggatttagagtaggtttgcacagtggaggagagcagttagggtggcgacttttcatctaccagttgctatgaaagcttagggggctgttgatatcactcgggtgtaaagagaattatttcattgttcagttggttgagtgtagattttgttgtcacatatctttttctctttcctcttttt

SEQ ID NO: 638876 - DNA, 413 bp, Homo sapiens
atgttattcctttgtgtccatgttatttcactcccacttgtgagaacatgaaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatca

SEQ ID NO: 638877 - DNA, 434 bp, Homo sapiens
  misc_feature (57)..(57): n is a, c, g, or t
gtccccaaccccccgtgttggtgggggggggggtaccccaggggggcctccttgaanaatgtttccctcccctgggggggccaaaggcggcgaaaaaaagcccccccctggtgtttttttagacacaccctcccggaggggggggaggccccccaaatattgtggtgcccccccgcccccccttccgcaagagggggggggcccaatttggtgggggggaatttttttttttccccccccccccggggggggggggtttataaaaaaagcccccgggggtttttccccccccccgggggggggttctctcttgcccccccggggggggggggggggggggggttccccccccttttttaaaggggggccccacccccccccttgtttttttttttgggccccccccccccaaaaaaaagattgggggcccccca

SEQ ID NO: 638878 - DNA, 136 bp, Homo sapiens
gttggttgaccgtggcttgcagggaagcatctactatacggctggcagcctcctctatcaagtctgctcccttaggcagaggtgcgtcctgggcagagaccatgctaggtacagagggagtgctcctttctctgcc

SEQ ID NO: 638879 - DNA, 396 bp, Homo sapiens
ttaatattttttatcttttctttctctcttttaattttatttgagacccagccttactgtttcacccaggctgaagtgcagtggcttgatctcaactcactgcaacgtcagcctcctgggttaaagtaatactcccacctcagcttcccaagaagctggaacaacaggcgtgcgctgccatgctcagctaatttttgaatttttgttaaagagggggtacactgtattggcctggctgttctcaaactcctattgatggaataacaggcgtgaaccattgcacccggccctaatttatccattcttaacagttataatccttgaatagttcattaaacaaagtaagccatcatctcaattaattcctttgtaaatcctttctacagcctgtgaaac

SEQ ID NO: 638880 - DNA, 475 bp, Homo sapiens
  misc_feature (130)..(130): n is a, c, g, or t
  misc_feature (132)..(132): n is a, c, g, or t
  misc_feature (141)..(141): n is a, c, g, or t
  misc_feature (151)..(151): n is a, c, g, or t
  misc_feature (156)..(156): n is a, c, g, or t
  misc_feature (158)..(158): n is a, c, g, or t
  misc_feature (162)..(162): n is a, c, g, or t
  misc_feature (250)..(250): n is a, c, g, or t
  misc_feature (253)..(253): n is a, c, g, or t
gggcccgagaacaggaggccccagcattattttagtgttgtattgttcggtagggcagccactacccacatgtaactttttaagatttaaatttaaattagttaacattcaaaacgcagctccccaatcncnctagcaacntttcaagtgnttgananccangcatgattagtggttcccctattgaataggtcaaaagtagaattttttcttcatcccaaaaagttttattggacagtgtttttttagntcntcataagactccagagcccttttcaaagttcaggcatgttcatcaggtaagtgtggtattttgagctggggttttgagactccccttagagatagagaaacagacccaagaaatgtgttcaattgcaatgggccacatacctagatttccagaggtcatttccccttttttattttaagttatgttaagattattaaaccaataaaagctcttaaaaattca

SEQ ID NO: 638881 - DNA, 451 bp, Homo sapiens
  misc_feature (429)..(429): n is a, c, g, or t
taacatcgagcgaggaggcatgacagcactgtgatcttcatatactctgaagcacttcttcaaactttggtacttgtgtcatagatacctgcagtaggctgacaatgtggagaaactccaaaatgatatgtaactactactaggattactatctacgccaagtcgatcataactcatgatgcctacacacacaatccagaactcattatatagcctgtaagtcgctatactccacaggagataatgaacgagtactccagagtcttggcaaaatgacctagcatagctggatacatacagtggtagtcttgtactcatacctcagtggacttaaccaaaattgtgttagtctcaattcctaccacactgagggagcctcccaaataactattttcttatctgcagtattcctccagaagagctaaccanggcagggctgcatgagaagtgc

SEQ ID NO: 638882 - DNA, 864 bp, Homo sapiens
ggccgggggcacagtggctcatgcctgtaatcccagcactttgggaggccaaggcaggaggatcgctggagcccagtaggtcaagaccagccaggcaacatgatgagaccctgtctctgccaaaaaattttttaaactattagcctggcgtggtagcgcacgcctgtggtcccagctgctggggaggctgacagtaggaggatcatttatgcttgggaggtcgaggctgcagtgagtcatgatgtgtatgactgcactccagcctgggttgacagagcaaggaacctgtttcaaaaagaaaaaccctgggaaaagtgacgtatggctgtaagtctcatggttcagtcctagcaagaaagcgagaattctgagatcctccagaaagtcgagcagaaccccacctcaaacctcgggccagtgtcttcaggcttaactggggacctgcgagctgccctaatgtgttggctgcaaggccaggccatccctgggcgcaacagacgagctccgagccaggtcaggcttcggaggccacaaagctcaagcctcaggcccaggcaactggatttgtggcaagagggggccactacccaagggctagctagggcccaagaccttagtacccagacagtgagaagcccctggagggccagaaaagttggacgcattgcagacagggcagggaaccctttccgcggcaagcaactgtttcacatgtctcagaagcaagtcaggttcatgaaaccgaagtgtctttgcgtgccaaaagtaccaggtgaccaggctcacaggatttgtggacgcgggataaaaattccccgaatggctgggcgccagctgcccgtaaacactgttccacaaacgaat

SEQ ID NO: 638883 - DNA, 292 bp, Homo sapiens
ttaatgacaaataataggctgtaactttattattactttttaaagtactgttgtaagacatatgtcttaaatttttttttaaaagatggcataggggaagaaggactgggagctgtaggacctagctggccatttcagctttaggtttaatatctgtgtcactaaaaaaggacataacaaaaaaaaaaacaaaacccggctgaacaatgtgaggggactctaactgacccttttcaggctgagtgttcacattacaagtttggccttttaatttacaaatggaaactggctt

SEQ ID NO: 638884 - DNA, 757 bp, Homo sapiens
  misc_feature (37)..(37): n is a, c, g, or t
  misc_feature (68)..(68): n is a, c, g, or t
  misc_feature (130)..(130): n is a, c, g, or t
  misc_feature (173)..(174): n is a, c, g, or t
  misc_feature (185)..(187): n is a, c, g, or t
  misc_feature (191)..(191): n is a, c, g, or t
  misc_feature (202)..(202): n is a, c, g, or t
  misc_feature (205)..(205): n is a, c, g, or t
  misc_feature (208)..(208): n is a, c, g, or t
  misc_feature (213)..(213): n is a, c, g, or t
  misc_feature (215)..(215): n is a, c, g, or t
  misc_feature (217)..(218): n is a, c, g, or t
  misc_feature (222)..(223): n is a, c, g, or t
  misc_feature (225)..(228): n is a, c, g, or t
  misc_feature (232)..(232): n is a, c, g, or t
  misc_feature (237)..(238): n is a, c, g, or t
  misc_feature (257)..(257): n is a, c, g, or t
  misc_feature (276)..(276): n is a, c, g, or t
  misc_feature (350)..(350): n is a, c, g, or t
  misc_feature (386)..(387): n is a, c, g, or t
  misc_feature (408)..(409): n is a, c, g, or t
  misc_feature (436)..(436): n is a, c, g, or t
  misc_feature (458)..(458): n is a, c, g, or t
  misc_feature (472)..(472): n is a, c, g, or t
  misc_feature (474)..(474): n is a, c, g, or t
  misc_feature (561)..(561): n is a, c, g, or t
  misc_feature (575)..(575): n is a, c, g, or t
  misc_feature (621)..(621): n is a, c, g, or t
  misc_feature (627)..(627): n is a, c, g, or t
  misc_feature (653)..(653): n is a, c, g, or t
  misc_feature (657)..(657): n is a, c, g, or t
  misc_feature (659)..(659): n is a, c, g, or t
  misc_feature (682)..(682): n is a, c, g, or t
  misc_feature (734)..(734): n is a, c, g, or t
tgcaaaaaaaaagtaacgaaaaccttaaaaatacaanaatctgaatatatgtaagaactaagcctccnaaacaatatttaaaatatatttaactttcaaatacatttataaggaacaccaatagtgaganaataaagtcttacaatttaaatacaaatcaccatatacccccnncccgccccccnnnccancctatcttacngcngtncaggngngnntgtnntnnnntggntctgnngcacagcactgctgtgtancacagctctgcctgtcgcnaaactgtcagcccgcacagccaaatgacagctgcgtcatcaagagaaagagagaatggttgcagggggcacgtnctcccctcttcactctactcaagcatcaagacccgnngctactttgctttgctctagnnaaccatagggcccatcaccctgttcanaaacaagttaacccgtcccagngcctctccagggcngntcatttggtgctctgctccaaggcagagtactccgtctctgggactctggaggcatcgatgagcttggtgagccctgttttggccgngtacttgaagatgngggacttcatcagctcgtacctgtagttgcgattgatgaagctgtngggggnggggttgacgcagcagtacaccagcnacangnactgtgtgacatgcagggccgtnaagagggcgtgctccagccggcaggtgaaaggaatgtagtgcaggatggagnagatgtccagcagcaccgccacg

SEQ ID NO: 638885 - DNA, 383 bp, Homo sapiens
cgattcagctgcaggagcatgatcttctgcgaggaagtcagcactcctgttgattcccttccggcctcctgatgagattctcttggctgaggcttttcatgcattcaggtacttagcatggtgtctgatgtggtcagcgatgaaagttgcaatgaagtagtagctatgatcataaccctcttgtagtctaaacacaacagggattttcttctctgtgcaggcagctatgaagttatcagggagtaactgcccatttgaaagaaactcgtcatcttttccttgatccgattaggatgtcaatctgggaaccccgaataggccttcacgagacaggtcgcatcgtatgccttccatttactttcatctggtccccaaaatatcca

SEQ ID NO: 638886 - DNA, 164 bp, Homo sapiens
tagagctcggaccataaggcgcgtcatggatgccgggataacccacctggcgtgatgtgtgccctgtaatgcacgtgggccctgattcgctgatgcctgcctgagggtatgcgcttatcggcgacatcagcctgcacttttcttatatctcgtgatctctctgg

SEQ ID NO: 638887 - DNA, 290 bp, Homo sapiens
cgagctcggcacccgtacctctttaggaagtggaggccggcagatagcttgagtccgggagttggagaccagcctaggcaacatggtgagacctcttctctacaaaagggtacacagttggccaggcatggtagtgtgcacctgtagtcagttacttgggaggccggggtgggagaatcacttgggcccaggaggtagaggctacagtgagccatgatcgcaccactgtactccagcctgggtgatagaacgagaccttgtctcaaaaaataaaataagtgaatttacac

SEQ ID NO: 638888 - DNA, 366 bp, Homo sapiens
tttttttttttaacaaagccatggccatttgaaaaaaaaaaaaagccttttaacaagtatcgtttagaatcatggttatattctacacagtgcattgaatttaaggttctcaaggctgtcttccatatactcagttctataaagagcagcctcctctctagaaagttgtttaaaactaggagacttgagatgcaaaatgctgagagattcagctcaaacaaatatatcacctcttgccctttaccttgtcaaggctgaacagtcttgaacaggcctccaggttcccagcccatgccctgctactctccttttatgtatcatgccgatcaaatgctggaagattctttccccttctgtcgtcttctc

SEQ ID NO: 638889 - DNA, 399 bp, Homo sapiens
atagacttaaaaaaaaaaatatggttttaaaaaaaatttttaataaaaaactaaaaggggtaatataaaggggaaaaaacacagaaaggacgccttgcgggcggccttcggccgatttgattttggcttcggctgggctttgcattgcggccttattggtccgattttgggtacatggggcctttttgggggtctattgccagtcgattggctgtttttttacggggaaacccctgggataccctgggtgtatcccattgtagcgctttgtgattacacccgctgttgtaaagttgatgagtctccaaaggggccccttcggaaggtcttgcccaattttatggcgtctcggaagtcgatggtgaattgtaggggataaatttcggttaaatttggggt

SEQ ID NO: 638890 - DNA, 240 bp, Homo sapiens
tctagatatcccgcttgtgtactctcccacctcagcctccgagagctgggatacaggcgtgacgcacatcgtggctaattttgtattttggtagagacgggctcaccgtatgggcaggtgccttgaactcctgacctcaagtatatgcccaccttggctcccaaaatgctgagatacaggtgtagccactgacctggccggccagtgttatcacaggtccttaaaagcgaaagacaggca

SEQ ID NO: 638891 - DNA, 153 bp, Homo sapiens
ttacatatacgaatcgagctggtccctcgatagggcaaccgcggttgggcatgcctgtaatcccagcactttgtggaggctgagtgcaggcggatcacgatggtcaggagatcaagaccatcctggccaacatggcgaaatcccatctctact

SEQ ID NO: 638892 - DNA, 168 bp, Homo sapiens
atcatcatggtatatgatgtctactatacatttgtgtgcaattgctgatatttattaggattttgcatctaagttcattagtgatactggcctgtatttctgtgtgtggtatctttgcctggtttcggtatctgggtgatggtggcttcagagcataagcttggaagt

SEQ ID NO: 638893 - DNA, 1365 bp, Homo sapiens
tggagagctgagcagtcaagatgtgtgacttcacctgaagaccagacctgcagagttcaatggagtgccttccagctgttttgacctgaacatgtgtgatgtgcaatgatcctgtacatgaacatgatgtgtggtgattgttgattgatgtgtgccctgtgtgccagaacccgtaccaactgccgatggatgctcaaatgtgtccttggtgtgaaccccaagatgtgattgacgactgcaattgttgaaagtgtgcattggagctatatgatgcagcatttcattgcaccaattgcattgcaggaacaatgttggaccaaggaacaaatgtgaccccatgatgggccaccatagttgagagaattattgtcggacagtgacacttcgcggttgctttcggacaacgtgaacggcaaactgtgcagcctgtcaatggagttgcgtgaagatcgcggcaatgtatctttgattcaacaacttgtggttgacagacacgatgacacgacgggaactcgacacgtacgacgcgactgcttgggtgtgcacggggcactgcaggagcagggcaaaatggagattattattcacaaagattaattgacaggcaggctccgatcacgaaaatggattgacatggaaatatgggcgtgaagtgacgccatatacacaagagacatacccacacaagaaggtccagtatacgcatatctcacgcatgtatgttaaaatttatagtaattcgttatgctcataacatggtattacaccctaaagtgacatgttgcttattgtccagaaacgacaaaagttattcccgaaagtccgttgggtctccagcatagggcactacatgagtttgcgacgagacatagaatttcaagcacaaaaagataagactatagaatcctcaggggagcactgaaaacaggaagagaaagaaggcaaagcaagaacaagagaagccatcaaagttagatgcatctgtgtacaaaaaaggggaacagcgaacagagtgagagagaggcccagatgaacgagacaaggcacaccagatacgagaacaggaagggaagaagcggaagccaaacaccataacagtgacagagaaagaaaagacaaagagggtaccggaacataacagtgtgaagaaaggaagaagagaaaaaaagaagaaaagaagaaagataagaatataataaatgttgaaagaagataagaaaagaagtgaagaataaaaataataataaaagaaatatgatgagaagaagatagagtaatatagtaagtgtaaagaagtaaagaaaatatagaatttaataagaaaagattataggataaatgataaagaaagaaatgatatttatt

SEQ ID NO: 638894 - DNA, 280 bp, Homo sapiens
cttataagactataccgtacccttcccccagatactacgcatccctaagagagaccgacgtccagatgggaattactagcactaggctgcctcccctttcccaggtacagctgacttatgaccctccaattcagagcctggctctgagcccttggtgagatggcataagccctgatagagtttacaaacaagtgagatttcaagtaccaatgccttcgactcccaataagaatgacaattcatgtatactttaccagaactttatcatagaaaatatctg

SEQ ID NO: 638895 - DNA, 108 bp, Homo sapiens
tcggtacctggtccgtcttgcgccggtccaagaatttcacccctagcggcgcagaggaccagagcgaaagcatttgccaagaatgttttcattaatcaggaactcggt

SEQ ID NO: 638896 - DNA, 144 bp, Homo sapiens
gtaccgatcagcatttgaccagagaatggacccagaatactcagtcctcttggggaaagatctagtggtgggtcactataaacagagcggtaaggcctgcgggtgaaagtggagacatcagacctttggaggggctggtgctga

SEQ ID NO: 638897 - DNA, 192 bp, Homo sapiens
ctgcttggctggccccgggcctcctcttctgccctccgccctgcgcttttttcttttctccctccctccccttcttcttctcctcctcccgtcgccttgccgttccttccccctcgggttcaatggcatttcaacacagccgcacagcacatccagttcaacttttcccccacagcagcagcagcggtcggg

SEQ ID NO: 638898 - DNA, 845 bp, Homo sapiens
gaatcaatgcagaacgtcgagatggagcccaactcactccagatgggtcggctcaccgtgtggcttgcacggaccttacattttctacaaggcttttcaattccagccttggaaaggcgaagaccaagaattttgtcccttgtgcgactgtgctcttatgtaagatgtacgccaaatggatccagatttgcgatagcggagctccagtcgtgtcgtgggaagagaggacctagccggctaacgttttatccagctctaaacttgatttcctctcagaagacactccccagggcagaaatagcgaccatggcgaggatgaagtcattgctgttccgaaaaggtgatttgtgaagcttgaagacctggtcaacgtggtgtacattctgatttctccaatgtggtagatgttggcttccacgctggaccacgttgaaaagctgaggccttgtggaaggaatggacatgaacggaagctctgctgaagtacaggcggtcaagccctaaacagtggactctaacttcaaagacgtcctcaagggagaaggcatgacctggggggtagggacgatggaagaaacgaacgtgatagtgcttcaagcttaccccccagtactgccgggtaccggctcgactgcttgaagaccgcatcccaggataacgccatctgcccattccttaccggtacccagtttgcatttggcctgggggggccatgcagttgggcaagtctggaaccttcagatccggtcttgtcgggacaccttagaccacccgatctcataaaaaaagaattttgcgcagaggttgggcaatttagggcgccacccgaaaaaactggcccaaaa

SEQ ID NO: 638899 - DNA, 213 bp, Homo sapiens
tctccggtggttgaacaaaaccaacgcatacaagaagtaacaagctttggctgcctgctcctgaggtgtttcgctctgcagtcccctggaacgaccatgctaacggttaccgtcggtgtccccactgccggactctcgatggttcgccttgttttttcttctcttcccccgaattgatttcttccacagatatcccgttcgatgaaacaaaca

SEQ ID NO: 638900 - DNA, 203 bp, Homo sapiens
ccctagtatatggctgtagggaaaacgaacccaagctgctggaacccaatcctcttgaattaatggcttcataggtatttaaaaaaaacaaaaatatgacccaccacacccagcgtcattctattggtaattttatgaggaccttccattagtgtttactacatttagcgggtcccatttttaacatttcctcaccacacaag

SEQ ID NO: 638901 - DNA, 464 bp, Homo sapiens
cctggtgtgttgtgttccattatcatggttcaataatttcttttctattttcttcttaatttctttacccgctggtcattcaggaacatattatttaatttccatgtttttgtatagtttccaaaatttctcctattattaatttttagttttattctattgtgatcagtgagaaggcttgaaattatttcaagtttttgaatgttttaagacctgttttgttacctaacgtgttatatccttgagaataatccatgtgctgaggacaacaatgtgtattctgcagccattggatgaaatgttctataaatatctattagatacatttagtctatggtgcagattaagtccaatgtttctttattgattttctgtctgtgtaagacctgtcatggaaatctccagcaattattgtattggagcctatctcactagctgtaataatatttgctttatgtatctgg

SEQ ID NO: 638902 - DNA, 474 bp, Homo sapiens
cgacaagttcctcaagggcctcccactgctaaagttattgtgagctgttgatctgtgcttcctggatatgacttttacacggcattattctggcagcacatgtcgtattcttggatgatcttgctgctcttatttctccttttgtgtgtgtagtgtgtagtgtgtgtggctatgggatttcatttgtaactccatctgctataggagagtgggctctctataagtgttacctgctgtaaaacttcattgacgcacaggctgtagagagaaataaggactataattccacctagggggctctccatctccacaccttacggaggagatttctagaaaaactgggccagattctctttgttctccctcattttcatgtggcaggctgtacagttatccttaacctctatacctatgttgatatcactttcgtaacgtgtccaaaaagaaaaacagacccaatcaagagtctctatg

SEQ ID NO: 638903 - DNA, 521 bp, Homo sapiens
accactctggaatgactagggcaggcatcttttatggtgtgtgtggtcctgctcctggacacaatagtcatggtccccagagcccacatggactcgcatagggccatggaccccttcttggaggcgaactgcagttggatgtttggcctccgtaactccttcaggctacagggttccctcctgggcggtggacttaggagatttggttttggccaggcagtgagacagcagccaggggcttccataattggtgggggagggggtagctggaggggtgagccctgccatgttggccagtaactggggctatgtaaaccggtctagggggcctcttctcctggggaatgtcaacgccagctgagttgcctcacagccacgctgtccggaggagccggaggaggaactccttttaggatatctgatttctcaaattgctccagcagactggacaggtccgatgcctcacttccaatctcactgatgaaagcctgtagcagatcttcagaaccctgagtacgtgg

SEQ ID NO: 638904 - DNA, 332 bp, Homo sapiens
ctaaggaggagaggtaaaggggcaatgtaggtcacagagtacaatgtttgggttagacaggagaataagtttctgagatctgtggcacagcatggtgggtgaccatagttcggaatgtattatatatttcaaaattgctaagagtaaattttcagtgttctcactatgcccacaaaaatacacaggtgaagttatggatatgttaattagcttgatttactcattctgcaatttacacatgtatcaaaacatcacattgtaccccataaatataaacaattattgtcaattgaaaataccattaaaaaatataaatgaccaaaaaaaaaaaa

SEQ ID NO: 638905 - DNA, 314 bp, Homo sapiens
tggagctggttgaggctgcagtgagcagagatcatgccactgctctctagcctgggtcaaagagactgaccctctctgggggggaaagaaaaaattagaaaacaactgtcatgctgggcgcagtgtctcacgcctgtaatcccagcactttgggaggccaaggtgggtggatcaactgaggttgggatttgagaccagcctgaccaacatggagaaaccccatctctacaaaaaatacaaaattagccaggcatggtggcgcatgcctataatcccaggtacttggaggctacggcaggagaaccacaatgggg

SEQ ID NO: 638906 - DNA, 184 bp, Homo sapiens
ctcactcaagttctgcccagaatgctcataaccgctataataatattatccctaatacctgccatcccactcttattcagtgttggaagaacggtctcagaactgtttgtttcatttggtcatttacttttatgtagctacatactggtttattgatactcactgcatcgcttaacctttcagt

SEQ ID NO: 638907 - DNA, 784 bp, Homo sapiens
gagtttcctcccgagggcgcgcgcggaaccccggcgtcttctggaatagcccccagagcacaaacgcaatggtccctgtggacaaccgcgtggggacgccccccacggggttgtgtccaaaggaagtaacggtgcacttcttcttccacgcatcccactcgtgggtgaaaaaacgtagtcgccctcggtgcaaacagccgcggagtgttcttcagaaacagccaaatggtaccacaggaagaggtgtggcgggtggcccccacacgaagaagacgtcctgtgtggcgcacgcgccccgttcatacaggaaaaactgtaggggtgctaaaaatcagagaggcgttctcccgaaggacaatcgtgtgaagaatttcggaccaattgtccaagagcctaaacaactgtggcgactttgggcgcatcgtctccacgagagaacgcccgctccgttgcgagtagtcctattttagccaccccactatagagtcggattgaagattctttgtatccttaagaacaccacgtgctcatgccgcctggggtgtcttcccaagcacacagaatgttgggagagattcgaggcaatctcatctcaagagtgttcgtgtaacgctgccccgcgtatctatcatggtgtgctgttgtaagatactgtctggcaagtgggccacaaacatatgtacgacgcccgattatggactgacgcttctgtaacatgacgggcctatgagactgatggtgcgcccccatatggacatctcgtcttttagtcccacaatgtcaa

SEQ ID NO: 638908 - DNA, 359 bp, Homo sapiens
agcttaatagcatatcttactttgaatatttacacaaacacataaccatgtgactacattgataggccctgtaccacgggccttgaaactgtagcctatgcacattaccagccctgaaacctaaattatggtagtgttacagtacatccacttgcttgatgaaatagacaatgtgactggattgctcttagcaggtattcaatctctacaagtttgggctattaatagagatttaagcaaccactaatgctgacgtccaagtatagaatacaggaccagcctctgtctagtagagctggggagtggtgagcctggattaggaggctttgatgaggagactgaacgtttgatcgagctaa

SEQ ID NO: 638909 - DNA, 243 bp, Homo sapiens
cgacctctggcttcacgtgacctgcctgtcctcagctccctgggtagctgacaagtgcggatctccgtgctccaggccacagggtgtatgtggccatgcctacctgttttgtttttttcagaccagaaacccctattttcacagacctcttttaagaaatttcataaagggacatgcataaacctgggtatgctttacttaaaacataccataacaagaaaaaactagcacaacaaaaaacac

SEQ ID NO: 638910 - DNA, 808 bp, Homo sapiens
gagcggggtacttggacctgaaccttgctcagagagggagtcctcgcggacgtcagccaagatctccagaatgacgtactatcttgacttaccccgtttaaaaatcttcccactgcatcaatagatgggccctcagagttttccataagatcctcatgagactggttgcctcgccaggctacgagactgcccgcagcgtgtccagaccaaaacgaagaagacgttagcgcaaacctcagatataaggaatgttgtggtggtggatggtgttcgcactccatttttgctgtctggcacttcatatagaagacctgatgccacatgatttggctagagcagcgcttacgggtgtgtgcatcggaccagtgtccctaaggaagtagttgattatatcatcttaggtacagttattcaggaagtgaaaacaagcaatgtggctagagaggctgcccttggagctggcttctctgacaagactcctgctcacactgtcaccatggctagtatctctggcaaccaagccatgaccacaggtgtcggcttgattgcttctggccagtgtgatgtgatcgtggcaggtggtgtagagttgatgtccgatgtccctattcgtcactcaaggaaagtgagaaaactgatgcttgatctcaataaggccaaatctatgggccagcgactgtctttaatctctagattccgatttaatttcctaagcacttgagctccctgcggttctggagttctccacagtgagaccatgggccactctgcagaccgagtggccgctgcctttgctgttactcggttg

SEQ ID NO: 638911 - DNA, 195 bp, Homo sapiens
ggcgaatgcctctgataccacaaaggctgtatttgacatggagctgtctcctgaggcttagacttgtgaaacaactgtatgtcaaatgtgactgaccatccccatgtgtgatatgagagactggtcgttcttcaaccactcttgagggttatttatatcgtggacctgtatagtgcatatctcaggctatatggt

SEQ ID NO: 638912 - DNA, 500 bp, Homo sapiens
caacggacagagaccgggagagaaggaccacgagtagaactcaagcagagatagagaatgaaaatgggcccaatctaatagatccgcaggtaccattatctccagaagcagactgtaaggggacaggcgcagtgcctgtggagcggcacttgacatcagcgtctttttccacatggagtgaggagcctggccttgacaagcctgccttagaggagagcgcaggagctgacaccacacaagagacacttagtttaccagaaggagaaatcaccacgattgaaattcatcggtccaatccttacattcagttaggaatcagcatagtgggtggcaacagaaacacctttgattaacattgtcatccaggaggtctatcgggatggggtcatagccagagacgggagacttcttgctggagaacagatacttcaggtcaacaactacaatatcagcaatgtgtcccataactatgcccgagctgtcctttcccagccctgcaa

SEQ ID NO: 638913 - DNA, 264 bp, Homo sapiens
  misc_feature (12)..(12): n is a, c, g, or t
acgctctctctngtggggtacaggttttcccatgaaatttacatcgagtggtccacctccagcttatagggcttctggaacagagtgggtcttgctcttcgtgattccatgggagaaaatggaatgggaggaactagtagaattcagggtaatatccagtcagagacttggactgtgatggattgggagctttcctggccaggggctgggttacgaacagagcaagcatagagcccactatgcttggccccacagagagagcgt

SEQ ID NO: 638914 - DNA, 178 bp, Homo sapiens
gggttttaaaaagggggggggaacaaaatttttcctttgggggggattaacccgcccccccctttgggggaagccccaaaaaaaactttttttttccggttttccccccggggaaccaaaaaaaaggggggctttttttttccctggtttttttttttttttaaaaagggggggggta

SEQ ID NO: 638915 - DNA, 197 bp, Homo sapiens
ccaacccaagccggattgcctttggagcaccaccagtttctaggttggtttttttattgtattgaaaaccacccttggccggggttttattatttcaaggcccaaattaaccttctttttcctaccatttgccttattaaccttggtttaattacggacctttgaataccgactttttttacccccctttcttctta

SEQ ID NO: 638916 - DNA, 128 bp, Homo sapiens
ctagagcatcgcttatctggaaagggggagctcagtgctgatggagaaggagctaccaggcttcctgcagagtggaaaagaaaggatgccgtgataaattgctcaaggactggacgccaatggagttc

SEQ ID NO: 638917 - DNA, 154 bp, Homo sapiens
gtggaaaacgtgcttgctcgtacacaaagacaaatggatcttctattcccagaggaccaggcacaccaaaatcctccctcttcagaatggaggtagacagatcaaaatgagaggggcttgagtgtcacagacaatctgaaagtaataatagggg

SEQ ID NO: 638918 - DNA, 227 bp, Homo sapiens
tagacagtcgccaggatgattaaatttaaataacaataacaaggttgatttcagatgtctcaccacaaagaaggaggataagggagcgaggtgatggatatgttaattagcttgatttaatccttccacattatatacatgtatcagaacatcacattgtactccatcaatctatatacaattattttttgtcaatcaaatgtttttaaaatcaaaggtgggccgga

SEQ ID NO: 638919 - DNA, 301 bp, Homo sapiens
taaaagcccccccctttttttttagggggaaggggccggtcttttcccaggtccccccggggggggggaaaggatgggtttgggggaaattagggaagggaaaatttttttaattttggccttaaaattttttttttttgtttttttttgaaggagggggcttgggggccccccttcccccttttttgtcccccaacttgagagggatgaggggtttgggtttccctgggggggggggggggcaaccgggggtttccgggacattggtttggggccggttgaataaagggggcccccttta

SEQ ID NO: 638920 - DNA, 118 bp, Homo sapiens
tgctctagaggatctcagaggaggtggacaggggtggcgaggtcgatgaatgagtggttaattaattatattagggggttaattttgcgtattggggtcatcctccctgtgctgtcca

SEQ ID NO: 638921 - DNA, 1625 bp, Homo sapiens
  misc_feature (435)..(435): n is a, c, g, or t
  misc_feature (751)..(751): n is a, c, g, or t
  misc_feature (851)..(851): n is a, c, g, or t
ccactcgatacggtgtctcgcagagactccatagggctgtcgcctcacagcgaagtatctttcgattgtggaggaaaggtgtgaatgagtgacactgggagcagagcacacgtcacgatgtcttagtagaggaggctccatctcgagcacatcttggaactcgcaggtctaacggtcgccgaggtcagcacatctcgaaggctcgagctctgagagcatccaccattaacaagacataatattccgaactttagcgccacagagcaatgcagagcgtaagaaatcgcgcgaaaggagttcgtcgttgctgggcctagctgacaatgtaaaacttggcctgaccaaaaacgttgggaacatgacactagtgcgagacttaaaaacctcggagggcagagtcattccacggtgccttgcatcagcacacgtagttgngcgcgatagcaccaccgtggagggcttgggtccttagcgcggctactctcgaagcatggagcaaatgggcgcattgttacatctacagggagtgaatgtccgagaatcggatgcactagcatctatgggcgcggtgcaaaagaagattgggctcgcaaattgcacgttctttggagccacaagaagggagagcatacattcggggggcagcgaataaaattgctgcacctggcgtatggggactggacagacattcgttgtcacgatagggaataaaggggtgtacccgcattgggcagatcgtcgtagcacagcnaagggtcccggctgtgtcgggattgcaagtttacaaaagaaggcgttccaactcgggcaacagaacgtaaagccggattcgtaccttgtgtagatatggngaatgtcgaacggaggtgcttggtcccaatggggccccttagtgtgcagggtccctgggattgtgtggtggggcccagttttagggtaaacccttgttgttacataagcaattggttctaatcgtttcacatacgaaaaagagggttcgcgatcgcgtaaaagctaacacccgtaagttaaaagggcatcccccggagaggtaattggggccaatggaaatggatcccaattagctggctttcatcgttggcacttgcatgtcgtccgtgcttcgacatgaatgaacaaccactgtctaactttaggcttttcaatagtgcattgacaattcctagattagaacgctatggtgggggatgttatccctttgaccaccagtgagggccctgagctccaagtacctacgaccatggaatcttgtttcgaagttgttacatacttataaggtccgcgagataagcggggcgttttacccccattcaaatgcgggccgcaaaaatatacccgggggggtacgcatgttgcattccccattgtttcatattaccaatattgaccacgtctgtcacaatgagcaaatccattttctcatattggacccatttcgcatagcacaaaggttcgcaaggcggaacttataaagttacgtgttcacgagatgagaccccgcggtagatcttgtgttgcccttcttccacccagggggtagtaattccacaccatgacgtgcgggtggcaccctagggtgagggtacagtgtgtgtagagccata

SEQ ID NO: 638922 - DNA, 203 bp, Homo sapiens
tcctgtactagctcgccagtgcaggcggcctgttaatcgcagctccggccagtctgtgttctcactgtcagcatcttcatctgtgagagcacggaatggagaggttcagtctgccctgtacctccagtctggccatggcacttggtactactgctgagggacacatgttcaatacaccccacaatcactggcgcggtaggacg

SEQ ID NO: 638923 - DNA, 334 bp, Homo sapiens
  misc_feature (68)..(68): n is a, c, g, or t
gagctcgattcctggttgccgcctgctgagtagctgggaccacaggcacctgcaaccacgcccagctnattttttgtttttttagtagagacgggatttcaccgtgctagccaggatggtctcgatctcctgacctcacgatccgcccgcctcggccccgcaaagtgctgggataacaggcgtgagccaccgcgcccggcctgatctgggccattttatgcacgttatacctcaacagaaagttagtattattattttgatacagggtctcactctgtagcccaagcaggagggcagtggcgcaatctcagctcactgcaacctctgcctccca

SEQ ID NO: 638924 - DNA, 136 bp, Homo sapiens
  misc_feature (68)..(68): n is a, c, g, or t
  misc_feature (73)..(73): n is a, c, g, or t
  misc_feature (109)..(109): n is a, c, g, or t
ccacagctgggcccagatcagtgcccagggcccctgccacagctgggccccagatcagtgcccagggncgtcntgccacagctgggccccagatcagtgcccagggacntcctgccacagctgggccccagatcag

SEQ ID NO: 638925 - DNA, 1364 bp, Homo sapiens
  misc_feature (208)..(208): n is a, c, g, or t
ggttgacatccgggtgctacagaatcgacccccagagtcaagagaatgtgcagctcatgctgagccttggactgttgaagcaatcctgctgcaggctggcagtccctccaggataaagaccacaagatgccacatagggtaggtgcatgcgcccactgtgcggggccccgatctactatcactctttgtacgacgtgacctgtgcatngactggtccactcagtcgacatgtcttgggctaaggatgcgtgacttatagacagagtacctaacataggatgaaactatcgtgtcgtccaacaggggcttatggcgcatgagacattgcgatatcgctatcgatcccttctcgcagagtgacaagataggttgtggctcagacaacggatttggtcgaaggggatagtcgccacgatttctggccatggttgagatagccaaagagcttgcgtccagagggattgggaaaacgagctatgtggctatggaaccataggctcatagatgtggaccctctctatatttgcggctagtggtatggccccaattgagcttaggggcctattagccaattggtcctccgccttgtactccagcctattgtaatcttggggttgccaggtaagacaccctaaggtaaggtaacccttgaactaagcggtggtcccttgaactggctagcgccgccccaagaggaagagcgtcgccctgattggaaattcccacaaaccaaataccggtacgccgtcccccgaagtttggttcttgggaggggggcaattcccgccaaaccgttaggaatcctaagtaccccccgcttgtaaaccctatgggggtatggcccgggttccgccgctttgggggaaagagaggccgatatgggggcacgtcattgttcccactttcttgttcccaaagacaccaacgggcgttcggaaacacgataatggtcccccttttggtcccccaaaaggtatacggccgttaccctatgggaccctgactaggtttcgacgctcgacccttggtggacgcaatcttggccatttggtggaatcccacaagaaacattcttgggaccagcctctaagtgttccccattataacacttagtcccaggtttctcccccagtttaccaacgcggaggctcttgcaacccacgtgtgacacctatagccctcaaagcattgggcgttaatacacctcagtggcaaccgtttggcactttataggacggaggcgccgccgaatgtcgaggaaaccgggggaaactcgctcaggccgccccggcagttagagtttggggccagccccgggtttattccaaaaacgcggccaacaggaggtggcacccacagtatgg

SEQ ID NO: 638926 - DNA, 157 bp, Homo sapiens
atagaattgagaccaattaaggctttgccacattctcacatgtgtaggggttctctccagtatgaattcttttgtgttgagttaggcgtgagagcacgtgaaatgatttgccacattctttaagtgtaaacaagcatcttagcaacggggaggaacg

SEQ ID NO: 638927 - DNA, 436 bp, Homo sapiens
  misc_feature (252)..(255): n is a, c, g, or t
gccccgagccaggagcatgctgaattctcttgtggtctttgtttcctgaatggcctatcaatcagtaaccgagtgcgtgccaaacccagcccacacgggaacccggtgtcctcggctctccagtaaatactacttcaggtctcatgtccgaggaccatatgctcccaacacagctaataaaatcacccaggagcaaggaagttctggggtcagggtaggcagctgggtgttcagaggtgtttgtggggaatnnnnccccccggggtggggttttggtttgaaaaattacccccccctcctttttttccccttttttccttggcctcacagctaaggtcacaggctttggaatcagcagacctggatttgagccctgcttagccaattatgaactaagtttcatgcgcatccgtgtgaagagaacccccaaacagga

SEQ ID NO: 638928 - DNA, 272 bp, Homo sapiens
  misc_feature (177)..(177): n is a, c, g, or t
  misc_feature (227)..(227): n is a, c, g, or t
  misc_feature (250)..(250): n is a, c, g, or t
tatctatgtatatctatgctaaaacatatattcaaaaatgtttttaataacctgaaaaacagttgggatatattaagaaagcaacatacaatgtgagtgtctacgtgtgtgagtgagagagacagagactgaggcaagaaataacatttaatatgatgttgaaagggaaatgtgccnatataaaagcattgggtataatcacagatatttttaattacaactctccntattcccaattgggctgttaacntatatttatattttattaattc

SEQ ID NO: 638929 - DNA, 109 bp, Homo sapiens
cacaaatagctcaaagattgcagcctaaactaaattcatacgacaataataaactatcactagttacagttaaattgtcctgactggtttaaaacttagttgtaaaaca

SEQ ID NO: 638930 - DNA, 236 bp, Homo sapiens
ggcgaggacctctcttatatggccccctacggacttaagcggaggcacccaggtgtggaacatattccgggggcccttttttgaagagagggcacgaaaaaagatctgtgacggatcttttttttctgggaacttcacggcccccccaggcccattaaatccccttttctttttcttcaccccactacagtgaaaaaaaaggtgttttttttctttttttcccccaacataaacaa

SEQ ID NO: 638931 - DNA, 336 bp, Homo sapiens
  misc_feature (33)..(33): n is a, c, g, or t
  misc_feature (36)..(36): n is a, c, g, or t
  misc_feature (54)..(54): n is a, c, g, or t
  misc_feature (75)..(75): n is a, c, g, or t
  misc_feature (241)..(241): n is a, c, g, or t
  misc_feature (300)..(300): n is a, c, g, or t
  misc_feature (315)..(315): n is a, c, g, or t
gtgtttttacagagtgctgattggtgcgtttantangacacagcgctgctttantaggacacagtgctgctttantagacacagcgctgcttggtgctatttttacagagtgctgattggagcatttacaatcctttagctagacacagagcactgactgatgcatttacaatcctctaggctagacagaaaagttctccaagtccccactggacccagaaagtcaagctggcttcacctntcaccagcaagcctgaactggtggcatgtaaggggacaacagcaaaaatttgcaggctncaggcaagccacctnagccctaaatgccaggtccca

SEQ ID NO: 638932 - DNA, 120 bp, Homo sapiens
gtgacgtacatccggcgagtagctggcggtccccgggtgctgctggtttagtgtgctctgagggagggtccgagccagccgctgtttttgccggagaggcccctcaggccggctgcttcg

SEQ ID NO: 638933 - DNA, 443 bp, Homo sapiens
atctctcattgtactttcgcatgtggaccatctagtcgtcaagggacatacctgctcagctgttctagtctgctatactactacatcctcaggcataatacaggccccctcccttccctacacatcaagctcgaggattagcccccacccaggactggaaaattagcattattcaacatgccctgagataacaaaaaataaaactactcttagtctaggtagacactttcactagataggtagaggccttatctacaaggtctgagaaggccaccgcagtcatttattcccttctgtcagacataattcctcagtttagccttcccacctctatacagtctgataacagaccagcctttattagtcaaatcagccaagcattctctcaagttcttagtattcagtgacagactaatggtctattaaaaacacacctcaccaag

SEQ ID NO: 638934 - DNA, 286 bp, Homo sapiens
cccgccccatgtgaccagaggcccacaggaacccaactctatttcccttaggaataatggtttagtatttactaatgcagtgttccaagtgactttatagaacataactactgcaaataatgagaatcaactgttttatctttggatcatgtgctgtattactgttaaaaatgtgaagacataattatgtaggagaaatattactgtggaggattttttttttttttttttttttggggggggggtttcactttgccacccagctgggggggaaggggctcaattt

SEQ ID NO: 638935 - DNA, 777 bp, Homo sapiens
ttagtgggacttacatgagtaagcaaagtggaggtgaaggcggcatcattatcaattatgtcatctttacgaggactcatgcccgttgcacagcagtccggcttatagtgctacaaagcatggcgtatttggattcacacgctcagcagccgtgggctgctaatcttatgaacagtggtgtgagactgaatgccgatttgtccaggtctttgtctaacatgaagcatcccttgaatcatttgttaacatgaaagaaaacatgggacactatatagaatataatggatcatctcacggatatgattaaagtacttagtggaactttagggtccactcattgattgccaattggattgcttactacgtcattgaatatgatgctttaagagtggtgccttaatttatgagggatcacaactctctaagcggaattcatttgcaagactatgatacagacctccattgcaagcaaaaacccaatgaacagcttatgtgttagccatagctgaccataacgcacagagatagcttatattcagatcctatctttcatttgaatatccgcttttaacatgaagagtggtccagctttgaagttttccttcatgcacttggtgataaacgttttctaacattctcagttcagtatatcggatacccagttatgacgtattcaaatgtgatgtggccacaaggctacgtcgtacacatgatgctctaccaatgatcacacctgtttccgaatctcaatctgcctcgcacgggcttcctccggcc

SEQ ID NO: 638936 - DNA, 243 bp, Homo sapiens
ggagaatgagttctatgaatttgctagagcagttccgattcatcagagcccatgtccgttcgaggaaaagagatggagacctctacatcctcgcacaaaactttttctatgaagaagatttatccctgaagtcgtacactgagtataagagtgtgacatattcagattcttagaatctaaaatttgaccctgttcttcaccttatgtgctcagactccacacgtctgtgatttgctgatcagt

SEQ ID NO: 638937 - DNA, 197 bp, Homo sapiens
catgcgatccaagtgctcccgtgtcactacattcttatttcctgtgcaagttattacgacatcgacttgccgtgatgacttcatttagctttaccaccctgaacccatccatgcaggcctgcagagcacagatggggtcgatttcggtactgtagactattgctccaagagctttgagagcagcacagcagcccttg

SEQ ID NO: 638938 - DNA, 211 bp, Homo sapiens
aaaggtttaaattgggcttttttgggggttcaatttaaaaggaatttttagggtaaattatgataaaaatgaaagtaggctttcattatttaggggttttttttcccagtttgttctttaaaaatcaaaacaagcagaaagagaaaacggttcacccatcctttcatttttttttttcatttttttccccttttatactaatatttttata

SEQ ID NO: 638939 - DNA, 1986 bp, Homo sapiens
  misc_feature (259)..(259): n is a, c, g, or t
  misc_feature (859)..(859): n is a, c, g, or t
  misc_feature (867)..(867): n is a, c, g, or t
cgtgtagtatgtggcgcgctggtagttgcttctgcctggtgttcgtcggtgcgttgttgtcgcacacgtgtgtggtgctgcgtcttcgcttgttttgtggggtgtccttcgggtcgtgcttgtatcttgtctcgcgtccgtgttggttctcctcggtgagtcccgtggggtggcccctgagcgtcggtgagtgttgctgggtaggtccgtatttatacataccgcgggtcggcgaaccagtcacatgggggtttttttncggggcatcccggtgggtggtgtacgcctactgcttgttggtggggaggacccttgttagtaatgttctgggagtgttgtgttgttgggtcgtcaccggctcattttgtctcctgtcgtgcttggtgttcctgtgggcacccagctgactgttgcgcccagcattgtgtgtgtgggccgtgttcattccacccgtgcgcttcaatcagtgtggcccctgtgtgccaccatcgcggatgattgtgctgtggggtggacgcacaatgcgaagagcccggttgttaggcgaatataattcatctcacacggaggtggtgaagactcccacaaggtggtagtttccccacgtagaattcctaggagtagttggtgaaagggcgctctgaacaccacacattgtcctagagggaccaaaataatactcgtggggaaaattgtctctgtgatagatggtctgcaggcgagattatatctttggtagacgaacagtttggtgcgttttccccaagaagaagagtgcaccccacgtggaaatttgctctcgggccttgctccttctggggggtgtccaaaaaagtgtgggcagacatgcggcgccccnccggattntatatagagtggagaataattctccacaaggggcgcgccacttcgtcttgtgttcgtgtggtaagaatcgtgggaattgatggaatactttttgtaagcatgtggcggattattgtcttctctgatgcagaacgatggttttgcgccccaacaagggtggtcgtgaataatattgtgggggcgtaatattgtgttgacagccctcaatatttgtgttgtgaagtggtcgcccctccctctgtggtgtaggatgataggggttgtccttgtgacaaacacgacgtatagctcgtaggttttgttgttgggacgttgttcttccaacatgttgtgccaacactggtactggtgtcaacgagtggggttttgtcctccggtggtaaaatgttgttatattatgaacaccgcggcacatccatcagggccaccacacgatatagggatgctcatctttatatctctaagggagcatgtgtggctcacaatatagaagggaaattatggtgtgtagaaagagataggctctaatatgggcgtggtaaatataccgccccacgcgctcatatgatatatccccttcctggggagtattgtgatatcgcgccgctctcatatcacgttgtgtagtatatgagaaaacacacgccctctcatatatagtagatatgtatagttaagagagagtgtctcatactgctgtttataaaagaggagtataaatagtctcaatatgtgggagtgtatacacacggcgagtgagagggtgccacagggagtaagagacacgacacacctgttgtgacacgtgtctccacgtcgccacatgttctcacacaaaagtctctgtgtgtaagatatctctgtaagttgtgtgaagccacagcacctcgttgtggagggagaaaattaacctcgttgttgagctcgccacagtggtgtgtcatgcactgtcttaaatgattggtgaaactggctatagtatggagatttgaaacccgtgaatgcacgatagtctttttcctatttgaggccctggtggaattaaaaacccgtatattttactttgttgccagataatcttgccccattttggcaaagttgtcagagatggtggagctt

SEQ ID NO: 638940 - DNA, 508 bp, Homo sapiens
gttgtgtttataaggaagttagatccagctattgtttgtttaattacatctttcgcagacagaggtttcctgtcagcattacctggtttggcttcatcattatcatttgaactttcagaaggaattattacttccatagaagattgttttacagtgctactatgtggtgttgtgactgtcgcaggcagtgcacaaatctgtccagtatacttaacttattttcatgtagatcacataattgtcgttgattttgatcctgagaggcagataattcagcattttttaaaaagataatggtatcacagcaacatttggatactacagtgctatggagaataccaccattatagtggctggtgaactctaccattatgtagggctgcacttttcccccacgtgtacaaggctaccgcgtagagcaggtgaagctatgtgggtccacaacaatgtagttctaagtagatgtcaagaggtatctaagctcaaatcacagtgtagtagctatatt

SEQ ID NO: 638941 - DNA, 474 bp, Homo sapiens
tttgtcgctaccaccctccaattcagtcgcgccggcgtattaacgcacaccctaaatccctgggcacaatggcaataacctcttttaccgaacgtgcgggagtgcatcccccgaggccaatgaccaccggcccgccttgaatagccccgctctccggctgcagggtcgtcttttctcgggcataccccgcgggccactagaggatggcgggcttgtaaaagaccaccctaggccggctaacatccaatatggcggccaccccctagctcaccgaagaagggcgttggcggagcaccacaagagggaggggcgagataaatcaggggagacccccccttgctcgcgccgctgcaccatctcagcaagaggcgtacgccctcgccccccccccccccgggatgatggttgtttaaaaccccaaaaaatggggggttagcccaaggaaaaaacccttttaaaaacacccaaaaaaaa

SEQ ID NO: 638942 - DNA, 207 bp, Homo sapiens
cgagcacagtgcacatatatatatatctgaaacatagacatatacatgtgcaatcaacttagaattgctagcacatcaattagccactctcagataggtccacaatcagattagtaatgctaagtaggttagtccccatgccaatcacaggtactcccaggatcaacacctctcctaccgcacactatggtcatatacagctccaga

SEQ ID NO: 638943 - DNA, 668 bp, Homo sapiens
taaaagccgggatggtaaccagattttctttttcccccttctcagctgtaaatatgatatctcctttacagggccccagtttaagggcaaagtgagttaatggtgtagacaacgggcgagggacaagagagatgttaacatctagacgggggaaaaacgccatggtgtgtgggtttctggggaaccaccaacacttgcaggtttagcttttctcccagggttgactacaagaaagaaaaccatggtttttggcaagattaacaatggtgggtcgatgtggtggcctaaattaaccatccccatttcttatcattatttccaccatcatcttcggggtcttaaaagagtcagggctcacctggggcggagctgggtcagtaccattgggcttcttaagaaaggctaagtcctggggtcccggtctggatttaagggtcccaggagaatcttcctggaaaacacccccgatcgcaagaggggtaatcttcctggagacgttcggtcttggcaggggatacgctgggagtgtatgggccaccctgggtcccacagatggcgggtaatggaatccagcaaaacgggggagaacgcagggctgcgcaaaatggcccaactcgcagaaccgggtcaggcaatccaggtgaatccggagacggtgtcggaggacc

SEQ ID NO: 638944 - DNA, 171 bp, Homo sapiens
tgtccgggacgggtacacgaccggctactacacacggaccctttttctactggtggtttttaccacacgtaacaccttctactttggacacgtacgttttacgactttaccgactgcaacgacacgggaccggtctggggactcctctacgacgtcgacccgtgcacggca

SEQ ID NO: 638945 - DNA, 1104 bp, Homo sapiens
  misc_feature (15)..(15): n is a, c, g, or t
  misc_feature (74)..(74): n is a, c, g, or t
  misc_feature (85)..(85): n is a, c, g, or t
  misc_feature (159)..(159): n is a, c, g, or t
  misc_feature (162)..(162): n is a, c, g, or t
  misc_feature (167)..(168): n is a, c, g, or t
  misc_feature (170)..(170): n is a, c, g, or t
  misc_feature (173)..(173): n is a, c, g, or t
  misc_feature (178)..(178): n is a, c, g, or t
  misc_feature (185)..(187): n is a, c, g, or t
  misc_feature (197)..(197): n is a, c, g, or t
  misc_feature (200)..(203): n is a, c, g, or t
  misc_feature (215)..(215): n is a, c, g, or t
  misc_feature (217)..(219): n is a, c, g, or t
  misc_feature (224)..(224): n is a, c, g, or t
  misc_feature (229)..(229): n is a, c, g, or t
  misc_feature (231)..(231): n is a, c, g, or t
  misc_feature (237)..(237): n is a, c, g, or t
  misc_feature (240)..(240): n is a, c, g, or t
  misc_feature (243)..(243): n is a, c, g, or t
  misc_feature (245)..(245): n is a, c, g, or t
  misc_feature (254)..(254): n is a, c, g, or t
  misc_feature (260)..(260): n is a, c, g, or t
  misc_feature (263)..(264): n is a, c, g, or t
  misc_feature (602)..(602): n is a, c, g, or t
  misc_feature (613)..(613): n is a, c, g, or t
  misc_feature (618)..(618): n is a, c, g, or t
  misc_feature (629)..(629): n is a, c, g, or t
  misc_feature (643)..(643): n is a, c, g, or t
  misc_feature (832)..(833): n is a, c, g, or t
  misc_feature (839)..(839): n is a, c, g, or t
  misc_feature (846)..(846): n is a, c, g, or t
  misc_feature (850)..(850): n is a, c, g, or t
  misc_feature (867)..(867): n is a, c, g, or t
  misc_feature (870)..(871): n is a, c, g, or t
  misc_feature (874)..(874): n is a, c, g, or t
  misc_feature (877)..(878): n is a, c, g, or t
  misc_feature (883)..(884): n is a, c, g, or t
  misc_feature (887)..(887): n is a, c, g, or t
  misc_feature (902)..(902): n is a, c, g, or t
  misc_feature (928)..(929): n is a, c, g, or t
  misc_feature (932)..(933): n is a, c, g, or t
  misc_feature (937)..(937): n is a, c, g, or t
  misc_feature (948)..(948): n is a, c, g, or t
  misc_feature (953)..(953): n is a, c, g, or t
  misc_feature (956)..(956): n is a, c, g, or t
  misc_feature (976)..(976): n is a, c, g, or t
  misc_feature (984)..(984): n is a, c, g, or t
  misc_feature (986)..(986): n is a, c, g, or t
  misc_feature (995)..(995): n is a, c, g, or t
gaatgggtcaaggcncctgcctgtttttgttggtgcacagagattgacttgattcagagacacaattcactccncccctatggcngaggaatgggttagccctaatgtagaatgtcattgtttttaaaactgttttatatcttaagagtgccttattanagnatagnngnatntcttnaaatgtnnntgataggaanttnnnngatttatataangnnnccccngcctnanaataanaanagntngttttaaantgcttnatnngtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaacttttctccaggaaaatatttggaaatcatgcngctgagcctcnatttncttccttggangttggatccagatncttttatcataaattttccagcatttaaaaattcactggatgtacattcaagccaataaactggttaatggaatacacaacactatgtagtggtggtccctattataacatggcttgggagcaacgtatttctatgagactctttactcaggtgcatggttacagcccacagggaggcatggagtgccnngggaanggattcngcantacccagaacctggttncgnnggnatnnggacnnacnggtttttcaaagaanccatttcctcagattacaagatgatnntanncaanttagcatggcncaaanggnaccaccaagtgtgtcacccngtgccttnanaggaggttnaatcccaggcacatccagacgggccatagtcagcgacgtacagccctcataaagggccgcaattacggtaagtccccacacatgtgttgcgacatcgcaggctcaaagg

SEQ ID NO: 638946 - DNA, 156 bp, Homo sapiens
tcggctcatgacaaacaacacagtacaactgggtccacctagaacggggaaaaaaagctgggggaaaaaaggaatatacttatttagtttctttaggtatgtttcttttcataactgggtattatgtggacattatattatgctacaaggtgtcga

SEQ ID NO: 638947 - DNA, 824 bp, Homo sapiens
  misc_feature (263)..(263): n is a, c, g, or t
agcgggtttacccttgtatggccggcgacattggctatggctcgctcaactctctctaacgggagagcagtgcggaatacatgagattgagctgtatctgccctctagtgccaagaagattcatcgcttcacaactggctgctcacacagatagccgaggaagtgttttccacttccatgctcctttttccatagaaagagaagcttgaactattaagatattgactacgtcaacaaaggaagaatgaaaaggtaaaccgtanagacttttgcattgccaagcagggtgccaatatcaaaatactcggcagggcgacagggctcgcgagaccgtggagtagtagaccgtaggctcttgactgtgattcagagtgtatctcgatgcatgtcgattggatctgatgaccgggtgaggtacgtacatggctcgatcgtggaaatcttagtgaccatctctaatggcgggacaggcgtgacgccgtgaaacactcggttagtgaaagcgatctcgtgggatgtgcatgcgcccgagacgatgacaaccgctctggatcggccaaaaagctcgaagcgagaaatcattgcgtgagaagatgctgtgccgaccacataaatgcgcaccaatcgcaacttccgtagtacgttggggtggaaccatttatctggatttgtggcacacggggaatggctagtcaccggcgttatccccacacgtcaattaccacgcttgtatataccaaagaggtggacattgtgaacaattagccaagtgaacaagcaatttggatgtttaacactcaaggaatgttggggaagatagagac

SEQ ID NO: 638948 - DNA, 399 bp, Homo sapiens
  misc_feature (25)..(25): n is a, c, g, or t
  misc_feature (45)..(45): n is a, c, g, or t
  misc_feature (71)..(71): n is a, c, g, or t
  misc_feature (304)..(304): n is a, c, g, or t
  misc_feature (358)..(358): n is a, c, g, or t
  misc_feature (367)..(367): n is a, c, g, or t
  misc_feature (394)..(394): n is a, c, g, or t
tctcctccacttttttcggaatttntttcttcctaattacagcgnggtgtggaggaaactgcagctgagtnccgaaaactaggcgtcactgcgcatgcgtatgtggtagactgcagcaacagagaagagatctatcgctctctaaatcaggtgagactgcaggttcacaaatttcttcagattattttgtttcctaggacgctgacgtggaaaatgagaaaggtctttatgactgcctgatttaaattcgattttagctgctaactgaagtagttatgtcaccaaggaaggatatatacttttnttcttgtatgtaatccactcagctctgcccattattattgtttcatattattantcatttccntctgatcagagtgtgagcagtggcacnggtga

SEQ ID NO: 638949 - DNA, 701 bp, Homo sapiens
  misc_feature (282)..(282): n is a, c, g, or t
cccccggcatggggttttgcttagggattctttagtggcggcccttagaggggggtggggtacccccggccccccgggtcaggaagcgttctgggtggctaagacaggtttctgtgatcttctccgttggggcatgttgacagacagtttccccccctcccaccctcattttttggtcctcgcgattgagagccaggggggacatcatgaccttttgtcccggccgccttagccccgggcacagggaaggcagatgggccgtttttgtttgtgtcccatccngctgtccttttgtcctggatgttttatggggccggggccccccagggaagcttacccctcctgtgttgggtggaggccacgggacaccttaggtgcccccccccttggcccttaaacagcccccaggaaaacaaccggaaaaccggacaacaggcaacctgtttgggttttttaggcctgggggtggcaaacaagcccccgggcccgtggttccaacaacagggttgtcagttggagcattttggggctccctgggtcctggccgttttttaggtaggggcagtaccgtgttttgtaggtaacagtaggaacgggggcccccccggcccttcaaccgcttatgggggtggggtgtgtgccaagcccccccggggggcagggggttacgtgtggggaataaataggggttttgcccccca

SEQ ID NO: 638950 - DNA, 154 bp, Homo sapiens
tcgagcagtcgggtcttatacacatagtccactcctgtattcacaggcctatgtccagccgtacttccagggatgaccttgtaatccgagtattagtatgaagcaattctacctcagcacagcggcacagtacatcacgaccaagcttgtgcag

SEQ ID NO: 638951 - DNA, 290 bp, Homo sapiens
aatcccaggtatcatctgactcttcagactccgtccttcttctcatctgttcttctcctctgctgcagcagtgggcagaaccagcagcgaggggctgtgaaacctggtgcagcagaaacggttacagccccaccagcaggtacactggcaagcttgtcaataccctgggctatgacgtcttccatgtttgttccattcagctcactgataaccttgttgagccggtcgtcgtccgcctcgatacccacgctgtccaagatcttcttgatgtccttggcccccttatcgag

SEQ ID NO: 638952 - DNA, 1042 bp, Homo sapiens
  misc_feature (616)..(616): n is a, c, g, or t
  misc_feature (633)..(633): n is a, c, g, or t
  misc_feature (640)..(640): n is a, c, g, or t
  misc_feature (655)..(655): n is a, c, g, or t
  misc_feature (698)..(698): n is a, c, g, or t
  misc_feature (702)..(702): n is a, c, g, or t
  misc_feature (723)..(723): n is a, c, g, or t
  misc_feature (778)..(778): n is a, c, g, or t
  misc_feature (788)..(788): n is a, c, g, or t
aacgatggcggcttcctagtgagtcggcggctgatttagaaggaggttcaggctacggtgagccgacacaggagccatggaagtggcagagcccagcagccccacgtgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcagtgagccggcccctaagtcctggcaggtgcccccgccagcccctgaggtccaaattcggacaccaagggtcaactgtccacgagaaagtgattatctgcctggacctgtcagaggaaatgtcactgccaaagctggagtcgttcaacggctccaaaaccaacgccctcaattgtctcccagaagatgattgagatgttcgtgcggacaaaacacaagatcgacaaaagccacgagtttgcactggtggtggtgaacgatgacacggcctggcttgtctggcctgacctccgacccccgtgagctctgtagctgcctctatgatctggagacggctcctgtnccaccttcaatctgganggacttntcagcctcatccagnagaaaactgagcttccggtcacagagaacgtgcagacgattcnccgncatatgtggtccgacatcctngtctacagccgtccacctttgccagccccagttctccttgacggagcccattganacatgttccngtgccatattcttcttgacgttgttacttccccaggcctgagggcgcggggacaacttgtgaaagacattgttgccctctagggcggactgtgtaaccggggcacccttcaagtttagctggcctgctgtgcacccctggggtgtcacgtgtttttgaatgtggccccctgaggcgttcagcagtctcaaccgggaggaagaagacagatatgcggtgtgcacccacatacatatgaagagaacgcatcaactg

SEQ ID NO: 638953 - DNA, 1085 bp, Homo sapiens
  misc_feature (659)..(659): n is a, c, g, or t
  misc_feature (676)..(676): n is a, c, g, or t
  misc_feature (683)..(683): n is a, c, g, or t
  misc_feature (698)..(698): n is a, c, g, or t
  misc_feature (741)..(741): n is a, c, g, or t
  misc_feature (745)..(745): n is a, c, g, or t
  misc_feature (766)..(766): n is a, c, g, or t
  misc_feature (821)..(821): n is a, c, g, or t
  misc_feature (831)..(831): n is a, c, g, or t
aacgatggcggcttcctagtgagtcggcggctgatttagaaggaggttcaggctacggtgagccgaaggggaggattctggcttcccctgtccgtgttccatctagccacacaggagccatggaagtggcagagcccagcagccccacgtgaagaggaggaggaggaagaggagcactcggcagagcctcggccccgcactcgctccaatcctgaaggggctgaggaccgggcagtaggggcacaggccagcgtgggcagccgcagcgagggtgagggtgaggccgccagtgctgatgatgggagcctcaacacttcagtgagccggcccctaagtcctggcaggtgcccccgccagcccctgaggtccaaattcggacaccaagggtcaactgtccacgagaaagtgattatctgcctggacctgtcagaggaaatgtcactgccaaagctggagtcgttcaacggctccaaaaccaacgccctcaattgtctcccagaagatgattgagatgttcgtgcggacaaaacacaagatcgacaaaagccacgagtttgcactggtggtggtgaacgatgacacggcctggcttgtctggcctgacctccgacccccgtgagctctgtagctgcctctatgatctggagacggctcctgtnccaccttcaatctgganggacttntcagcctcatccagnagaaaactgagcttccggtcacagagaacgtgcagacgattcnccgncatatgtggtccgacatcctngtctacagccgtccacctttgccagccccagttctccttgacggagcccattganacatgttccngtgccatattcttcttgacgttgttacttccccaggcctgagggcgcggggacaacttgtgaaagacattgttgccctctagggcggactgtgtaaccggggcacccttcaagtttagctggcctgctgtgcacccctggggtgtcacgtgtttttgaatgtggccccctgaggcgttcagcagtctcaaccgggaggaagaagacagatatgcggtgtgcacccacatacatatgaagagaacgcatcaactg

SEQ ID NO: 638954 - DNA, 227 bp, Homo sapiens
accagctggtcgcgatctccgacttcgtgatctgcccgctcggcctcccgtagtgctgggagttcctggcgtgcgcccccggacccggccccttagatctgtttctgagatgtttttctggctctccagcctgttattgtgagaacaggaggctggtgtgcattgagcaagtgttctcacaaggcctccggtcagcgagaagccattcctacggtgggttggcccaa

SEQ ID NO: 638955 - DNA, 246 bp, Homo sapiens
tagtcggacccgtattctgttgcgttgtggctcagcggttaccaaacctgacaggatccatgaggatactggttccatctctggcctcactcagtaggtcaaggatctggcattgccatgagctgtggtgcaggccgcagactcagcttggatcaggtgttgctgcggctgtggcataggctggcaactgtagctccgatttgacccctagcctgggaactttcatatgctgcaggcgctgccctg

SEQ ID NO: 638956 - DNA, 247 bp, Homo sapiens
cctgcgctacctgctgaattgcagcgattcagaaagctgctttggtttgatcacttgagctcaggagtttgagaccagcctggtcaacatactaagactccattctctacacacaaaaaaattgattttaaattagccgggcacagtgatgcatgcctgtagtcccagctactcaggaggctgagacgggatgaccacttgagcccagtaggtcaagggcgcattgagtcatggctgcactactgca

SEQ ID NO: 638957 - DNA, 684 bp, Homo sapiens
cctcaggttcatggaaggttcccaagacctcttgaaaatcggcgacaaatgcgaaaccatcgtgaaccaaacataatccccgggcttaagtttttctttcggcgatcaaacccccttcttgttcttgcaaggggccgccccgttatttccaattccctccattgctcacaagtttcgggggtgaactggggaaatagctttcacttgaagtttaaaatttaaagttgtgccctaagcgtctgccaggaattccctcccttccatcgacttaccggcccgctctatagagcgtgagctcaagcacagaccaatctgcattgttacgcttgtgtggcccatgtccaacccaaccacatggcccttatagcgtgtgatggatttgttagctgcttatgaacataagtcatgcaaaacgcctgctacgctgacctgatggttccaggatggtcataaggtggtagtgccctgccaactggcagtcggcttacatcattctttttacaagctattaagcagcctatgagcttaaaatgtgtacaagcaagagcaatagttctatcccctgctttttcctgtgtcttggtgtaaagccggtgcccagtctacaccccgtgtgtttctctaagccttttcccatctttttgcgtgctccagttgttccactattgaaaaattttcaccggc

SEQ ID NO: 638958 - DNA, 403 bp, Homo sapiens
  misc_feature (26)..(26): n is a, c, g, or t
  misc_feature (69)..(69): n is a, c, g, or t
  misc_feature (116)..(116): n is a, c, g, or t
  misc_feature (164)..(164): n is a, c, g, or t
  misc_feature (171)..(171): n is a, c, g, or t
  misc_feature (201)..(201): n is a, c, g, or t
  misc_feature (220)..(220): n is a, c, g, or t
  misc_feature (229)..(229): n is a, c, g, or t
  misc_feature (236)..(236): n is a, c, g, or t
  misc_feature (245)..(245): n is a, c, g, or t
  misc_feature (316)..(316): n is a, c, g, or t
  misc_feature (344)..(344): n is a, c, g, or t
  misc_feature (349)..(349): n is a, c, g, or t
  misc_feature (387)..(387): n is a, c, g, or t
acataaaagtggaaaaccaaaattantagtaatctcttcaaagaatcgagaattgcgtacaaaaaaaancttaaataaataaagaatgaataaatttacaggggtaaatgcaaacngcttccaactcaaagcaagtgacagcccagggtgttctggccaaaganatcagcnaagagagggaagtgggtcctacggcttggnctttccaaccctgagaganccgcaaganaaaacanctggttttngcgagcgtctggagagatcccagaccactcagccctgacacgttaataccctgcccagatcagaggctgcnggccaaaaagattaaccaagccaaaganttgtnttccacaagcccgttcttaccttagccacgaagtaccnagcaaaaggtcctaaa

SEQ ID NO: 638959 - DNA, 855 bp, Homo sapiens
ccctgtacacgtatcctgggaaactggagggccttcaaggtctctcatcgctgctcagtacagcggggctcaggtccgcgtgctctccggaccaccccacttccatttggccaaatcaacgcacccctgaatttctccgcaaatttcctgccggcgaggtcccagcatttgaggggtgatgatggattctgtgtgtttgagagcaacgccattgtcctactatgtgagcaatgaggagctgcggggaagtacttcctagaggcaggagcccaggtggtgcatatgggtgagctttgctgattccgatatagtgcccccagccaagttacctgtggtgttccccaccttgggcaatcatgctaacacaaacaaacaggccatctgacgaatgccacaggaggaccgtgatggctgaattctggggctgctggatgcttacttgaagacgaggacttttctggtgggcgaacgagtgacattggctgacatcacagttgtctgcaccctgttgtggctctatgacgcacggttctagagccttctttccgcagggctttttcccattagcaaaccggtggtttcctcacctgagattaaaccaagccccaagctccggggcctgtcattgggggacagtgcacacctggtgtgacgaagatggcccaggtttgagtgcttaaaacggtttggagaagacccaagcctataaagggccacaccacgggaaagagaagcgttcacgggacagagaaagcagaacccccagggttacgcgggaggcagcgcacaaggcggttgccctgtcctcggggggcaatggtgaatgtacaagccgcgtgtggccaaggcaggcct

SEQ ID NO: 638960 - DNA, 229 bp, Homo sapiens
ccaacattggcctctgacttcgagtgcgatcagcggcgaacagctcattcacgcgctgttgttgcttgtcagtaggtagatgatctgcgccggtgggaagggttcgctgattctggtaagcaggtggtgcctgcggtcccaggtgctgtacagctcgatttggacccggcaccgacacaagtcgagcgcgtcacctgcgaggcggatgacgtggatgcggtccacgacc

SEQ ID NO: 638961 - DNA, 435 bp, Homo sapiens
accaaatcaccagaaacattagtcttggaggaaaaaagaaagttagagataggcgtcttctgtgtggaggaaaaggttgccttttttcgttctttggtcttttaaatttttttctccttttctttttttctttttcttcttttttttctaccactctgaatgcacttggtctgatcgggtcttcgaagctaagcagagtcaagcctcgttagtatttcgatgggagacaagttgggaaaattggggtgacgtaggctttaagcttttttattttattttatttatttatttttattttggttcattggctttggggatcttagtcataaattcttggcctaggccaatgtctaggacagtttttcctaggttttcttctagaatttttatgatttcaggtcttaaagtctttaatccatcttaggttaaatttgg

SEQ ID NO: 638962 - DNA, 1377 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtagggcattagcggcctccgcggatactcgctcagttctaagcacacatgg

SEQ ID NO: 638963 - DNA, 499 bp, Homo sapiens
ggccgagcaagcccagctaggtatggcgatggtgaagcggttctttgaatcttaccatgaggtccccgacggcacccagtgtcatcgcaagacctacatcaccacggccttaggcggcatttgcggcataatcggctccgcttacagcgtctcactcaaccccgcagattccaccctggaagcagtggccagagtcggccggtacacattcactgcagctgctattggagcgatgtttggccttaccacctgtgtcagtgcccaggtccgagagaagccagatgaccccctgaactactttcattggtggctgcgcgggaggcctgacattgggagctcgcactcacagctatgggacagcagccatgggctgtgtctacatggcactgcggccgccctgttcaagatcggcaagctggaaggctgggagttgttccctacccccaaggtgtgagccaaacccctgtgacaaataaacgctgtatgttcctgtgaaaaa

SEQ ID NO: 638964 - DNA, 2810 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtgacgggtctgctgcagtcctcagtcgggggtcctgggcaccatgtgactccccatcctcccatgaggggtccctgccctggatgagtcctagctgggggacaccctgagagctcgagcccctcccacccgggcatccgctggctgcctcctgtcagctgggcaggcggggcccacagtacctgccccaccaggacagcctggctcaggcctttctgggctgcttctcacatcctgggctggatgtgggtttggaagctctggaaccatcccggactcgcccactcctggattcgagggccctcgcagggacagctctgcccagcatcaccccagggcctggcagtgatagagctgagagctccacccccacatacctgccacccacctggccagccacagcacgtgtgtcacctgcagagagccacccagacgtccccaccgagtccagcacggcaagggtgcaggggctgccctagaaatggactcagaggagcctggcccaccctcttgaaactggtcctggaccttggctcagctctgccgcctcaggtagcacgacccccaggccagcctggacacatcagggagcatggtgaggggcaacggcaggacccgtgggccatatcgggacaggcatttccagcgaggggtggggcagaggacatgtggctggcaggctacacccaccctgccatgcagcggtgtccaggctctggggaggccctggggaatttggaggcatcatgagccaaggcctggtggccctcgttcccctgcccctcgtcaccatcctgtccttggctggccgtgaggactcccctcctcaccactgggtcccacagggctgaggtgggcagtagagggcataggtgggtacatgtcccgggcaaggtctctcggggggacagaagtgagtccagggagtgggtgggcctgggcgtccctcactcagaatgccgtggggtgaggacggtgaggacagggtgggcactgggttctggtttagagtcagtaatgttagggcgcagtgggcagggggtcaggacatctccagccggtggtgaggaagcatggtggggtctcctccacaggacgggagctggggagggggtcctgggtcggacccaaggcacccacacttgagaaagcctccgcctggacgtcagggaggcctgcgagctgccacagtgcaggtgcagccgttcccaccgccctgctgctgcttgacacgggcataggagatacaagtggtgtgtgcggcggttcatgcctgtaatcccagtactttggaaagccgtggcgggaggaacgctgggcaacatggtgaaaccccgtctctaccccctaaaaatagaaaaattggcaagaaaaaaaacaaaaacaaaaactcgcgtcttttctgggcggaaagtttaggcgctgcatgttctgccttttaaggc

SEQ ID NO: 638965 - DNA, 895 bp, Homo sapiens
gattgctgaggcgcggaacggaggatggcgctggtggcgttggtggctggggctcggctggggcggcggctgatgctgggccggggctggtggcgagggcactggacggcggccatggctgctcccggagccggcgcgaagcggcagaagccgaggcggaggtgcccgtggtccagtacgtgggcgagcgcgcatgcccagctgcctgatcgcggtcttcgtgtggggcttcagcttctcgaggggcgcatgggcagtgccttcctttgtggtgcccagctcctgggccctgggaccccgcgcctggctgccacagaacgggcctgcattgatccagcccgtgccctatcgcctggagctggagcaaacagatttcatctgctgcttgcggctatggagttcaacactgctgtgctcataagactgcggatgttacgaaagtctgggtggatgggacgtcaaggaaagattctcaggaatatggagtataaacaggagccaggaaagataaaaaagatgtggctacgagtatgtgtaggaagagcctcaacagggttaccactgactctggagagaacttcaggaggagaacgggtgatgagggtctccatgagggcagaagaaacgaataacattggatgttgagtggagcaggttcacaggaagtcttaacgggaatgggaaaaaaggagtgacctatcattgggggcaaagtggatgggagaagagagaggatggtcgagagaaatgagagaatatacgagttgaaaaggttaagaggaggatgcgcagaggaagtggagggaagtatagaaatgagcagaggtggggacgcaaaggtcaggcatgatagagagaaggaagtagtaggactggagcgcgtgaacgaggaaag

SEQ ID NO: 638966 - DNA, 1947 bp, Homo sapiens
  misc_feature (1163)..(1163): n is a, c, g, or t
  misc_feature (1258)..(1258): n is a, c, g, or t
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccagtgttcatggagcctcttgagtctgcattcgtactcttagcaaacttggaaaatttgaggcnaaattcttcaaatattttttctgtttcttctcttctgtcttctcgttggagaccacaaacactagatccattgaatttgtcccacagctcacgantacaccttttacctttggaattctttccccgtgagacggagtctcgctctgtcgcccaggctggagtgcagttgacagcaatctggctcgctgcagctctgctcccgggtcacgccatctcctgcctcagcctcccaagtagctgggactacaggcgtctgccaccgcgccctgctaatttggtatctttagtagagatagggatttcaccgcataagccaggatggtctcgatctcctgacctcatgatccgcccatccttggcctcccaaagtgctgggattacaggggtgagccaccacaccgggctgggatactattttctctgttttcttgtttttaccggaaaacggggtctccctcagaatccaggctgcgtgcacgtgggtgcgaacattgcccacggcggccccaacacaaccgggctgaagccatcctcccagcctcagcctcgacaaattagtcggggaccccgggtgcatgccacctatggccccgcaatttggcatcctccggtagaagacggggttcgcgcccatgctgctcgaggctggtctcacaatccctaggcacaaggaggattcctcccttgccactaccccccccaagtggtggcgaatcgaccaagtgtgacccccgtgctgcgcccgggcagtctaccactccgtcgccaaccgtgccgttaatcc

SEQ ID NO: 638967 - DNA, 1279 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtgagccaagggctctccctgccgtgctgaaggtgtcactgggcgcgggtgggtgtgggtgtaaggaggcagagtgatggggagggtctcggtcccctggggcttctgccccaacagagtcagagataggggctggcccaggagccggtcctgcttggtgccaccccagtggtggta

SEQ ID NO: 638968 - DNA, 1383 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 638969 - DNA, 294 bp, Homo sapiens
agagagagggagagggaggtgggagaggatcatggtgatcaattgaagcattgtgaagcacatcatgtcagctaaaccgtgccaggaagccagggaaggtgtgcagggacgtctcatctccatgtgtgatgctgacacagcggctggagtcgtggaaaggaggggagcttacaagatcctggaaaaaccttggacctccacgtggttgcgctctggccctctcaggctgtgcttactgtgacagcagatctgtccccacccatgggctcatgaataaatggctcttgcggctca

SEQ ID NO: 638970 - DNA, 191 bp, Homo sapiens
gacctgaccgaccgctgcagcgcccactcgtaaacacctcaccgctgcagcgctacaaacccagcgctgcaacgtacgcgtcagaagcagcaacccgagagcgatgacgctctcaggtaccagcgctgcagcgctcactcgtgaccgctgcagcgctcacccagcgctgcagcgcgcggccaaaactgcag

SEQ ID NO: 638971 - DNA, 1110 bp, Homo sapiens
taatttcagtgcacggggctcggggttttgagttgatagtctaggtggcccatcgtttgcctagtgtggcatatactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 638972 - DNA, 109 bp, Homo sapiens
gtgttctgctctgtttatctctgcttggcgtgtgaccccggctatttatggacactggggcttctggtcttgcgcttccagatctcagccttctctgtgtgtgtggatc

SEQ ID NO: 638973 - DNA, 715 bp, Homo sapiens
  misc_feature (326)..(326): n is a, c, g, or t
  misc_feature (521)..(521): n is a, c, g, or t
  misc_feature (601)..(601): n is a, c, g, or t
  misc_feature (623)..(623): n is a, c, g, or t
  misc_feature (641)..(641): n is a, c, g, or t
  misc_feature (644)..(644): n is a, c, g, or t
  misc_feature (679)..(679): n is a, c, g, or t
gcaacccgcttgggtccccttccacactgtggaagctttgttctttcactctttgcaataaatcttgctactgttcactctttgggtccacactgcttttatgagctataacactcaccgcaaaggtctgcagcttcactcctgaagccagcgagaccacaagcccactgggaggaacgaacaactccaggcgcgcaatgaacaactccaggcgcgccgccttaagagctgtaacactcaccgcgaaggtctgcagtttcactcctaagccagcgagaccacgaacccaccagaaggaagaaactccaaacacatctgaacattanaaggaacaaactccagatgcgccaccttaagagctgtaacactcaccgcgagggtccacggcttcattcttgaagtcagtgagagaccaagaacccaccaattccggacacattttggcgaccatgaagggactttcgcctattgccaagcggtgagacaatcgctgagcagtgagaccatcacctattgccgancggtgaagaccattgcctatcgccaagcaaatcgaggccatcaagctacagatggtcttacaaatggaacccccaatgantcgactaacaacttctaccganggaccctggactgaacanctngcacttccctgggcctaaaaaattcccctctgaangaacctacactgccaaagcccccttcttcgccctat

SEQ ID NO: 638974 - DNA, 284 bp, Homo sapiens
taattacagcacatagggacacttgaggcgggagaatggcttgagttcaggaatacaagaaccagcgtgggcaacgcaacaagacaacatctttacaaaatccttaaaaatcagctgggcgtggcggcacccacctgcagtctcagctactcgggaggttgaggcgggaggttcacttgagcccaggcagttgagacttcagtgactcgtgatcgtgtcactgtcctccagcctggcaacagagcaaaactccttctcacaaaaaaataaaactagtgtagagg

SEQ ID NO: 638975 - DNA, 354 bp, Homo sapiens
ctctctcgctccagcgggctcaggactgtccggtatgcggagggcagcatgcggatatggtttaacgatgaaccgttgcagtgcgccgaagcgacctccgtcgccgatctgctcacgcagctggaacagcagcagccgggcgtcgcgctggcgctcaatcaacgcatcctgccgcatgaacagtggcaagatcatctcttacaggaaggcgatcaaatcctgctttttcaggttatcgctggaggctgacatgttacgtattgcggataaaacctttgagtcacatcttttcaccggcaccggtaaattcgccgcccccgacgtcatggtggaggccattcgcgcctccggcag

SEQ ID NO: 638976 - DNA, 1432 bp, Homo sapiens
tgcgcggcggcggcgcgcgggcgcctggggcgggacttccggcgcgctggagcgttttccggccgtgcgtttgtggccgtccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgaccgaccagctgggcatgttcacgcacaaggagtttgagcagctggcccccgtgctggatggtttcagcctcatgacctacgactactctacagcgcatcagcctggccctaatgcacccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 638977 - DNA, 366 bp, Homo sapiens
gcggtcggcagagaagccaggctcatgctgagccaggctaagctctgaacatttatcagggagacttgatctacttcaatgtgatgtaagaaaatcaaatgtgctttcagcagaagatccagggtaggaaaccaacaatagagagaaatggtggcttctgctgccttacagagtgggagctgtgcctgagccttctgcctctcagcccagagcctggcatttcttgaaccatgagacgtaaagtttattgttgagagcctgagaaactgtggatgctggggacgggtctgtcttccccttcatttcctggtgaagagcccaggctggggcatccacggttctgggcatggtgggtcagaacataag

SEQ ID NO: 638978 - DNA, 390 bp, Homo sapiens
atcactcacagcggtccccctgcctcagaaaatcactcagagtcattcccctgcctcagaaaatcactcacagtcatgcccctgcctcacacagtcacacggttgtgacacacacactgggccgcctgccctggcgctgtgtttgcattttatttattttattatttcatttacacacactcactcagcgtcatgcccctgcctcagagactccaacactatcgctggagtgacaaccaccaggtccccctacaccctgaccttgcatcctactctggttctgctctgaactttaaatggagagcccacccccagaggaaacgtcgtatgaacctctgagacagacgccaccgccgtagacgcggccgcgaatttagtagtagtaggcgg

SEQ ID NO: 638979 - DNA, 225 bp, Homo sapiens
cacgaggtggttctcctgtgatcacaggaatgccgcatcaaatgccacggccatggggtctgcaataccaccaggcactgccactgtgactagggttgggcacctcctctgtgcatgacccagctcagcacatccatctcgctgaccacatgcctgctcctcagcctcctgatgttattgttcctcgtactacttggtgccagttactggtaccgtgtccgcctg

SEQ ID NO: 638980 - DNA, 1304 bp, Homo sapiens
tgcgcggcggcggcgcgcgggcgcctggggcgggacttccggcgcgctggagcgttttccggccgtgcgtttgtggccgtccggcctccctgacatgcagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgatgtcaccaaggtctttgggagcaagttcacacagatctcacccgtctggctgcagctgaagagacgtggccgtgagatgtttgaggtcacgggcctccacgacgtggaccaagggtggatgcgagctgtcaggaagcatgccaagggcctgcacatagtgcctcggctcctgtttgaggactggacttacgatgatttccggaacgtcttagacagtgaggatgagatagaggagctgagcaagaccgtggtccaggtggcaaagaaccagcatttcgatggcttcgtggtggaggtctggaaccagctgctaagccagaagcgcgtgggcctcatccacatgctcacccacttggccgaggctctgcaccaggcccggctgctggccctcctggtcatcccgcctgccatcacccccgggcccctgtcctgggttcgagcctgcgtccaggtcctggacccgaagtccaagtggcgaagcaaaatcctcctggggctcaacttctatggtatggactacgcgacctccaaggatgcccgtgagcctgttgtcggggccaggtacatccagacactgaaggaccacaggccccggatggtgtgggacagccaggtctcagagcacttcttcgagtacaagaagagccgcagtgggaggcacgtcgtcttctacccaaccctgaagtccctgcaggtgcggctggagctggcccgggagctgggcgttggggtctctatctgggagctgggccagggcctggactacttctacgacctgctctaggtgggcattgcggcctccgcggtggacgtgttcttttctaagccatggagtgagtgagcaggtgtgaaatacaggcctccactccgtttgctgtga

SEQ ID NO: 638981 - DNA, 624 bp, Homo sapiens
tgcgcggcggcggcgcgcgggcgcctggggcgggacttccggcgcgctggagcgttttccggccgtgcgtttgtggccgtccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactaccctgtcaaagtcagatgccaaaaaagccgcctcaaagacgctgctggagaagagtcagttttcagataagccggtgcaagaccggggtttggtggtgacggacctcaaagctgagagtgtggttcttgagcatcgcagctactgctcggcaaaggcccgggacagacactttgctggggatgtactgggctatgtcactccatggaacagccatggctacgagtgggcattgcggcctccgcggtggacgtgttcttttctaagccatggagtgagtgagcaggtgtgaaatacaggcctccactccgtttgctgtga

SEQ ID NO: 638982 - DNA, 252 bp, Homo sapiens
tgccctcaggtgatccgcccacctcggcctctcaaagtgctgggattacaggcgtgagccaccatgcctgaccttatgtacttatatttttatgagaatatttctcttggttttctgataaatgagttactggcacccttatgaatttgaatgcaaatgaaacagctaaatgttatataattgtcgtgtttaaaaagcagattataaaactgtctgtattatatgattacagttttataaaaacaaaaaaaa

SEQ ID NO: 638983 - DNA, 173 bp, Homo sapiens
tacgcagcagctgaagtgggattgcttgatcgctggaggtggtatgaggtgtagtgagctatgattgcagcactgtactccaggctgtggcactgagcaagatggaaagaacaaggaaaaaagatggctgggcgcggtgcgatcatgcctattatcccaccacctcgtggggc

SEQ ID NO: 638984 - DNA, 343 bp, Homo sapiens
ttttggagaggatacagaatcgggatatgtgtgtttgcttctagtgatccacattctcctgtgtggatgggtggcccccagggctatgtttataggatggcaggggcagggaacctggggaaggtttgtgaagcacccaggaggtcgcgcctcagaagaggagcctgcaggctgcctccaaacggatggattccgtgatgccccagagggcagaagactagactttagaaagagagaaaggacagtggcctatggagcccagagcctgggatttgaggcctgacctacctctccctgactgtgtgactgtgagccatcacgtacccaccccgtcgggtggagc

SEQ ID NO: 638985 - DNA, 525 bp, Homo sapiens
agaggaaattcctttgcttcttaaagctgccagtcccggctttttgggggctcatgtgttataaattctggaagctattttagctgcagtttgagcatcaggctaatcttcttcctcttcctcggttcgcttgtgttttagaaacaagtcagactttaagaagcggctgtagctgtcgtagttcatgagattaaagatatggtcgtggagtttctggaacatcagagggtgaggttgttccaggatcttctcgttgagcagagactgcccctccacgttgacctgtgatcaggcagtgctggacaggaaggtcatgtagatttcatttaccttttcgtgtatgtgggtcttatcttgcattttgttaagatcttcagatgctagccgacacacagcattttgtgcgctggacccctctatccacagaagcatcagtagtaggccaagcagtgcagtagtaggaggcgggcccagctgctcgacagcagtcccggcagctccttgagctgttgttgcagccacatc

SEQ ID NO: 638986 - DNA, 418 bp, Homo sapiens
ggtgttcgacatgttggctaggctggtctcgaactcctgacctcatgatctgcccaccttgtgctcccaaagtgctgggattacagatgtgagccatcgtgcctggacatgtgcccactttttgatgaggttttttcttttcttcttgctgatttgagttttttgtagattcaggatattagtcctttgtcagatatgtagtttgcaaatattttctcccattctgtgggttgtctgtttactctgatgattacttcttttgctatgcagaagctttttagtttaattaagtcctatttatttatttttgttttgttgcatttgcttttggggtcttagtcataaattccttgcctaggtcaatgtccaggcgagtatttccaaggtttacttctagaattcttatggtttcaggtct

SEQ ID NO: 638987 - DNA, 425 bp, Homo sapiens
atgcatacgtccacaggcctctagagcacaacgtcgtagactgttgccaaagatgttccccctggcatgtgcgctggtggccttcgctctcaacactcctaagacatgtaacaggtaagcccacgacggaaacaccttactccaagctggaaccaaagacaatcttccctagggattttttgttacactacgaaatgagacaagtggtagactgtttctaaaattcaaatgctgttaacaagccatatttactgctttactgagaaactgcaccataaaacaacaacaacaaacaaaagccactggaacagaggtaaagcaagaccaagacgtaaagacaataatgaagggtattcaatatccagtcccaattgtttctgaagcctaactcattccttggcctctctgccattgggttatttgct

SEQ ID NO: 638988 - DNA, 1015 bp, Homo sapiens
  misc_feature (137)..(137): n is a, c, g, or t
ctggctggtaactctcagctgccctggccaataactgacatgtagaaggagggtacaaaagacgggctcccttgctttaaggaggcctaactgtggtgccatttgtgctcagagttccccatgagagcaagcggaantaggtctccacgtgagaccacactctggctcagccttagcctttttctcgccctgtcttgcttccctcacccccttctcctgagagcatttccccaataattcacttgaacaagaatgctcagcttaggctctgcttctagggaacctggacccatgacacgctctgttagcttcctgagagactatcttgttagttcccctaggaacaaattcctgtcttgggactctgcttatgatcactcccttcattcccctgccaagaatgacagctcagtgagggaatatgttcttcacttccctagaactgttcctagaacacagtaggtgctcaatgatgcactgaatgcatgcatggggagagcccagagtctatctgacagctcagcggtcagcaccccttcttgtcctggggtggcctggcctggaggcattgtgagtcatagcaggtggacaagagctgagtgggtcagagatgggactagccctgtggacagcagctcagcaactccaccccatcttccaggtgaggaacaacatacagtgaggactaacggggaaacatcctccgagaagatacaatctcaagggtgggcctggatgtgggcttccagagaccatctccctgaaccagatcttggggatgcagcgccccctggctcgccttcatcattctggacatccgggctcccgagacaagagcgcagcacgagtcgccagcgctcccgaggctccccttcgagcacctgcgtgccctacaaggtccacgccctggcaaccttcgagtgctcggctacgagccatgccagccgcctgtggcagacgctgcagcagttttgggccgatcacatctcgcggcccttctcgccacggcggccgc

SEQ ID NO: 638989 - DNA, 734 bp, Homo sapiens
gacagataaacactttgtttattcatcctcctcctcatctcctcctcgtcttcatcttcctcttccacctttttccaggcaactttagcaggacgctttgagccatcaaacttccctttcgacttagaatcagcaacatccttctcgtacttctccttcagctttgccgtcttagtgatgtaaggctgcttttcactgtcatttaagttattccacatctcacccagcttttttgccacatctccaatagagatgccagggtttgtggatttgatcttggggcggatttccgaagagaacaggaagaatccagatggtggccttttgggggcactaggatccttcttcttcttgcctcccttagctggtcccttcatttcccgatcacagtgcactttatccgtctttgccatttcatcaaatttagacttctctttcccggacattgtcttccacctttcagagcacttcttggaaaattccggactcttgtctcccagcagcgccccctggctcgccttcatcattctggacatccgggctcccgagacaagagcgcagcacgagtcgccagcgctcccgaggctccccttcgagcacctgcgtgccctacaaggtccacgccctggcaaccttcgagtgctcggctacgagccatgccagccgcctgtggcagacgctgcagcagttttgggccgatcacatctcgcggcccttctcgccacggcggccgc

SEQ ID NO: 638990 - DNA, 515 bp, Homo sapiens
  misc_feature (54)..(54): n is a, c, g, or t
  misc_feature (57)..(57): n is a, c, g, or t
tccttacccctcacccttccagctgcaactcagaacaaggccctcctcccgtcnttnatctgcatatgtatcccagggcctgatcctcagtggtctttggggaagatggtttaggtgagactgctgcctgtgcagcgtggaacgacgggctcctcggtggccagcagctggtgagacacagccgcagccgtagctgcagggctaagacatgtccgccggcctcgcggtttgagaggcggcctgtaccaagcacgctgctcacccggactcttgtctcccagcagcgccccctggctcgccttcatcattctggacatccgggctcccgagacaagagcgcagcacgagtcgccagcgctcccgaggctccccttcgagcacctgcgtgccctacaaggtccacgccctggcaaccttcgagtgctcggctacgagccatgccagccgcctgtggcagacgctgcagcagttttgggccgatcacatctcgcggcccttctcgccacggcggccgc

SEQ ID NO: 638991 - DNA, 1374 bp, Homo sapiens
tcagcccccactaaccaacggcacccgcacacacgcgctcccgcgccgccaaacggcacgcccccacacgcagccccacgcggacctactcctacccccctgcacgcgccctgctcgcgcctccacacgctctactaccacgcgcctctctccctgcgcccccagcacacgcacaccccaacaccatcccacccacctctccacacctccacgcgcctctgcctgctctgcaacgcacgcgctctgctcctacctgcacgcctccgcccaccccacacccccggccccgcccctcctgcctccccctcttccccccggcactgcactccccgcgcacacgcacctgcacagcctctccccctgcgccccggcgcaaacacacccaacacgcaccgcgcctcgcctgcgcctctgctgcgcgcgcacccaactacaccctgcactgcactgctgcccgcgcgtctcacgcgcacggcgcctaccccccacacacccctgcacacgcgcgtactgctgcaacactgtccgcccgcctgcaccccaggccccggggccccccggcccaggaccccagcccacttcccctccagcggccccccgcggccggcgcccaaacggcaactcccctccaccctctttttccgcagcccccaagccccatgcgccccccgatgtgcaacccttcccccccctcacacgcggctctgtcttgccgccccaccctgcttcccaatggcccctctctcccagacgccctccctccgcccacaggtgtcggcccgcacgcaagcggctgctatccccgcgccccacttctctcccgcgcccaacgggaccccccccaagcgcaaacccacccgaccaaccaagccaccacccacgcccaaaaacccccgttaacgcctccccggcccctccccaaccgcgcggcccgcggcaaagccttccagaaggccgctgccccacgcaacgggcccccgtacccgtgggcccccaggccctgcacggggcctaccacacaccccacccttacacgccccttgggcacatcccttagcgtccttctacaattctaacacacccacgcactccccactgcccttgcaccccaccccacccaccaaccccgcaccaccccgacgcataaccacacccccgcgcaacgccccacaccacaatcggcactccaccgacctgccggacaccaacccacgacgccgctcccccgcacacgtcggtccccccccggtggcgcccaccaacccagggctcccgcatggtgccccccgcaccactccctccacccccccccgcgcggccaacacctcctgacccgccccaccccacatacgcgaaccccgactactcacacgc

SEQ ID NO: 638992 - DNA, 670 bp, Homo sapiens
acagcctggccggcatggggaggccgcatctctactgaaaatgcaaggattggtgggtgtggaggcgggcgaatgtggtccctcagcctcccgagtagctgcgactacaggcgagtgcctccatgcccagctaattttttgtgtttttggtggagacggggtttcaccatgttggccaggatggtcttgatctcctgaccttgtgatctgtccaccgcggcttcccggggtgctgggattgcaggtgtgagccacagcgcccggccaaaaaaaggaatttttaagaggaaaaagaatgctaccaacctaaccacatttctatgactgtttatatttttccctgttccacatacatacatttttacatagtacgttcattgcagcatgagttacttttcacttaataaattttaaacattttccagctgggtgtggtggctcatgcctgtaatcccaacacttggagaggccaagtcaggcttattgggtgagtccaggtgtttgagactagcctaggcaacatggcgaaactgcgtctctacaaagaatacagaaattagccgggtgtgctggtgcacgcctgtggtcccagctgctcgggaggctgaggtgggaggattgcttgggccgagtgtaggtgtctgggtgctgccaggaaaaacaacctaag

SEQ ID NO: 638993 - DNA, 170 bp, Homo sapiens
gaaaaacatgggggaaacagatgcctcagcctactttcacactaaggaaaaaaacttgttcttcccttctgattagatggtgctattttgctttgttttgttttggttttgttttttttgtaggacaggaatctcggctcttgtcgcccaggcttggggtccagtggcat

SEQ ID NO: 638994 - DNA, 1818 bp, Homo sapiens
  misc_feature (211)..(211): n is a, c, g, or t
ggtagtctgttgagtgggagatccttggcggcgtctcttcgcctcctatcaccgccgcagtacgcccttcaaggtcctaagtcattggcgtgacgttgcaatctcctagtctcaaccgtgggcgcatcggctgggtagtactagattcgcgcaagtagccatagcgtaggcgagcttctaacctgccttaggaagcagcgggctatcgcangccgctgagtaggccacgagtgctcgataggatgcagcgaatggatccaatttgcggtgcgagagacgtagtgtagtgtccattccagagcagcaattctctctgcagctggaaagcgaggctcggcttgggcaacacgatagtgcgcccgggcgcacgtgataatcgtcatcaacgttggacaaacgcgcagcgagtatcagtctgccatggaatgtcttgccgtgacatggactgacatgtagcgcggacgaaccgtacgtatgccaaagcacttgcatgcattgcttcgagtcgacacgtggcgaagggtaacgaatgtctggccaaagtaaacttaatgggacccaggaaaggggtgggaccctcaagacgctcaatttagtgacatagagggccagaaatcctcaatatagggactcgctcaggctggcatcagtggaatagacggtcacaatttccagacctgcaagacagtgagactttcgagacccgagaaataggcatagccaggaattcaattttcccaaaggcgcccactctcctatagaagctgatttggtcacacagaacgaaagaatgttatctcgggaattggggaagcggcgaaaaaaacatttttgggaatatgcaattggggagtggataaaccaaacgtccgtcacagagccggtatggttcacgtacacaaattgaggggaagaaaccgggaatataatttacaatacagaagaggttatcggaacctattcaaatttagggcgccatcaggagaaaaaagggtttctccaaaagaggaacatttggggaaaaaggattatcacattatagaattgttgtgaaaagccccacgaagacgaggaccaccaacacaagggggaattcagacccacacgcaagagagatgagagacaagagtgtgggcaagtcacacccgttaaccacaaaagagtgagcaccagaagtgaccaatagccaaacgcacgaggacgcgacaagcagcaacgcaaagaaccccagtggaggcaacgaccaacctctccttggccagttcaggcatgtgacccactctagcgcaacatggggattgcaagagacagcagcacaacaatgggcacaggggagcacccacatttactacaagtttgcacacacattacctgtggatagcggtcagaagagcaaaaaagacgactcatgtgagcaacattatttctgcgaaaggcaggaggcaccgccaagacaccttaaactcgaacagtatcaagaccttgtataaacacccgactgcagttgataattagcagaccaagaaaatttggagtggatttacccttaccacagttagccaggtgagttctacccccacttgcaacaaatgcattgcaacatctgacgaagaacacccgtcgcaagacatgtttatgacaccagttagcagaagctaacaattggctccagaaaccacaaaacaccttggtgttgagcccctagtgacgaccgagaatgtttcagcaagttcacgatttggtggacacacgatttgtgacgaccagcgatcgaacacactcggtcgtgaagaaaacgacaaatacagagagaacagg

SEQ ID NO: 638995 - DNA, 115 bp, Homo sapiens
ggatttgctggtgcagtacaactaggcttaatagggacatgggtggtgtctgagaggcgtgaagggcctggagccactctgctagaagagaccaataaagggcaggtgtggaaaa

SEQ ID NO: 638996 - DNA, 548 bp, Homo sapiens
  misc_feature (109)..(109): n is a, c, g, or t
  misc_feature (182)..(182): n is a, c, g, or t
  misc_feature (224)..(224): n is a, c, g, or t
  misc_feature (263)..(263): n is a, c, g, or t
  misc_feature (281)..(282): n is a, c, g, or t
  misc_feature (421)..(421): n is a, c, g, or t
ggcacgagagcaaatgagcccttgaacagtcctaagagaccctgaggattctgtggagtagtttgaaaaccattgttctgaggaagggggtccaatcatggctcctctngcacataaagctgcgaactcatggacaaagagggcaacgtgtggcggtagacaacgccatgcatgtctccatngacccactagaggtggacaggacaggttcctgctggtgcccntgtggacttacggctaactatttgcatgtcagacagggncgacttaagccatccagnngcggttttatagtaactagttgcccacccaacataggttccttttaacaacacacactaacggaacatgtgacgggtagtacgcgcagcatgcaggagcagagcactgacacagagggcagcagccgttcatctttagncaaggatgtacagggctatacattcacgttacactcaagacaacaagcacacaacgcagaacccgttcaccaagggcttcacgactacagtcctcgctcctccatcctgggtccccaggcttcccgg

SEQ ID NO: 638997 - DNA, 334 bp, Homo sapiens
gcattcttctagcccacactctcaagtagctgggaatacagacgagtgccaccatgcttggctaataacagtatcactctcagagatgggcgtttcaccatgttgctcaggctggtgataatatatttttaatcggtatagatatttaatggcccgtgctcagaacttatatattgaataaatattccgtgtttcaaagagggtcatacactcaaataattctgaaatgtccacttttatcactgtgattattttacattgcttacattgctatccacaaattacgaaaatcttataataccatctgattagttctccacaaggtggttcgatc

SEQ ID NO: 638998 - DNA, 1166 bp, Homo sapiens
atttagaagaaagatgtttggcgtagccagcagttaacatctccaaataggctcattaacacacaagtctcacaaccatagcagcatctgttctgtggctttggcacatattcaacacaaacttcatgtcaatccttattttcaacaatttcatcagctgtacttcttgcaatatcaaacacaatccatgcccagtcattcttctcaaacggcatttagagttcaactacagcaaaggcaggcttgcccatgtacatttaacatttctttggcaccttgccagttccaaacatattagtgccccaccaagtgctgcagacagtgaatcttgggcctgctgtacgccctatttctttccagatctgcgaacatgtgttagctgcaaaaacataatcatgaaccaatctggatgcctcattatgtcaaccaggtccagatgtgctcataatctgtcttcaccgtatgtaggcccagtcgtcatcagatgcttgcggcaaaaggaaagctgtgtctatactggccagaaagtacaggtgctcggagttttacctgggcttcattctcaatactgcttactaactctagttcacacgcacccgggcacgcgaacaacaaaaaccgaagtggccacactaccctgacctcgggcggctggacgtacccagattaccgcctttcacgtcacgaaaacccctccatgtggtttactacccgggagcagcaccaatggtcatctgggctgacaaccactttacccgttcagcagcttgactacaacggttattggcaccttaaaccgtattcactgcctcattaacagtggcttgccttggcattgctcacaagcgctttgactctactaacgccacttggctctctgcatgccacaaacaatacgcaggatgctcccaagcgcatcgtgtcgacgggcgaagtttctctaacaccgctgtcaccggtttcccactaaagcctcagcccttccactcggcaacgtcggtcaatcagcacgtcgcttacagtcatctcgcctatctataccacctaccgtcagatctccacctacttgttcatagcgcacgtctataggctagcctgtctcagtcagttgtagcgcatagcacaagtcgtgcgagcataagacggctacctctcgaccagcctta

SEQ ID NO: 638999 - DNA, 350 bp, Homo sapiens
  misc_feature (2)..(2): n is a, c, g, or t
  misc_feature (5)..(5): n is a, c, g, or t
  misc_feature (9)..(9): n is a, c, g, or t
  misc_feature (13)..(13): n is a, c, g, or t
  misc_feature (34)..(34): n is a, c, g, or t
  misc_feature (102)..(102): n is a, c, g, or t
  misc_feature (106)..(106): n is a, c, g, or t
  misc_feature (120)..(120): n is a, c, g, or t
  misc_feature (152)..(152): n is a, c, g, or t
  misc_feature (334)..(334): n is a, c, g, or t
cnggngccncgtnatcacgccactgcactccagnctgggcaacactgagcactgagtggacgaggctccgtctgcaatcccgggacctcaggaggccgaggntggnagatcactcgcggntaggagctggagaccagcccggccaacacagngaaaccccgtctccaccaaaatacgaaaaccagtcaggcatggcggaacgcgcctgcaatcccaggcactcagcaggctgaggcaggagaatcaggtagggaggttgcagtgagccgagatggcggaagtacagtccagcttcggctttcacaactttggtggaatcagagggagacgtagngggagagggagaggga

SEQ ID NO: 639000 - DNA, 290 bp, Homo sapiens
gtgggcctggggagcctgtggaagcggaccccgcctgcggacaggcaggcggaagccgagagagagtcgtgacttcatgcacaggttctcagcattaacgagaagcaccttactgagacgtgggccaaaccaaatccaccaggtcggctgctgggctgaggtgcctacagcatgtgccctccaggtgcccctggttgactcaagagaaggatgccatttgactgagccccgcctcagagtaggagctggtggaggggtgaagaggctgtaaaaatcacagacatatgctg

SEQ ID NO: 639001 - DNA, 249 bp, Homo sapiens
  misc_feature (3)..(3): n is a, c, g, or t
  misc_feature (84)..(84): n is a, c, g, or t
  misc_feature (194)..(194): n is a, c, g, or t
  misc_feature (234)..(234): n is a, c, g, or t
aanaaaaaaaaaaaaaaatccctgaacgcaattgattctcctgtctcagcgtcccaaagtgcctgggataataggtgtaagccnccatgccctgacactttatttttatttatttatttatttagttattgagacagagtttcgctcttgttgcccagactggagtgcaatggcgcgatcttggctcactgcancctgggaggcggagcttgcagtgagccgagattgcgccantgcactgcagcccgg

SEQ ID NO: 639002 - DNA, 572 bp, Homo sapiens
  misc_feature (381)..(381): n is a, c, g, or t
  misc_feature (507)..(507): n is a, c, g, or t
cgcattctttccttccaatttccaatccagaatcttttgtccgcagtccttttttattttccggaaccaattgaagattaagggaatttcttgccgataaccgaagacaccccgctcttccttgccagcactggaccggcaaagatccatcacgcaaaagacaaaatattgtccaacaccgccatcgttgtccgtcgacaacgcttcatatcaaataattttcaactgacaggaaattaaataaggcatttcgccaaccccgatttaccgcgcaaacgattgcgaaaagcatacaaacgttttactgcgacactttgccaccctcattaattccaattcattgattaatccgatcttcaattcccgatcgtgaatttctcncatgcgcggtcgccgacacgaaatgtgcggccagaatggccgggagaaaaccgcgaagatgcgcgcacacgtttgcccggagggcgacgcgaacggtcgccggacagggaatgcggcgcagcgcanccggcgccctgccgcgagatgaaaagacatctggatggttcgctggaccgcgagaggaagcgccg

SEQ ID NO: 639003 - DNA, 838 bp, Homo sapiens
  misc_feature (3)..(3): n is a, c, g, or t
  misc_feature (66)..(66): n is a, c, g, or t
  misc_feature (109)..(109): n is a, c, g, or t
  misc_feature (118)..(118): n is a, c, g, or t
  misc_feature (140)..(140): n is a, c, g, or t
  misc_feature (165)..(165): n is a, c, g, or t
  misc_feature (186)..(186): n is a, c, g, or t
  misc_feature (196)..(196): n is a, c, g, or t
  misc_feature (215)..(216): n is a, c, g, or t
  misc_feature (238)..(238): n is a, c, g, or t
  misc_feature (296)..(296): n is a, c, g, or t
  misc_feature (311)..(311): n is a, c, g, or t
  misc_feature (315)..(315): n is a, c, g, or t
  misc_feature (337)..(337): n is a, c, g, or t
  misc_feature (351)..(351): n is a, c, g, or t
  misc_feature (388)..(388): n is a, c, g, or t
  misc_feature (393)..(393): n is a, c, g, or t
  misc_feature (428)..(428): n is a, c, g, or t
  misc_feature (433)..(433): n is a, c, g, or t
  misc_feature (435)..(435): n is a, c, g, or t
  misc_feature (437)..(437): n is a, c, g, or t
  misc_feature (454)..(454): n is a, c, g, or t
  misc_feature (457)..(457): n is a, c, g, or t
  misc_feature (459)..(459): n is a, c, g, or t
  misc_feature (462)..(462): n is a, c, g, or t
  misc_feature (464)..(464): n is a, c, g, or t
  misc_feature (468)..(469): n is a, c, g, or t
  misc_feature (480)..(480): n is a, c, g, or t
  misc_feature (484)..(484): n is a, c, g, or t
  misc_feature (490)..(490): n is a, c, g, or t
  misc_feature (493)..(493): n is a, c, g, or t
  misc_feature (501)..(501): n is a, c, g, or t
  misc_feature (511)..(511): n is a, c, g, or t
  misc_feature (515)..(515): n is a, c, g, or t
  misc_feature (538)..(538): n is a, c, g, or t
  misc_feature (626)..(626): n is a, c, g, or t
  misc_feature (630)..(630): n is a, c, g, or t
  misc_feature (833)..(833): n is a, c, g, or t
tcngtacaacgtttgccaccatcaatatacttgaatcttgatacaaatttacaccagtgtctatantttaccaaataatagttgactaactaaagttcatcaaaatagntgttgtggngtgggaaagacttttacccaantaagtacaaggaaagttacaaaccngacctccactttctaaaaatnagaagtttantcagtcttagaaaactacnngctagcaaatgtacagagagcnggctggtgctaacaccacagttgggacagatgtctttttaagggtctatttttaaagnctgttgccattggcngatnctcggtcacttgcttcttttcnaggccaaaaacacnatacaaggtctggccatttccccaggtcatgcttacnagttnggctttatgtacatttatcgcatatttaagtgctnggtanangncttgtaaaatttccagnacnancangnttannacgtttaactntccnagtaanagntgccgaanaggttaacantaanaactttcaagtgtaatagtgcanattccctctgcgtgatttactgcagagaaagattctttgaaattacattttttcttttataggtttgttgttaatatttaggtatttnttgnagttactgttaccaccctaggacttccctccctagcaaataaagtgatcatttacttggactcacaggctattaaaattaatcattgaaaggtactgtccaaactatggcactgtcacttaaaatttttttttttttttaccattctatcttgtgccagatcttcacagctgtgacatggtttaaattccataatccatcccnagagg

SEQ ID NO: 639004 - DNA, 1698 bp, Homo sapiens
  misc_feature (1474)..(1474): n is a, c, g, or t
cctgtgtatactcgccgaccccccttcctcttggtgtgtggagggtcgcgcgctacgtgcgatcggaccgcttgggctcattatctccgctccgtaagttgttcaccggcgtgtttttctcagtagatagtgtccgtcacctccctcgctggtgctgaagtactagtcagtgttgtcggcgagtaaactacgcccggcctctgtttgttgttgtgctggaagaaagtaatacgctcgcccctccgtgagtttatatatgccgcccgctgggtgggccgtttgttgtgtgtggtgcggcacgaacacgatgcccgctcgtcgtgtttatttgttctccccgccgacggcttctcttcattcaactcacgagggaggggagctattataatttgtgccgcaaccccgctggtagaatgtatttccctcgccctgtgttgtgtgacaccccccccggcgggaggtgggtgtgttgtagagaaagttgtaccccccccctcgtgtggacagcccgcttgttgaagaaatttggtcgtcgtcgtccctcccttctgtgaaatgcattcttctctcgcgcctcccctctttggggggtgggcacaacaaaaaaagaggaggaaaaggagttctctcctgccccccgctctgtcttattatactataagattattcctgtatgatcaagattacaacctccccttctcccgcttgtgggggaaccacttctgtgtttcccccaacaaggagggatgtggtgtcatataggtgatagaagtgaatattgttgaagaggcgcaattctttaggaagagagggaattatttgtcctctgtgtgaacacattgttggggagacccttccccccaagaagagtggttcctccctcaatactcttgttctctcacaaaatagtgggggttgtgcccaacacgggtgagaccggggggggcgccgccctctctcccctctgtttctttttgcacacaacggacacacgagttggggcgcccttttggtgttatatagtcggagataatagaggttgttctccccctttctcccctcccacgaggcccacacatcgccacagcagagagagagcgctttggtgttacagctctttttgtatatctccctcacagtgggtgcccccaccctatactgagagttcacaataacatgtgtttctcccacacactagtgttgcgctcacatctctctctctctggggcgcacacacatctcacgacctcacagcccccacatactcacagagaatagcccacagagggtttgctctctgtcccttgagcacaacacccattttttctacaccttctctcacacattctccacacactgtttgagacacacacacctgagatgtagatgtttgatgaatactttgtgcccaacacatatttctccttacacacaacagccgagagatgtctttgtaggaaaccctacacacatnttgggaccaatagagaagagctgcttcctctcggcctcacgggcaccacactcccttctttcctctggcttcctcgctttttttttccagaacatatatatataccacacacttaccaacattttatattcgggaagaagaggaccggggtggacctgaatttctgtttccctgtttttttggctgaagtctaccctgaataaaacccttttttccctggccca

SEQ ID NO: 639005 - DNA, 179 bp, Homo sapiens
attttcccttttgaaaattccaagaagcttaatataaaggttggccttctcctcaggaaaaagcctctttttggatatgttttaaatggatttttgtccccatatccagaaagtttttaattgtttttcccgtctgtaaggcttgatgttttaaaataataccctttttatatttttta

SEQ ID NO: 639006 - DNA, 176 bp, Homo sapiens
gtcggacgcatcttccctgatagtcactgtctatatcaattacgaactagcaagctacacctcatatctctttcaaactctgggtcacgaaatatacttgatgggtcacagtcagcactgtgtcgatgaaatagaatggattttttttttttttctggcgtgaaagagggaaggag

SEQ ID NO: 639007 - DNA, 105 bp, Homo sapiens
ccatgactcttttcttcagtcctctcaagtagctggatacaggcgcccatcatcagacccagctaattttgtatattagtaaagatgagtttgtgcgcgcgtggg

SEQ ID NO: 639008 - DNA, 128 bp, Homo sapiens
gcttattgtctcctactcctactctccctcctccccctcctccctcctcttcctgtttctccttctctatctccccctgaccccttactctcacctcctatacacctatcaatggacactgcatcaca

SEQ ID NO: 639009 - DNA, 166 bp, Homo sapiens
gactctacaggatccccacgtagagccctgggcatagcatggtcttagtcgaattagtgatgtagctcttagcctctttgattttgatcaataattcgctggccatcattactttattgaattattgttgcaaccccaatgagaatacacaggaacaataaaaaaa

SEQ ID NO: 639010 - DNA, 918 bp, Homo sapiens
tgaatggttctatcaaatataatagcattgaaacattttctaatagttatgatacttatacatgtgctttcaggaagttccttggtgaaacaatgttgaggggggatctaggtaattggcagattctaaataatataatttccagatagtaattttaagagtactcatcgctcttgccaaataagttcagggtattcaaatcttggactagtctctggaaggggatataagagatataaatatcagatgagatatatgttgaaacacagagtattattattatatcaggtggggaattgtggtgttgtgtgatgatggaagggtagggacaataatcgaccatctcaaagccttgacataagagaatactggacttgtttcggtatgatgatcactcagaaatggacggatatcataggaaaacagaaatcctttggaattttacctaagaatcactgcatatgggcaacttcacgagatccaggaccatatttggatccaggcgttcctacacactactgtagttattcatgcaaagacgctcatgtatctgatcctaattactaaaattatttaagataatctatttaaccgtgataaattattgtattctaggtgcaacaaaggacacaattttatggtggcaagtccaaaagcaagtcctaagggggataaatgggtcggcccagaggtccctgctacatgaacatactgacacaggaaccaccgtgacgccatgagggacgagtggggcaccacacgctgatgtagcgcgccacggacgaaaaccaggccacacccaagcgagcagaccggcccaggggagtgcttcacgacgagcacagagaggagacaagacacaacggcccacgggaagacgccacacgaaaacgggctagacaccaacagcgagagacg

SEQ ID NO: 639011 - DNA, 363 bp, Homo sapiens
agacagatacaagtcgagctcggtaccggtgtttccctttgtctggtttcaccctatgggacactacccagtgcatagatgttcagaaatgaaactaaaggcctccctagttttctccctggattactcagtggtggcaaggaaatgctcatttgtgatccttaattatttttttgagacagggtcttgttctatcacccaggctggagtacagtggcacaatcatggctcactgcagcctcaatctcccagactcaagcaatctttcagcctcaacatcctgagtacctgggaccaaaggcacactccaccacacccagctaatttttaatttttttttgtagagacaaagggaaacaccgg

SEQ ID NO: 639012 - DNA, 81 bp, Homo sapiens
tcagccctgtacttctgtgccagcagccaaagcaggggggggtggggcgcctctggaaacaccatatattttggagaggga

SEQ ID NO: 639013 - DNA, 824 bp, Homo sapiens
agcggggttccctctccggggatgcggcggcggacgcgcggctcccagccgtgccctctcacgggctctcccctccccagtgtggccggagcctacctctgcaaggcgatggcccgcgccccgagcgcacgctacgcgatgcctgggatgcccggccatggttttgtatcggctctcggagcccgcgagggatcaggcattatctggggaccaacagcctggaccgaggctcagggcatagcagaccggctgcctccagctaacaggtgaatgtaggacgacaacagacgcgatgcatgcccaagtcccggcagaagcacataactatcccaggagatcagcatgcggctaggaccaggatcctccctgcactggtatttacccacgcgtggtagaaggacccaacgttgaccaagcctactcgcccatggacccaagggccccgacgtgcgcaccagcctacactcgcgagtgggaaacgggcgaggcagcacagcaccgacagggacctcaaaccctgccaggacccttgggacatcgacacactacataaccatgccctgaataacacgaacaccgtcccacgaccgaaaggggccagaaaacaaaagaagagccgtcagaccaaacggcaaagccaacaggaagatggcgcatagaacgcaacgagctagcacacaaaaaccgaagacgagacagccccacaaggcgataccgcacagccaaaatggaatcaaactaacgaagaagaggaaaatggacgccaggacaggggacacgatcccacacatgcaacacgcaaacaacaccactaatcgaaccag

SEQ ID NO: 639014 - DNA, 510 bp, Homo sapiens
ggtcgacggttctcagtcaatgtgttaacaaaaagcagagtggatcactaggtcaggagttcgagaccagcctgatcaacatggtaaaaccccgtctctactaaaaatacaaagattagctgggcatggtggcgctcgcctgtaatcccatctactcgggagactgaggcaggagagtcgcttgaacccgggagacggaggcagcagtgagctgagatcacgtcactgcactccagcctgggcgacaaaatgatactccgtctcaaaaaaaaaaaaaaaaaaaaaaggcagaatgtactcatcccttgggtatttgtaggggattggttccaggacccattgggaagctcaagttttttaggtaaaattgactaatatttgcatataacctatgcacatcatcgcgaggttgtctataatacctaatacatgtaaatgcgaggtttttgttatttactatattgctgagagatggtagaaaaatgtggaaaaggttcattcagcccggct

SEQ ID NO: 639015 - DNA, 1309 bp, Homo sapiens
agcggatattagcatataatgagcaactatgtgggtaggagttttattctgggctctcagagctgcaaagaaagagcagcagacaacagcagttctcaaaccatgggtgccgcacagcaacaagcactccagaccgattcattaccagccaatgcacacagcaacagcaatgcaagcatccagggcagcaaacaaccgggccaagcacagtcatttgcaagtcaatcccaggcaacatgtttccagcatgttctacaaagcacagcattttcgtagccagtatatcaccaacaatggcggcccaaactagaagtgtcactgcgcattgggcaccatctcacagtaggtcattgcgaaaagaatcacacccaattgacccagtggattctctatgcgaccaaggggtctcacaagaggctaccaacagacatccaaaaacccaggggagtcgatcagagtggcgaaatccccagtcagtgtttcaaccagattgtggcaacaagctcccggccacacaaggcaaacacaacaaacaggcaccaggccaaacgcacaacaaacaggcccatgtactaatagggccacacatctctggcacatcccgcagatcaataggggcggcatcgcagccacagtttaagtccatctcatatggcaacgcttggtcccaattgacactttaggcaaacgcaagggaaatccaggaaaattgacgacaacaacggtccacaagcaaggtccaacttcgcgggcaattggccaccacggcattctggcaatgggcactccattctgacaatagtgcccgcaggcaggttccagaacatggcccagagcacacaataaaatcgccagaacacaacacgcacgcgcgcaggttacaccaggcaattggcaaatcgaatcaccgtatgcgggggccacccgcacaacgacacacaactcgcggtcgcacagcaccacggtactgcgcagagggacaaccgcccttatgtagggcaacgcgatgggggggacaaggcaccacacaatagcggagggaacgtagggtatccttcaggcgattaacacccaacaccgatctaaaaccggcacacaggaccacaaagcaccggggggaaagccgaccggacactacgaccacatggttaggccagacaggaccatgacagcgataccatttcacctatagaggacgcaggaagcccgcactagcaaccgagaaaatgtatacgcgacacaacaacacaatagccgcagcaactgggggcaagccggaacagaaatatagacaacacagaacagagca

SEQ ID NO: 639016 - DNA, 244 bp, Homo sapiens
cacgagggggattgggcgtgaattgcacgaccctccggaagccctgcactggtgaagaccgctaacatggctggtgctgcgcgaaggcatggtgttcaccattgagccgttgatcaaccaggggggcaacgcggttctgaccgtggacgctggctgcacggtggtcacgcgcgatggacagctgtccgcgcaattctagcacaccgtgtgcggtgacgccaaagggcgtgcgagtcttgacctt

SEQ ID NO: 639017 - DNA, 182 bp, Homo sapiens
tgaaactagctaagaatgaaggttacaaacatgcaatatcactgtatcatgtgatataggctaacatagatcgtatgtacgagaacaacaataaacttagaattcaggcaataacaacatgtgcaaaccaagcacattaccctgatacggtccttgaccagaaagctcttactggttcagct

SEQ ID NO: 639018 - DNA, 152 bp, Homo sapiens
gggccccccggggggccccctttttttggtttaaccccgttttgtttcctcttcccaagggggcctttttaaaggcccttgggggtggggccccttcccctttttggcccccgcccattccccatttttggcttttaagggggcttggttta

SEQ ID NO: 639019 - DNA, 344 bp, Homo sapiens
tatgcggtctccacatactgcacgtagaagtgccggtactacagtgatctcggtcaccaacacgggcttgtacgctagcagatcgctccttctcctccagcactggatcacctcctccacgggctgcttctcatagtgggcccagaccttctctatcttctgcttagcggcctcctcggaaaacagcagggactatgtagtaggagctgcgttcggcggtgaagtggacccttggaagagacgcgtgctcaaccagcaggccggaacaggttggcacagtcgatagtgcagccagccgataaagttgccggcctatgtaccaatgactctccacctccaactcc

SEQ ID NO: 639020 - DNA, 388 bp, Homo sapiens
  misc_feature (382)..(382): n is a, c, g, or t
gaaatatatatgcacctaacacaggagcacccagattcataaagcaagttcttagaaacctatgaagatacttaggtcactacaaaataatagtgggagactgcagcatgcccattgacagtattacagatcattgaggcagaaaactaacaaaaatattcagggcctgaatttgacatttgacaaaattgacctaatagacatctaaagaacactccacccaaaaacaacagaatatacattcctcttatctgcacataacacatattgtaaaattaatcacataatcagacatcaaggcaatcctcaggaaatttttttttaaaaagatggaaatcataccaaccatgctttccggaccacaatggcatgggaattgganttggat

SEQ ID NO: 639021 - DNA, 172 bp, Homo sapiens
  misc_feature (5)..(5): n is a, c, g, or t
gtcgnggtggagtggctaggctaagcgtcaagagctgttttgttgcgtgcttgatgcttgtcccttttgagcgtggtgatttagagggtgaactcaccggaacggggatgcttgcatgtgtaatcttactaagagctaatagaaaggctaggaccaaacctataccacgaca

SEQ ID NO: 639022 - DNA, 392 bp, Homo sapiens
tgctgcacagctcgtctggctgcctccctccgggttagtgttcttggggttgaccgacactctccgtgcatcctcgacctgttcccctgcacagtttttttcttcctggtgtacagatgtgacccggtatctcccatcataaaaagcagacacccggcaggagtcgtctgctgctgctgctgccagctaccactctctagcagcttaaaacaatacacatgcatcctcctaaagttctggaggcagaggttctaaaatcacggtgcaggcggggctggctccttccgggggctcaaggggagataggtgtcctttccctttccagcttctagaggccgaccacgccttatgcacatttatttacctagatgcttgttaagcacatgccatgc

SEQ ID NO: 639023 - DNA, 976 bp, Homo sapiens
ttctacagagttcctccggcgcttcctccaccccgggatacacagaacctcatctcctacggtgctgaagcctgcagcaggcaagagatgggtaggagagcatgagccgcggaagtctgcggcgcgggtgaagagcgtcgcgtaattcccgtcacaagattgttccgtgcccgaagcccctggactagcaggatccgaaccccggcggctgcgtgcttataggcgcagcacgtcagagagcccgcggcttaaaagcgcgtcgcctggctagtcgccagcccctaggccttcttcaaggcctccagggctgggcccaagcgcccgtcgacgggaccctggtcccagaggactcgcgggcctcatctccaatgattcagaagtcaggtccgtcgctgttgcaagcccaagatgtcggagacacggtgggaaaacgcttatgtaaccatccggtgatcagggctttcctgtgtggctccatcagtgggagcctgctctaccctcgtttttccaacctctggatctccttaaaacacgccatggaatcctcaagccctcagatcatgggtctagaggtgtcgcgatgtgggtgtactcttgaaggtggttcgcgcggatgagtctttgggcctttggaaagggatgtccccttcgatgttgagatgtgtccctggcgtttgtaagtctacttggcattctctactctttgaagaagaatttgtagcgagtgcatccccagggcctggagtcagcaatgctgggggtgggctcttcgttgttgaggggtctgttgtacattactgtataaaagcggcatggagtggaattggtttgggattaaacgctggagtgtacagatagggcgggcttttagggggagggaactttgaggctctgatacgggttaacgagggattgctgtgggtccctttaataggattgtggatcgaaggggaatatagagtgttagacttaataa

SEQ ID NO: 639024 - DNA, 237 bp, Homo sapiens
  misc_feature (217)..(217): n is a, c, g, or t
caaagtgacaactggtgttatggacacttttcttaatttttattttattttattttggagacggggtctcaccctatcactcaggctggagtgctgaggcgtgatctcagctcactgcaacctctgcctcctgggttcaagtaattcttgtgcctcggctcccaagtagctgggattacaggcaccagccaccaaacctggctaatttttatacttntggtagggatgggatttcac

SEQ ID NO: 639025 - DNA, 320 bp, Homo sapiens
atctgggtccttaaacagttattcataaattccctaaaaatttaaatttccatgggaccctgtggttaaaaggccctaaattaatttctgaaaatatttcccttaaataaccctttacattaggccaattccctaaccttaggtttagttaaaaggaattaaagagtttaaaagaaccctttaaagaatgcttaaaactaaccaaccattttcaccctttgtggcaaccatttgttaaaccagtttcccttaacttcttttacagtttaatggaaaccttgggttaattttaattgaggtccccatggtcaaccagcctt

SEQ ID NO: 639026 - DNA, 135 bp, Homo sapiens
ccaacaaacacctctgacaggtgtctgcacaggagactgtaagacattccctgctgtgagatgcatcacacaccctccctttggtctcggaaactggtgactctgtgttcctgtttcaggtacacttcttcagtc

SEQ ID NO: 639027 - DNA, 927 bp, Homo sapiens
ggggggtgataaagagtaataagataggagtgtttggtgttttttgtttttttggtatagtctgcggttggggtatttgtcttcgggagaggggggatgtatgttatattctttcctctttctttttgtgggtgtggttgctctcgtaagagtagagagaattacgggagggggggagtggggtgtgattcgtcacgtcgctgtcgtctgagtggtaggatgtgtagtaatattatattgtggaggcgcggcgggggagagggtggggagagaataaaaaatagttttttttgctccggaagagatgtaatctctatatatgtatgacagctcagaggggcgggctcatattttgttgggtggcacgctcagatagagagaggaacatgattgattgtttggtcgcgaaataataaagaagagggggtagtgttggtgggcgtgtgtcggagatgattaattctctcttgcggattgttgttgttgtgtggcccgcggcggttgtgtgggtggggcgccgcctcatccggcgcggtgtcgcgccgcccactccgatgtcgcccgcgcctccctgctccacgatgatacgcctccgctctcttgtttctctctcttccccggccgcgcccggggggcgccctccgcgcctccccgccgctgtcttgttttgcgcgccgccgcgccctccctggtgtgccctctgtggggtttcgccccgctccctctcccctcccgcccgcctgtgtcgcttgtgtgtgtggtttttctttgttgtggtaggggcgctcctcttgtgttgggcgcgtgttgttttttttgttttgttgtgggggggggggggggggggggggggggggccacccccccccctctttttttttttgtctcccccagcggggggaaaaatgttgttggctttccatctca

SEQ ID NO: 639028 - DNA, 763 bp, Homo sapiens
tcacgcacacagtcgggtttatgggctcatcatacacacacacatcaaatatgtacacaaacataaatattccaatgtacaaagttacatgggactcacagatcacccctcgtctctttcatccagcaccccaaactgggtgccgtcctcttcctgtttcaggatgaaaggcgtgatgaggggctggcactaggaaggcagggaatctggaggaagggagaaggtcctgctcccctctcctcacaggcacctccgaaagggtcctgtcccttttcaagggcaccttagggcagagggctaaatccctcatccctctctgctgaagctcaaatccccaattctccttgatccctttgactctcctccctaatttcctgggcttcgatcctctcagcatgtctgcacactcctggctggagagtagccacccaaggccccctcccaaacgctgttggcaagggcatggccaagtggcagtcatgacagccagcagctcaggcggccagtcatcgaggtcaagggagcatatgccaggtggagtcaggcacggcgactaccctggacacttacaccgtatgtccgaagcaggtcaatctccttgccgtgagatgatctgcatgataccatgcaggctggggtgataggtgagcagcccagttgtcacagaagcgtacacataatttcttcatcacaacatcctgtgtgcaagagccatggccggatcccgctctagacaaggatccccgtgctagacgggcgatgc

SEQ ID NO: 639029 - DNA, 306 bp, Homo sapiens
  misc_feature (75)..(75): n is a, c, g, or t
  misc_feature (120)..(120): n is a, c, g, or t
cagacagcgtcaccatgttgtctgggctggtcttggactcctgactcatgatcacccaccttggcttcccaaggntgctggattacaggcgtgagcatcatgctacgctgtgtatgtgtnttgaaataacagctttattggtacataattcacatacaataacattcattttttcaaaatgtacaattcattggttcttagtatattcacaaattgtgcaaccatcactactatctagttttatattttcatcccaaaaagaaatcttgtacccatttttcagtcactcccgctctctccttcctc

SEQ ID NO: 639030 - DNA, 130 bp, Homo sapiens
gcccgacgggggcctcctccgcgggcatgaccagtccgcctacgacggcaaggattacatcggcctgaacgaggacactttagctcctggaccgcggcggacaacgcggctcagatcacccagcgcaagt

SEQ ID NO: 639031 - DNA, 628 bp, Homo sapiens
agttatttttatgtaagcttctctcattcctccactgtgcgtgctcgggggctggtggtgaggaaaaagaaaacagctgtgcgggaagcatcaagaaaaggcaagtcatgaagtcttagagatgagtgacatgtaagaaaaagagtgaggagaaaaatattcctactaaagttttccatttgtttaccttccttgtcacatagacttccaagagttagaagtctaggatttgatctccaaatcttcctggcagattactcatcttcatttcattcatatagtccaggggtttgtacaaaggaagatgccagttcttccccaatcataactaagatatcaagagatattcttttgaaatgtaacaaaggagatctgaagttcatctgaaaaaaataaatgggtaagtatactgacaaatattttggcaaaataaaagtaatgaggagatactagcattagcctcatcaggcattaaaatatattataaagttataatatgtaaaacaggatgggactggcactgaaactgacagttcaactgaagagaatagacaagttagaagtaagtcttgatgtatgtaagaatttaataaatttgaaagatggtaaggaaagataggattgctta

SEQ ID NO: 639032 - DNA, 150 bp, Homo sapiens
ccacggcaggcgagcggcgtcgcggcggtggcggccttgtaacgacatcacggaagaacaatggaaccgcgtgcggcaatggcccggcacgacggtcgaaccggagcagacagaggtgagggatggcggagctttctaacgcgcgttgcg

SEQ ID NO: 639033 - DNA, 288 bp, Homo sapiens
ggatggtaacatcatcatgaagctatacattatagaaacaaagagataacactacattaggaagtataaccagcaataatgaagtggtatgaggaaactgtgtagattaggttgtgactagggacagagactacagatagggggcaggatagagagaggatcagaatagggccaagagagaggaaagagctagtaaccatgataaaagcacagcacagaatgtcacaagatcagagaacactcacagactgagcagtgagactagtaaccagcctctgtgatggataa

SEQ ID NO: 639034 - DNA, 82 bp, Homo sapiens
catggatttgctggtgcagtacaactaggcttaatagggacatgtagcctcaaagggatggaggaagatctaccaagcaaaa

SEQ ID NO: 639035 - DNA, 343 bp, Homo sapiens
tgactctcctctctatggtctgggacacacacagatcgtccttagtgggtcacagtaatcatgaaccctgggtacaaaagatacaggctgagaagtaagaatacactgctcacttagagcaactcataccctgacctgaaccgggtgtgtaccacccttgcccatggttagatctctttccttgataggaacaagcaaaagaggggctgatccatctcccgtgaacatctgtagactataggcggtctgagccagccttgctgtgtttgcctcagatgcgagtcaggaagctccagttgtagcattggcacagctgaggccatgccattgctacccggaagct

SEQ ID NO: 639036 - DNA, 213 bp, Homo sapiens
gggacaggctccttggaagagcttaattgctgggccctgtcagttgacttactccctagttccagagacaactgatatctctgtgccatttgatacttgagatgaattggggtgaagaggaactttgttccccccaaggagacttgtccagagcccacatccccggcccagttaatagagatactcgggaggtgggattgccagatcacacaa

SEQ ID NO: 639037 - DNA, 226 bp, Homo sapiens
agagagaaaacttctccccccgggggggagggggttttttccggggggggcccccccccccccccccgaaagggtccccttgggggggttttccccccccaaaaaagggggggaaatagcgcgccccggaaaaaaaaggggccccccaaaatatttagggggcgggggcccccccccaaaaaaccctttaaaaacacctaaaggggtgggttaaaaaacggggggg

SEQ ID NO: 639038 - DNA, 448 bp, Homo sapiens
gcaataggcacgtgcgtttattcgtctagaacaactacccggagagacctcacctgtaaccaccgtgaaaacttctgtatcacaaaaccagctgctaaacacgagctcctaggagagtgggactcttgggacttgagaacagactcaaggtgacctccaaggaaaggactcagcacataccctcccctgcaaagaagcgggaagcatcccagtaaccaaacctgaattgccaaagaaaccaaaccctggccttatacgcagtgttaatcctgagataccgggaagagggcccatggctgagagctcagataagagggaagaaagtgccaactcctgccccgaggcctttgctgctgaagaactctgtatcctcagaaaaccccacctacccttcagctccactgacacctgtcactgtacctccccgactcgcaggggcatcacaagc

SEQ ID NO: 639039 - DNA, 255 bp, Homo sapiens
ctagctagaggatcccgccatgaggtgatcctgaactaactgtaaggctgtctggttttaggacaggtaaaatgggggaattgtaaggagattttataggccttaaaaggccatgctgtagcaggtgagtgataacaggatttaatctttttaaagcgtgctgcgggatgggatattggcgttgagtggggtaagggtgattaggttttaatgagatggtaaggggtgcatgatcggtcgcctgttacagcatgg

SEQ ID NO: 639040 - DNA, 230 bp, Homo sapiens
tcactgtcatccctcctcctatcggcgatgactgagtctctgtgtacataatctattgatacttatgcactatgcgtatcttcttgtacccgcagctgccgtctagcagactcatcctttcgggagctaatctcctgtttcaggtactgtatttccgattcctttacccgctataagacctctagttcataggcctccttgcccctgtgcaaggggtgacccagcgacat

SEQ ID NO: 639041 - DNA, 193 bp, Homo sapiens
cggcatggggactgtagctctgacgccccttagtccctctccaggtccttgtccctgtatccaggacctcaggtgcggggtctgctttttctgggaagcacccctagctgaggcagaggcagctgactgagcttccctttgcccatccgtccagcctgtgcgagcctcattgcgcaccagactgtcccaagag

SEQ ID NO: 639042 - DNA, 248 bp, Homo sapiens
ctctgatgctactagcgccacccgtgaccctaggaagccaggcccagcctcgctcctccatactcaagactctcatgctccatctggccggctcactccgtgtggcctgcctctgctgaccgttatggagttccccgccggagctacaggggcattttcttccctaaaaccaacagtgtcccactgacctccccaagtgtttgctgcgtgacagatttcctgttcttgttcgcagtttgccgactgaa

SEQ ID NO: 639043 - DNA, 914 bp, Homo sapiens
tgagcggagggacgcggtccggcgtcccaagatggctggcggcggcggctcccggaaggcccgcggcggcgtcccggctgctaaggcgggccccacgcggctggcagcggacaggtccggatcctactgcgccgtggatgtgacgtggcggcagcgcgcctctgcggcggtaccgtgggctgggtccgtgcggccgggtagcggccgccagtgggattgctcttgactggagccctggcctcgtcccttctcaaactttaagtggctgtgcgtgctgggcctcgatgcctcgctttgccttcacacggagtctccatgtgacgccttgaggagatcgctcgaggaaggtagttgatacttgactcccggcgtgaataaccaggcgtggataagggttacaacttgccacaagattatcaggatagatagagacgaggataaaaggtttggcgcaaagaaccaagggttatatgtgaagttcacgagagaatgaagtacaaaggccaaagcaaaattaagagtgtgccaacttcgtagtcctaaatggaaccccaagagaaactttggtttcccagcagataaccaccaagtaccacatgtgaagcctgaaccaagttgtagagttattcccgttaaaacttcctgggtgcgaattactcacgctttgggaaaccacaaagaaaaaccggaaattataccagcaggcccgttgtacggcacaaccgaaaagttgttactctataattcgagcacgggggggttcagggacttggcaccacacattaattaacacgtcacggaccgaagtgaaatatattccagactcaaaaataaggaaaagggaacggaacacattttatagtacaaaacacattttccaacagtagcaacatttggtgcgtagtggaactaag

SEQ ID NO: 639044 - DNA, 249 bp, Homo sapiens
gggcccatttattgtttattttgaactgggaatacaggcaaatggttcaaaattcaaaatggacaaaagggcgtaaggggtaaaaccctttcctgtcctggactaaacctactggttcccctcccaaaagaaatccggggtacccctttattttgaataggcttacataagcaattatgggcttatattctactcctttttgaaacacaaatgggaagtgcgctttacacatttctggggcttgccctt

SEQ ID NO: 639045 - DNA, 165 bp, Homo sapiens
aaggctcgaggaggggtatcatcagtgttaatcagagcataaagatatggtctggtgctcatcccctcctgggcattgattaaccgaactgagaccagtcacagccttccaatcaacccaagagacttgggaaataccaggaaacgtatgagaactccaaagcat

SEQ ID NO: 639046 - DNA, 1317 bp, Homo sapiens
tgtgagccgtgtgagtgtgtctgtgtcgtgggcgtgctttgtcgtaggattggggcttgttctctgtgttcgtgtgattttctctgttgtctagttgtcggtctgttgtttcttgtttgatacctgagcgatttttatgacccgtggtgtttctcgttgtgtttctcttctcgttcgctcgcccttttttagcatatctctcccccccatcctcctacggggccctggtgtgtctgcccttgtttgcgcctaggggccttttcaggggggccctcgtgggtcctaatcacgccaggttgcgtccatgccacgtggttaactgtgtggcgttcaccaccgcctgggtttcccccgcctaaggtccctccacatgtagccgcctgctgtattgttgggacaatatgctttgaaagcgggttttttttccctctggtgatggtgtctcagtcgtgggagttttttcgttttgaacttgcggaacgcgcccgggatgtccttttcccgggtaagtgttatcccccttcttattgtaggacaggagtttccctgcagaggatgttacattgtcaaagggtaaatttgcagtatgagccgctggtgagtgcgcagtttttggtccccgcgtttggtgctacaaaacatcgtggcgactttcgctgtgccgtaaaagtccgtggttgcaaacgcaataggccctgttaatgtgtgcctcgacacagtttctggaaggctgtaattttaatgaactgtgataatatctgtgagtttattctgaataatacgcgagttttctgttttggttaaatgggcgacccatttgcccacatttttgttcccacgaaaatatatgtagaatgccccgtggcctgaactatggagcctggttaaacacatatgctggtgtgagactgtgagattaatgccctttgagccacaaccaccatggaagcccaaatttggggggaaaactggtggcctggaagtgggccctgtgcaccctcacacctggcggaggctgggggggctctgtcacgcacggagccctatagaggagatctttcacattcgagttttaaagaagcaccacaccgggtcacttttcctcttgtatgttcctagcgcacgaactgttttcttaaacacaacttgaagtatagttttgttattctaagccactttttgttttaagtaagtaagtgtaactagaatgcgaagccccttatggttcaggttttttaaaactggtccagtattgtatttgtttcatctgttgccctcgtatttccatcatctgtaattaaaatgatcatatgttta

SEQ ID NO: 639047 - DNA, 383 bp, Homo sapiens
ggtggattttaaagaaccccggtggatacctaagatattttatattccagtgcctagagagatcccattgcagacagcgtaaagtgcttggaatgagggccaatgatgaacaaagagcacaataacagcttcatcgtaggagctcagatggggttatagcatgcctaaactgttatcgagatgcacacgctgtgaggggaatgcaacaattttgaaaagaattagagcaatatttctacagtattacattattactagtagataataacaagggtacaaattaatgtctcaatatcaaagtggatcagtattacatgacacatggctctttggaaaatatttgacctgatgtatacaaccacgagatgaaaacacagacaaat

SEQ ID NO: 639048 - DNA, 312 bp, Homo sapiens
tgctggcgtatgtactgacctggctccagacatgccaggtgcaggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcct

SEQ ID NO: 639049 - DNA, 128 bp, Homo sapiens
  misc_feature (121)..(121): n is a, c, g, or t
atccattgaaagctcagagctgagaggtactactaccaataacctgcttggctcaaagggccagcaccttctctctaaagcccaagaggagtttgaggaaaactaggtgtctgtgttcacntccaggc

SEQ ID NO: 639050 - DNA, 671 bp, Homo sapiens
gtaggctcacttccgtccgtggggggagctgcggcggtgtgctgcgtagcagtgcaggccgggcagagggttgcgtgagtggacctgactgtgactgcacgggtgtctgtgtgcgtgcctgggaggccatggtgagcgcggccctgggggccccggtgggcggcggggccggtgggtgggcttccccacggcaacgacatggagacctgtggtttgcgagtgctccctgggggcctcggctttggacccgcgaatgtgggcttggggcccttggcgctcctaaccgggggtctgcttgtcctggggggcgtgtacgctggggggggccggcttcttccgccgcgcttggcccctgtctgattcgggagagaacccccgaaagacgcttacccctgccctgggcccatgtgccctgtgcggagcagtagcgatatgccgctgtgggggggcccacaggttgttgggaatggcccctggcgactttgggacgaatgaggaaagcaccgggggcactaatggatattggggggcattgtcggccttcgaggttagacgccttacttaggcttggccatactttccttaggttaggcaccagccctatggcctcctgggagcgggaattctgattggcaaaagcgcatatcgaccttttccattgaccagccagg

SEQ ID NO: 639051 - DNA, 409 bp, Homo sapiens
  misc_feature (13)..(13): n is a, c, g, or t
  misc_feature (69)..(70): n is a, c, g, or t
  misc_feature (80)..(80): n is a, c, g, or t
  misc_feature (85)..(86): n is a, c, g, or t
  misc_feature (94)..(94): n is a, c, g, or t
  misc_feature (118)..(118): n is a, c, g, or t
  misc_feature (125)..(125): n is a, c, g, or t
  misc_feature (165)..(165): n is a, c, g, or t
  misc_feature (214)..(214): n is a, c, g, or t
  misc_feature (219)..(219): n is a, c, g, or t
  misc_feature (233)..(233): n is a, c, g, or t
  misc_feature (286)..(286): n is a, c, g, or t
  misc_feature (408)..(408): n is a, c, g, or t
aaaagaaaaaaanaaaaaaaaaaaaaaaaaaaagaaggagaaaaaaaaaagaagtaatgctctgagggnngttcttccgnatttnnaaaaagtnatcttcaactgccttggttatttnataaganatgctatattccaagaatctcaaaagagttagataaatgnggaatttgttcagcacggaaggaagaaccgctgaaaaaaggctgtacangaacncctccatgtttggnggaattagctggggcggtaagtaaatctggcagtctgccgggaggagtaaccncccctccgaagtaatgaaaacgttaatattgcaggggaattccatctgatggtagctgaagtcataatccaccttctgccacgttatgaggttgctcagggctgtcacattatgaacacctng

SEQ ID NO: 639052 - DNA, 239 bp, Homo sapiens
  misc_feature (13)..(13): n is a, c, g, or t
  misc_feature (107)..(107): n is a, c, g, or t
  misc_feature (115)..(115): n is a, c, g, or t
  misc_feature (155)..(155): n is a, c, g, or t
  misc_feature (173)..(173): n is a, c, g, or t
ccacacccccttntcaacgtccccccagagtcctcaggggggccttcgatctgcaaaagcctcacaggagtgcgagggggcccagctcccagggggggcgatggagnctcacacngtcaccttctccatcacgctttcagacacgtggacttcgnctttctggacggggacanatgttgactggccgcatattttttggtgatcctcccagtccttgcgttggcagaaggtggagcagt

SEQ ID NO: 639053 - DNA, 205 bp, Homo sapiens
agcacaactgtaatatcgtagctatcaatcactttttggtatataaagaatatcatgatactacttatagcctgcctatcaattattgatccttaatatactttctatttgtcaggtagcacaagataacctatacctgttctagcctatactgtcttgtacaccaaccatatacttactatggtaggccatgtaactataggaa

SEQ ID NO: 639054 - DNA, 453 bp, Homo sapiens
acttcaactacagtaagtcacagtaacaaaccatcatggtctgatacaaaacagacacacagaccaatggaacagaatagagaactcagaaataaagcttcacactgatatagtttgtatatttgtccccacccaaatctcatgttgaattgtaatacccgatgctggaggtgggggtctggtgggaggcatttgggtcatggggatgcagctttcacaccttggtgctgcttggcaataatgagttctcacaagatgtggtcatttaaaagtgtgtgacagtccccctactctccctcgctcctgcttttgccatgtgaagcacctgctctttcttcgtcttctgccatgagtaaaagcttcctgaggcctccccagaagcagatgctggcactgtgcttcctgcacagtctgcagaaccatgagccaataaaacctcttttcatataaaaa

SEQ ID NO: 639055 - DNA, 159 bp, Homo sapiens
gatgcacacaaggatctacaataccagatttaaagaaatgcaaggataccattagtagtgtataactagattcattgtacatactctgtaaagcacctatatgtccatttagcaatcataaagaacagatgccttcgaagtaccgtgaaacggtcagct

SEQ ID NO: 639056 - DNA, 346 bp, Homo sapiens
gcacatgagcaccgtcacacatcggacaccacagcggccttcgctcctcgcaaaaaaccacacttctcaaccttcactcaacacttccttccccaaagccagaagatgctctacgaggaacatcatgtggctgtgctgggggcaccccccagcaccatccttccaaggatccaccgctgatcaagcattcacaccgagacctccgtgcccgaccatgtcctctggtccctgttcatcaccctcttcttgaactggtgctgtctgtgcttcatagcattcgcctactccttgaagtctagggacaggcagattgttggcgacttgaccggggccccgccttgggggc

SEQ ID NO: 639057 - DNA, 244 bp, Homo sapiens
acaaacttgcgatttactagaaagcgaagcaatcagagattaattctagaatctacacttcgtaatattcaaaataaagtagtaataggttaccggtggtggtggaacatatcggtagtgaactactgtagaccacacttgacgacgaaactaactccaaacgactgccttatcactacttcgaatatactactaacacaactacgatagcttactgacgacttgacgccagagacaattaaag

SEQ ID NO: 639058 - DNA, 508 bp, Homo sapiens
  misc_feature (4)..(4): n is a, c, g, or t
  misc_feature (11)..(11): n is a, c, g, or t
  misc_feature (45)..(45): n is a, c, g, or t
  misc_feature (55)..(55): n is a, c, g, or t
  misc_feature (89)..(89): n is a, c, g, or t
tagnaaggatncaaaggctgtgtggtttacccaaatgcccttaancttagcagtnaatgacaactgtcaaaaacatgttgagggaaaanttttacctgattccacaaaaaggaaagacaagtttgccccactccttagtggcacaaatcaaagctgcatgcacctacattatcccaaattagtccgtaacccaaatagttaaaaaattctgctgggcacggtggctcatacctgtaatcccagcactttgggaggccgaggcagttggatcacctgaggttaggagtttgagaccagcctggccaaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagaatcgcgccattgcactctagcctaggtgacagagtgagactccatctcaaaaaaaa

SEQ ID NO: 639059 - DNA, 102 bp, Homo sapiens
tgctctgtgtcggatagctgtgcatcttgatacgtatcactatcgccatcatcatgagacgagccgctctccgctgcttcctctgtgattaataaattatca

SEQ ID NO: 639060 - DNA, 114 bp, Homo sapiens
gacctattgctggagaggcagtatggttctttggaggaaagaagacactgcagctttttgagttgccagagttcttgcgctgtttctttctcagctgtgtggcctttgaagttg

SEQ ID NO: 639061 - DNA, 254 bp, Homo sapiens
gtgtgcataccccttcgtgtgtgcataccccttcgtgtgtgcataccccttcgtgtgtgcatcccccttcgtgtgtgcatccccctttgtagtcccaactactcaagagagctgaggtgggaggattgtttgagcctgtaaggtggaggttgctgtgggccaagaacatgccactgcacttcagcctgggcgacagaacgagactccttctaagatagatatatggatggatagatggacgaaggggacggaca

SEQ ID NO: 639062 - DNA, 1466 bp, Homo sapiens
  misc_feature (1358)..(1358): n is a, c, g, or t
ggacccacagcagtggtcctgccagccttctccgctctcccctgtggggaagtgaccctcctccattctcccagagcccacgtgagtccgcaggaggcccccctgtggccagtgtgccagtgtgcctgagtgtgcttgctccaactctgggggctggctatgcaagtgatgtttccagttctccgggtccttccttccaactgtgcagtgtccggggctgccgggccattgctggtccctgttggccctagggcccgcccagacgcagaggcctgagcagcggaagagggggcgcaaactgtggcgttgagcggacagtgacgtcaccccactttggggaccactttcccactgcctcacaggtctccttgccactcttcaaagcacatgactatcatgcagaacgtgcacagatgttcaaccactctttagacagggggtgacagccctgtggtcaagcagacctaagagcacagcagggccacatggagagttgacggagtgatgaccgggcccatttctaacaagttggggtgcacacaaagatcggggagcccctggaacaacaggaggggacccacacacgggaggcaaggggagaaacacagaggactaaccgaagagggggggcaccgcactacccatggagcagctaccaggcggacacaatgacccacggtgcacaaattcctaaccaccgcgctaggcactagcacacacagagaacaaataacaggagatggcgaccaccggtggcagggcacctaatgcaaaggtctgggtacacgattgcgacttcaacggatgcaacccaggagacaaggacaacggacgagtcaacgtgactgaccaagacgaaaacacagagcgcacggatgttgaagcaacagaccgagcaacagggggggacacaacacacccagtaagtggacaggggcacccacacaaaccgctggatactccaaacaacggtacaagacacaacaggctggaactcccaggacgcgcggcggacaagagcactcaccacaaacagttcgcccatggggacactataaccagcagcagatagtaccaacccacgttgcagcacccactaagccaccgaggacatcaaacaacacattgctggtattgacactacatgtgggggcatttacgcagccaaacgtggaacaccacaaacgccaatgcaacaaatcgtgtgcgctttagacgaacgggtaaatatgcgtaagtaaaacaccacaggctataaggagacggccaacacgcgtcactgataacaggcgcaacactagtgcaggagtgtgatactcacatgaaaatgtctgacgccagctaccagtagcgacagntcaatccacgccaaacgggacagcagacaatccaaccgccctcttcacagaagtgtatgtggtcgccgaaaggtgcatgcgatctacccttaaacacaacacgaaacg

SEQ ID NO: 639063 - DNA, 109 bp, Homo sapiens
catacgttgctcagtgattgtaacatggtacagtcattttggaaaatagtttgatgagttctcaaaatgctaaaaaagaaaaaatgagctatcattcgaccgggaattc

SEQ ID NO: 639064 - DNA, 301 bp, Homo sapiens
aaaggggagtcgttcttggtcaccgcttgcgatgaccgttcgccgtcgagattcagtgatttggttcgcacgacgcctgctggagaattgctgtgaagccgcatacacgccatctgactgtggccgcggtcatcgggatcatcctgctgattgttgcggtggttgcgcgtgggctgtgacgggcctgcgaatgcaatcctgtaactaaagcaacatctaatagtcatatctaccgggaacccggtagtgaaccggtcggtttggggtatcgctcgtcctgggggtgacgcgcatactttgg

SEQ ID NO: 639065 - DNA, 348 bp, Homo sapiens
cgcttaggttccatcttcactgcacttcacttttgcttcttgcaagatctgcgaaacatggaggttctctgaccttgttatttttgcaaaatttgccttggatgaatcaaacatgtcagtcatgccaagcactttcagcggctccttcaaatctgtaggtgctccagctgtgaacttgggcaggatcacctgcagcctcttgggcaccaggatgctcatccagctgtctatggacttggtgcagatgtgtggagatgatggcagacagcgtgagtggcgctctcagtcggaagtgcaaacagcatgctgatgctatccccgtgataggggagtacaactgaagttgta

SEQ ID NO: 639066 - DNA, 397 bp, Homo sapiens
tccagctctatgtcggtcatctgtgtccccgatctaaagtggacatcccctggcacatacctggaatccacaactgttgcgtgatacaggagatcattgaggaaagactcgattacagaaacttttagcttatagtaaataaatacgagtatggataatgaagcacttaaatagaagaaaaaactgcattccgtttacctactaaaagtattccaaagtaaatcctcattaatacaacctacttggacttaagaactgattattattttagccggactgaaatttactgtgacaactcatgtggacagagtgtgcaggaaacatgaagagcagagccaccatggtgagggagagaagtaaggaggctccccatttgcctgtaactcaagagtgaact

SEQ ID NO: 639067 - DNA, 209 bp, Homo sapiens
  misc_feature (145)..(145): n is a, c, g, or t
acacattgtatcccattttcttctacttccatctggaactagggcaggcacgcacacaagaactggaatctaccacaaagttatgtggacatttcttgacacagaatgctccatatgtgtactttgcattgaaattgtgctccangttgaacaggtggttggcatagtagacaaaggtttggggacactgagtaacacatgctccactg

SEQ ID NO: 639068 - DNA, 287 bp, Homo sapiens
  misc_feature (7)..(8): n is a, c, g, or t
  misc_feature (10)..(10): n is a, c, g, or t
  misc_feature (16)..(16): n is a, c, g, or t
  misc_feature (19)..(19): n is a, c, g, or t
  misc_feature (49)..(49): n is a, c, g, or t
  misc_feature (56)..(56): n is a, c, g, or t
  misc_feature (72)..(72): n is a, c, g, or t
  misc_feature (84)..(84): n is a, c, g, or t
  misc_feature (98)..(98): n is a, c, g, or t
  misc_feature (124)..(124): n is a, c, g, or t
  misc_feature (142)..(142): n is a, c, g, or t
  misc_feature (174)..(174): n is a, c, g, or t
  misc_feature (179)..(179): n is a, c, g, or t
  misc_feature (188)..(188): n is a, c, g, or t
  misc_feature (192)..(192): n is a, c, g, or t
  misc_feature (202)..(202): n is a, c, g, or t
  misc_feature (225)..(225): n is a, c, g, or t
  misc_feature (228)..(228): n is a, c, g, or t
  misc_feature (230)..(230): n is a, c, g, or t
  misc_feature (245)..(245): n is a, c, g, or t
tgggccnncncgcacnccngtgaggcttttgcaggtcgaaggccccccngaggacnctggggggacgttganaagaggggtgtnggaaggtaaagaancgtgctggacaagtcattaacacacnttaagcgaatggtgcccngggaaacgcactccccctgcccgggccccctncccgntcgcggacngatnttttatcccngggatcatgaacgtccggtcttnccnanagggcctgtgctcgncgcacattcatacgtgttgtgtctgtcaataaagttaaataa

SEQ ID NO: 639069 - DNA, 378 bp, Homo sapiens
actgtctcctaagaaatgaatgtggccaggtgtgttggctcacacctgtcatcccagcactttgggaggccaaggcgagcacattgcctgaggtcaggagttcaagaccagcctgaccaacatggtgaaacccagtcactactaaaaatacaaaaattcgccaggcgtggtagtgtgtgcctgtagtcccagccactcaggaggttgaggcaggagaatcgcttgaacccgggaggaggaggttgcggtgagctgagattgcgccactgcactccagcgtgggcaaaagagcaagactccatctaaaaaacaaaaaaaaggccggggaaatcccagggttggcggccccgggggtctttaaaccaaactttccaaaaa

SEQ ID NO: 639070 - DNA, 122 bp, Homo sapiens
  misc_feature (42)..(42): n is a, c, g, or t
  misc_feature (49)..(49): n is a, c, g, or t
ggcagggctgactcccgtcgacacgaacttagaaagttactntcaatgnctttctctgtctagaacagacgggtgacaagtatgggcaaggaggcatggggcagggtggccaccccagtcga

SEQ ID NO: 639071 - DNA, 412 bp, Homo sapiens
gatggccatgagtcgcggcacgagagactgactgtgtgcgtacagtgagttacagacgagaacggggtcatagatgttgccgagtcaggaatgggcagcttcaggtggcagcatccagcacaaaatacattcccacaatttctgcaatggtgtcttcgtttggccaaccagaattcacagtcacagttatagcagtgtgatgccatatggtctggaacccagcgagtcacctcagtctctttcttatcaacaggttcccagcttgcttctgaaaggcagtcttcactgtgatcagagccaaaatcctcagtatcactgccatctgactccttcaaacatgtaaaatcatcctcatagtccatggggggctctgctggaggggcacagcagtgacggatgtccagcctcatct

SEQ ID NO: 639072 - DNA, 316 bp, Homo sapiens
  misc_feature (160)..(160): n is a, c, g, or t
  misc_feature (241)..(241): n is a, c, g, or t
  misc_feature (262)..(262): n is a, c, g, or t
  misc_feature (297)..(297): n is a, c, g, or t
gtttgtctcccctctccaaagtaaggaacccagctggccgtggtggctcactcctgtaatcccagcattttgggaggccgaggtgggtggaccgcttgagtccacgagtttaagaccagcctgggcaacatggtgaagccccatctctacaaaaaatacnaaaaaattagccgggtatgatggtgtgtgcctctagtcccagctacttgggaggctgaggtcagaggatggcttgagcccnagaggcagaggttgcagggtnaagatcgcaccacttgcactgcagcctgagagagngagagccagaccttgtctc

SEQ ID NO: 639073 - DNA, 449 bp, Homo sapiens
  misc_feature (283)..(283): n is a, c, g, or t
acgctctctctgtgggggagcttcccggagtaacctgagacaccttaagaacaccagtggagaccattgactggcaaggtctttgatcagctggatgcaccacttggctcctgatttgaaagtgcagcaggcactccgttggagcaagacgcccactgatcgctccaccgtactgtactgaccaagctgccaggacagaggtcagccacatcccctgctgtccacccgggcttcattcaggcccaagatgcgacgagtaacggccacttatctgccactccangtgctatggtgagcatcggcttactgcgtggtgtgtcttccccacacgcgcacggaggtccccaacaccagtaagccgcgggcaccataactgcagtgagtcactggaactgcaggacccgtcttctgggctgcgtgtgaccatgcaggatctgggccccgtcccc

SEQ ID NO: 639074 - DNA, 118 bp, Homo sapiens
ctctgaggatcccatagaggccaagatagtatcaaaggtcaataagtcacaggagggctccccacagcaaaaaattatgtgccccaaaaggtcaatagtgctaaggttgacaagcccg

SEQ ID NO: 639075 - DNA, 222 bp, Homo sapiens
caatgcaataattccttacagctcatttagcatttaacaatcctgaaaaatttttcacatataccaattgacccctcacaacagccctgtgaggtaggcagggtaggtgctacttccctactgctagtgaggagaacaaggctaagaggtgaattaaggccacacagtttggaaaattgatgcagcctaggacaagaacccataggcgccatataggggacc

SEQ ID NO: 639076 - DNA, 127 bp, Homo sapiens
atgtcgaggaagggactggtgggaggtgactgatttatggggcggtttctccatgctgttctcgtgatagtgaatctcttgaaatctgaaggtttaaaagtgacacttccccttctctctttctcct

SEQ ID NO: 639077 - DNA, 112 bp, Homo sapiens
aacgggtgatgcggttgatgccaaggtgacagcccctcaggagccctggaggagtgctatgtcacagaaattgaccaagataagtatgctgtgcgcttcatccctcgggaga

SEQ ID NO: 639078 - DNA, 407 bp, Homo sapiens
  misc_feature (46)..(46): n is a, c, g, or t
attttcagaggggaaaatggggcctaaaagttacagagcatttagntggtgcgctggcccccctggcctcacacaaactcccgagtagctgggactacaggcacccagtcactgaagcaggccctgtttgcaattcaggttgccccctccaacttaaacatttttcaaatgtgatgcccttagtcactaaggttaaactttcccccccagaaaaggcaacttagataaaatcttagaggactttcaaacttttttaagtcctcttccaccccccctttgagtcccccttggggttgaaaggaattttttcttgctttctcaataaagtctctattcatttcatgtttaatttgtacgcaaaaaattgctgagaaataaaatgttttgttcaccttaaaaaaaaaaaa

SEQ ID NO: 639079 - DNA, 116 bp, Homo sapiens
tttcttaagctgaggtctgtggtctggttattagcatcagcttttcactttcctgggttcagtctggaaagcctggtcacccacatgtgtactcacaccacagagtcaggcagtag

SEQ ID NO: 639080 - DNA, 246 bp, Homo sapiens
catctcgtagatggttgcaaacgcccaatctggccgcttccctgtgcaggctcagaaagtagttagcaggactgtgcggtgtgtgtttgtatcttccccagcattgcctactgcaactacttagtagcaagctacaggtggacggtgtccggggaagccgttagattagttaagtgtgagtgcaccgaaggataaattagtatcgtatcctatcaaaggtccctctgccctggctcaactaaagga

SEQ ID NO: 639081 - DNA, 250 bp, Homo sapiens
gagtggcagaggaatcggggagtggtagagagaatgtaaatggttgaaagtacggataaatcaagtagaaagacctgaggtgctctgcaaatcacagctgactagaactagctagtctaccattcaccatactaggtagacatccaaattgagtccaggtaccctgtgatttggaatagtctttcaactctattgcctaatccatcagactacagactgtatctcttatctaatgccattgtaataattt

SEQ ID NO: 639082 - DNA, 135 bp, Homo sapiens
tttcatcaaaaataaaaaattacatatttcaaacatagaatatgccttctatgaaaatgtaagaaggctgtatctatgggatgatgtattactataccatatagtatctaaggtagaacaacgctatatatccct

SEQ ID NO: 639083 - DNA, 221 bp, Homo sapiens
gctccccgccccccatcctgacatcctgtttttttgcacttaccctgtgctgggaatgtaacagtgggccttggccccgccccctttgatttgcattttcatttggggttgtttacacatccatgccctgcctggagcagtcgattgtcccagcttcgacttttggatgggaaagggggggccctgactgtgagtcgaataaacaattgaggcggtttcca

SEQ ID NO: 639084 - DNA, 251 bp, Homo sapiens
atccaaagaatttcggcacgaggcagaacacaggtgtcgtgaaaactacccctaaaagccaaaatggggaaagggaaaagaattatatcaacattgtcgtcatttggacacggagattcgggcaagtccaccacttacttggccttttgtcttttaattcgggtgctccgcaaaaggacccatttaaaaatttggggagggagtctttttaattgggaaagggtctcctctaaggtatccctgggttttgg

SEQ ID NO: 639085 - DNA, 590 bp, Homo sapiens
  misc_feature (497)..(497): n is a, c, g, or t
tcgacggctgttacccttctacccatttggcagcatgctcaccgggtcatcggagaacacggtggaatcttccatgcggccttggcgcaggcggacacaagcgccgtccttgagatcgatagcggggataatcagcatctggcaaaccttattcgatattcagcaatgcttgggaaatcagggtttctcaagcgaccacaagtcgctttcgatgctttcgaacctttctttaaggagcgtctgcgtgtcgaaaatcgccctgttgtaataatgcggcgccacttcggtggtgaacagctcaagaatttcggcgacctcgaacgagcccagcttgagctcgaagcggtcttccatgaaccgcttgatcttgtcggtagcctcacgctcctgctcgggcgcgaggttcaagatcggcggcttcggcttcctggccatttaccagcgaccatcccacgcggcgaaattctgcagcaattgcaggccatgggtatggcttntctccgggtgaaactgcacggcaaagcgcgaaccatcggccagtgcggcggcaaaatcgagccgtaatgcccgccacgtgtacagaccgtcga

SEQ ID NO: 639086 - DNA, 160 bp, Homo sapiens
  misc_feature (37)..(37): n is a, c, g, or t
  misc_feature (66)..(66): n is a, c, g, or t
  misc_feature (92)..(92): n is a, c, g, or t
  misc_feature (119)..(119): n is a, c, g, or t
  misc_feature (127)..(127): n is a, c, g, or t
  misc_feature (145)..(145): n is a, c, g, or t
tagtcgtcggggtttcctgtttcaaaagtgttggganggaacccggggttcgttccccaccccggncggccgcccatagtcagccctccgtnacctcttcaccgaaccctcgggattgncccaaggnccccgccgccgttccagngccgagaagacaccg

SEQ ID NO: 639087 - DNA, 1599 bp, Homo sapiens
ggacgcgtgggtcgaccacgcgtccgaaattacgatgtaatgtgagagagaccacagtaagaatgtgggtatttttagcggagtggcgtggggttctctcaatctatctctttcctccccatccccccatggggctgtatatggagatcaactatcctaccacgaacaacccagagcaacacacccaagcacgacctcacaacacccacacagcacagagcatcagacaagacagcaggcggaaacaaagcaacgaatcaggagaacagaacactagatatctcagtacgagaagcacacggagccgagcgcagcgaacacagaccacaacggaagacaatccagagacagagcacaaagagagagacaaagaaaaagcaccgacccaccgaggaccaacagaggacagcggactacagaaacaacagaaaccagcacaaccaagagaaatgaagcgagaactaaggagacaaaaagggagaacacagagcccgaagaagcgaagagaacagagacaggagacagaaggaaaaaacacacacacagagtgcaaggccagagccaaaccgagggcggcatgctggaggtcacgggccacggcgagaacaggacgggaggaggagggggcaggaagaacggcacccgtggggagggacggctcgaggcaggggagccgcgcggaaggaaggagggaaactgaagccaggcgacagcggggggagaagcaagcgagatgacgggaatagcagagccccaacgaccacgccgggcacgggccgcgcgagagatccacaaggcgacggaggcagaaagaaagagacacgaccaagcaaaaccgacgaccagacgacacaaagaagcagaggacgatcaagaggaagcggaaagacaaagcggcaagcacgcacgacagggagcaagcggacggcggagacgaaggcgagccactaacgccacgagcgtcacgagcaccgcatcggggagtggcggtgtgacacacgcagaagcggaacagcacgacgccagcagaccccatgtcgacgagacccacggtgcgcgatctgcgatgacaggagagtccaccagcgttgcaggcgccagcaagaggccgcacaagggaacgaggacgcagtgagcgcacggcaacgcagtgacacatgaggagcggaccgaacacacagcgagcgaccccccatccaggccaaggacatagggaagatacgagacaggagagagaggaaggcaggcagacacacgagaggaggcgcaagcacaggctgatcgttaggacgacgagaggatcagacgacgaaaaagacaacggacgaagagacgcaagacaactgagaacgacacgaaaaagaactagcaggctaagacgacaacaagcacgcgaaggaccaagccatgacagataaagaaaaacgaaagatcccacccaccggcaacaacaaaagacagcgacagacgagcgagacgaaggagggacagagagaagacgaaacgatagtagagattagggtagaatatggaagcgacggcatcttatcagaccagatagacgaagacagaaaaagaaatagcagacaaaaacgaaca

SEQ ID NO: 639088 - DNA, 191 bp, Homo sapiens
tggctaccatgttttacatttgagaggcgaacagaaaggatgtgctggataaaagcttgacaagttatgtactcagatgatgacttagaatctagttcagctccccaagagtttgaatacggtaactagttatttttctcatcttttttttttttgggttatttttgggggccgcccccgcagacaatagg

SEQ ID NO: 639089 - DNA, 315 bp, Homo sapiens
cagctagttgcaggcgtcatagagggaatcatggacacgtcgtggggatgttaaaagactctgttgatgtggaatcagaatccctgtggccagtcctgccttcctcttgctagctgtgtgagcttgatctagggtactctttgatcctccctgatacatgggcgaggtgacccacagtggcagatgcttaaccatccaacatggagtcatcatcattacttagacacccttcatttggaatcacgattctcagtgtgaagggcacttcccaccataggagcccctctctgtgagccctcagagggctgtctaatc

SEQ ID NO: 639090 - DNA, 158 bp, Homo sapiens
  misc_feature (30)..(30): n is a, c, g, or t
  misc_feature (65)..(65): n is a, c, g, or t
  misc_feature (90)..(90): n is a, c, g, or t
gcatggtccgttcattaggaattgtgtggntgatactgacaagagcggaggagaactgtgcatancggcgtgtgatatagtggggccgantatccaacccccctaggcgactgggggtcagtgcttcggacgctctgaacagtcgacggtatcgataa

SEQ ID NO: 639091 - DNA, 564 bp, Homo sapiens
aagatgtctaaaagtcaattggggtcaaggaacaagcctctactcacatgcatgtgggcaaatgaagtcacagaacaaataacctaccctgcatccaggcacggagtccagggacaccccctgctgctgcctaagagaaagtggcccaagaagcactggcccggtgcctgctgatgccaggagccctctgctactgcctgacacaagcatcctgcgcttccccctcccaggccctccccgaaagcgtgggccacaggtaccactccctatgccactgagccccacatttcccatcccccaagccactcccaccagccccagagctttcctacatttatgatttgtccaaaaatgtgatgcccttcagcccccagaaggtcatcctccaggctgtgatcgtcacacagggggtcccacatggggtcctcacaggccttcaacccagcacaaatcgtggcctggtttgacctttgaaatatctcaacatctaaaattcagagcttttttggaatatttattttccatagatataattctttcaaataaattccttagaaaacaaaa

SEQ ID NO: 639092 - DNA, 505 bp, Homo sapiens
tcagctggcccaatgtgggcatgtgctgaatcctgggattctcagggaggtagagatgctgactatgggtgaagccagtggtactgggggtcaggagagttgtagaacagatacctggaggcaaggacttccaggaaccatcaatatcaggtggtagaaaattccttctgggagatgggagtcctgagatcaaagctgaagactcactgcaggaggcagatggtatatgccggggggagtctgtagttacaggaagtgcctacaaaactggccctggaggcccaggagaccccagaggctgcgagggtgtcctacaggagctcaggggaagggatggccaggaaacagcttgggcctcgggtgaggtagagtatgaccccagaagcttccagtcttcccagggcttgatagcagttcagagagcagcagggggtattggcagaatagaatctaagggaaaaagtccttgggatgaacaccatctagcgtcagaaaaattgtggcc

SEQ ID NO: 639093 - DNA, 319 bp, Homo sapiens
cggcacgaggagagatccagttgttcaatatttcccagcatgcctctggactttagagaaacagttctggttcaccataaacccatatattcatacaataaatacatatattgagctccacctacaatataatataatttgcattcactaacatgtttgttcagcaaactttgactcatgggctactatgtgccaggttctatgctaaatattgggaattcagcagtggcaagatagacatggtccttgtccccatggagctttcaatctaatgagggagtcagatttaaaccccaccccaaaaaaaagttggcggccg

SEQ ID NO: 639094 - DNA, 83 bp, Homo sapiens
taaaatattaaattaaaaataagtagtaaagtataatcccatccctgttataagtgaggaaataaagtatttttgaaaaataa

SEQ ID NO: 639095 - DNA, 501 bp, Homo sapiens
  misc_feature (210)..(210): n is a, c, g, or t
  misc_feature (319)..(319): n is a, c, g, or t
  misc_feature (358)..(359): n is a, c, g, or t
gaaaaagagaaaggcatttttatatatacttggtggtgaaactcacaccaaactgaagtcaaccttatttaacgttcttgtgaatttagaatgtgtgaatagctctctaagatgtaaaagtgacacatactctattttatgcattgtcacaaaattccataatgtaagaaatttacttattttctgaataattatatatgaatgcccaanaataaaccactgtagcactatttgctctgtaaaaatatgaaataatagcataattgtgggagcaaggaaagtaacaaagaatacaatattaaatgtagacttattcagncctccatattactaaaatcaaactccttctatatgatannatgtaaatcactgaatagacaagcagtggtttctcctaagaccagcaatttgtgtatccagtggtattattgaatggtaaagtcttttatataagcacagttaataaatgtgggaacactcaataagatttccaatttggag

SEQ ID NO: 639096 - DNA, 604 bp, Homo sapiens
  misc_feature (20)..(20): n is a, c, g, or t
  misc_feature (35)..(35): n is a, c, g, or t
  misc_feature (195)..(195): n is a, c, g, or t
atgtacaaaagaactgaagncagccccttgtcaangtgcccaattgttacttgtcctcaagaggctccctcaaacccaatcaaccaattctccctgccccagaggaataagccctgtggacgcccagacccttggcataggtgcgagcagtgaggagacaactggctccagccagaggggcagccagtcctccanagcaccaaggccacctctcctcactcccccacaacgattacagaaatcagccagtgaaggcagtccatgggaagagagtatactcccggggcgccagccagcaaggtggtaaaggcacagttacaaagccaagtcagattccagacactagagccactgtcccatgtccagaggagtggcaataaaaggactggaggctgtgtgatctctgtggcagaagggtcgtagcctgccacatcctcacacatcacacagacgcaggaaagagcatcccgaaagcagaggcgcaggaataacttagaccttctgggagagttagtagctcgctatgcctggatggagtcccgaccatctaaaatgtctctgggagtgctgacagccgaaacatgcttccatggtggcccaccaa

SEQ ID NO: 639097 - DNA, 234 bp, Homo sapiens
  misc_feature (78)..(78): n is a, c, g, or t
  misc_feature (174)..(174): n is a, c, g, or t
  misc_feature (203)..(203): n is a, c, g, or t
cccagacactgccagcagctcccagcctcgtcctccttccctctgtctcctgttcctccttgtcaccatcagatccgntcacatcactctctgactccttgctgcccacaggtcaggtcaaaatcctcagtgtggcattcaaggccgggcacagctgggtgcagtcaaccacgnaggcgcatttccaaaccctccctccgctnaccgtcctctgcctgggcagctctggtctgt

SEQ ID NO: 639098 - DNA, 111 bp, Homo sapiens
ccagacagagtgaggaagaggaggaggaagaaaaacatcctcctaagcctgcaagccggagaagaatcggatcaataaggccgtatctgaggaacagcagcctgcactcaa

SEQ ID NO: 639099 - DNA, 344 bp, Homo sapiens
  misc_feature (2)..(2): n is a, c, g, or t
  misc_feature (14)..(14): n is a, c, g, or t
  misc_feature (27)..(28): n is a, c, g, or t
  misc_feature (50)..(50): n is a, c, g, or t
  misc_feature (102)..(102): n is a, c, g, or t
  misc_feature (105)..(105): n is a, c, g, or t
  misc_feature (114)..(114): n is a, c, g, or t
  misc_feature (121)..(121): n is a, c, g, or t
  misc_feature (159)..(159): n is a, c, g, or t
  misc_feature (162)..(162): n is a, c, g, or t
  misc_feature (169)..(169): n is a, c, g, or t
  misc_feature (176)..(177): n is a, c, g, or t
  misc_feature (202)..(202): n is a, c, g, or t
  misc_feature (242)..(242): n is a, c, g, or t
  misc_feature (259)..(259): n is a, c, g, or t
  misc_feature (269)..(269): n is a, c, g, or t
  misc_feature (273)..(274): n is a, c, g, or t
  misc_feature (303)..(303): n is a, c, g, or t
  misc_feature (307)..(308): n is a, c, g, or t
  misc_feature (327)..(327): n is a, c, g, or t
  misc_feature (330)..(332): n is a, c, g, or t
  misc_feature (335)..(335): n is a, c, g, or t
cnccccatcctttnccttatctacaannagttttccaggaaggtggaaanggaagtgttgctctcattgtgtgactcagtgctgctgtccatcccatggaancangggcacaancaagtanttgtccagcctattgcaggcttttcctgactttaaaanaangtgtgancaataanngtacctttgattatacagttattantgtgtctctgatgtactgtggattgtacatttacctttgnaatgcctttgtaataancagtcttaanaaanngttgacaagctctggttccttatttttanaaanngagaacatttaataataanaannnaangggattaat

SEQ ID NO: 639100 - DNA, 828 bp, Homo sapiens
actgatgtattggtgcgttgcgcgaagaagttgggggtatcgctggtgctgtgtatactgtaatcactgaacggtcctgggtgcgccctgtacgtatgtgctccgtattcatccacaaagtcccgaacgcgcgttttcatctctctcctctggcaggattgcgaggagtgcagttcctgggttggaatggagtgcctctctgacaaagtatgtgcgaactaataggctaatgcatcaatagttgcgccctcgtgccggtgacgaagaacacatgagaggctcactgaaaggtctgagaagcaaagtaactgctataaaatctctttccattgaaaatacggccatgaagttaaaacccagaatacattattagctgaaatggattcacaatttgatttccacaactgatttctaggtaaaacctatgtggcaacactgaagatttatccagagtgacgcaaacaaagctgctgtgcccatactgatgctgtctctccattgtctttccatcatctcattgccttattaccctgcaggttgcatgcactgtcactttgtcaactttggaattttgcccaaccttagtgcctttgcagacacccacttttgattaaacaatcagcatccaacacattcctagtgtccaaatactgtggcatttccattggaaattgttgcattttggtaattttataacccacttatctcatcccagggtcttgatctgtcctagtggctccattagccctattcacgggtagtacagtgtcaccataattcagatgtctattgtgccatgcactacaccatacatcgcacaccagccga

SEQ ID NO: 639101 - DNA, 621 bp, Homo sapiens
gatcggcggagagagctggctcaggacgtccgctaaggctcggacgagctgctgagtcctcccaaagcgcttccataaggctttggctttccaacttcagctacagtgttgagctaagttcgtgaaagaatggaaaaaagaagatccctgggccccttgtcttatgtgcttagccaaagtcgtcgttgtagtctttttgcccaaggctgttgtgtttatagaggtgctatctccagttccttgcactcctgtttaacaagcaccttcagcgagagcagcagcgagcgatagcagctcgcagaagagccgagcggggtctgctcagtgtcgatgaccatgggcgggagatcacaaccgggcagagaggatgctgtggatccttggacgactacctgacctctgcaaaattccttctctaccttggtacattctctcgtctacttggccgagatcgcgatgtggcacatttgcggatgtctgatgtttctggtagagctctatggaacacagcctccttttgacagcagtctacgggctggtggtggccagggtctgtatctggtcctgggagccatcatcggtgactgggtggacaagaatgctagacttaaaagtggcccg

SEQ ID NO: 639102 - DNA, 923 bp, Homo sapiens
  misc_feature (358)..(358): n is a, c, g, or t
taccaggcttcggaataatctcccatatagtaacgtgactactccggaaaaaaagaacctatttgggatacactacgagtatgcgtctgagactatgatatactaagttggacttccatagggttgtaacgtgatgacggcgacaccagtactatattagcatgtagtgaataagacagtacgatcaacatcggagcgataattctcagcacgtgccgtcttgaaaccaataagtcgtatcgcttaatcacgcactaccaaggggtcagaagctatgttaagcctgacatcgcgactactcgcacaggaaacgcaaatatgcaaattgattcttgcttgcacgtagctgcgtgtagcngcgtaaaggatttcagtcttcttctttggctaccaggtaggctgtgcctggactggcgaatttgtgaattagacaaatctcagtcgacgtaggacgaatcggtacctaccacggatcaacgctacctacgatatgctagactacgacttccatgctatgatcacgtagtcactaggtgagactgatcattagctcatcaatacggaaggcgttccatgtcagctggaatttgccacgcatatatcgtacatggcgtaacgactccttaggtaccaggatccttactgtcaagaatcccatgtccacgtaatcagtaattcagtcgggcgataaaattcctaaacttgtctttacccagcaacaacattttctcgagcctatccggaattgcccccgacgttactcggactaacccggatgcatacagccaggatgaagacattcctatcatcttgtaggctcattccatttctctaacaagcgaggtaaatattaagtaaatttgcatgatttgagaaagccttccgcgttcgaaggcgaaaagttcgtaagtagtagaaggaac

SEQ ID NO: 639103 - DNA, 120 bp, Homo sapiens
ggctggtgatcagagtatcccgagtgtcgcgctgtatcatatagtagaggtacatgccgtacttactcttgaattcagacctaattttacaatcatgtccacttcactgcgggagacact

SEQ ID NO: 639104 - DNA, 163 bp, Homo sapiens
ggatactttaaccgaaggacgggtaggtcattcaactccacatacatgcgctttactgcattagatttctgtgctttcttcctttccctctttgaagcaattaaaatcttcctggataacggcggttgtctttctactcttgtttcgggcaatttagtgagtt

SEQ ID NO: 639105 - DNA, 102 bp, Homo sapiens
  misc_feature (23)..(23): n is a, c, g, or t
  misc_feature (64)..(64): n is a, c, g, or t
  misc_feature (90)..(90): n is a, c, g, or t
  misc_feature (98)..(98): n is a, c, g, or t
tttcctctgcgttcgctccggcntgctggaggctgtcgtccaatgctccccaaacggcggcgangcgggtcgggtccctagcggcgatcntcctccangccg

SEQ ID NO: 639106 - DNA, 148 bp, Homo sapiens
ttacgtgatgtcgagaatcgtgccgttggtatattgagcaccacgtacttgtcagtttacccgggccactggctgtcttcttccggctgcttcaggacgtgtttcttccagtcggcaatggccgactccttacgcatcagaatgtctg

SEQ ID NO: 639107 - DNA, 246 bp, Homo sapiens
tattcccttcattatgcacatgatagtttgtgatagtaggtccagttatactaacaatcagatttctatattaagaggtctaacgtgatacgattattactatgcctccatgtgcagctgtgcactcttgtaaaggacatgactagtctcatcttaatctaagagcaagataatatatactgatcctctacagatagcctgctcctcataatctctcctatttttgtattacccagctttcttttt

SEQ ID NO: 639108 - DNA, 502 bp, Homo sapiens
tggctaaacataggtcatgcgtacacatatgcacacgtatgtgcacgtgccacacattttctgtataactgtcgggttcgcattatcaacagtgttgtcaaatgttctattgtatctgcatttagcagtggttggcttttatgaattgaaattatttgcgcattgatgcattgaaataaggaaaattatttatctctgagcactaaacttatttttgcatatttctgtaatattgcagtccccagatccagaacatgggaagttagggaaaatgtgtgattttgtgttttgaattactgtcagaattacatacacaattacaacaaactttttttaaaagacatttcattgtactgcaaaaatctgaatatttatatttcttgttttattctttatatgttttgcattttaatatgttgagccactggaaatttgtaacagattaatttgttataggagtttaaatttgtagtcattgtctccattgtctttgtccagagcc

SEQ ID NO: 639109 - DNA, 224 bp, Homo sapiens
tccgcgcctctctgtggggttgttctgagctttctctgactcctgtctgctgcactggagttaacgaactggaatgatgactcagtcctcttctcttatttctttgctggcctctccgtgtgtctgggagcgggagagaggctgggctagagaatggtgatgaactgtggccattactcttccacagctgtgatatgcctcaagtggagctgtaggaactggta

SEQ ID NO: 639110 - DNA, 221 bp, Homo sapiens
aaggctatagtgggctatgattacaccactgcatttcggcgcgggtgacagagcaaggccccatctcgaaaaaacaagaggacatatccgtgccaaaaaatcaacggacattacaagtgatgctcttcgcccaacatccaaagaactggtttaccggcacacaactgaatatacatcagatgaatgctaagagaaagaagatatagcaatattattgccaa

SEQ ID NO: 639111 - DNA, 164 bp, Homo sapiens
  misc_feature (34)..(37): n is a, c, g, or t
  misc_feature (39)..(39): n is a, c, g, or t
  misc_feature (46)..(46): n is a, c, g, or t
  misc_feature (59)..(59): n is a, c, g, or t
  misc_feature (62)..(62): n is a, c, g, or t
  misc_feature (73)..(73): n is a, c, g, or t
  misc_feature (100)..(100): n is a, c, g, or t
  misc_feature (107)..(107): n is a, c, g, or t
  misc_feature (111)..(113): n is a, c, g, or t
gtgggtgtcaaactccaagaagacatacactttnnnntnacttctnttgaagatattgnaanttccaattttncatgtgtactatgtcagaaaatgcttncgatttnattnnnaaatctaacatcggatggcttttccggagtgttgtaaaaacttcaatcata

SEQ ID NO: 639112 - DNA, 568 bp, Homo sapiens
tgtgaggaagcactcgtgatgagtgaggggactggcatctcattgtctgatgctgtgattggctgagtttcaggtctctgatgctttttgagaggactgagagtcctttcctgaggaaggaactcagataaaacaaatataattttcttttatagaatggcttgacctcaggagtttgaaaccagtctgggcaatatggtgaaaccctgtctctaccaaaatacaaaaaaaaagagggttgcttccaagatggctgaataggaacagctccggtctacagcttccagtgagatagacgcagaacacaggtgatttctgcatttccaactgaggtacctggttcatctcactgggactcgttgaacagtgggtgcagcccatagaggatgagccaaagcagggtggggtgtcacctcacctgggaagcgcaaggggttgggggatttctttttcctagccaagggaagctgtgagtgactgcacctggaggagcagtacactcctgctcaaatactgtgcttttttccactgtctttgcaactgacagaccaggagattccctcttgtg

SEQ ID NO: 639113 - DNA, 121 bp, Homo sapiens
ttataggtctctcgcttgctcaggtccttccttgctcaggtctcgtgggcgtgacagacctgtagcaagccagtgacctgtagcaagccaggacaacaacacacagacctgagcaagccag

SEQ ID NO: 639114 - DNA, 416 bp, Homo sapiens
  misc_feature (15)..(15): n is a, c, g, or t
  misc_feature (229)..(229): n is a, c, g, or t
ctttttcctcccctncccccaaacctcctccccataattaataattgccatataattatccttagtcctccccataaaattatcatgccatattatgaaatcctttaagagggaaaataggctgggcgcctggtggtcacgccctgtgatccccagtactttgggaggctgaggtgggtggatcacctgaggtcagaagtttgagaccagccctggcccaacatggtgnaacccagtctctactataaatacaaaaattagatgggtgtggtggtgcatgcctgtaatcctagctacttgggggctgaggcaggagaatcacttgaactctagaggtggaggttgcagtgagccaagatcttgccactgcactccagcctgggcaacggacgacactctgtcgccccaccccccaa

SEQ ID NO: 639115 - DNA, 656 bp, Homo sapiens
  misc_feature (137)..(137): n is a, c, g, or t
ggggtgggacttgggccacacgtctccagctcggtccttcttcttaagggcataggagttcgaggagccctgggcagcatggagtgagctcatctgccaggcactcagcaagggtcttaatgtctccggaggggggnctcacgagcgcttggtgcacagcagccagagtggccggggttcacaggggcgcaggggggacacatccacagcccgtggtcgtctcacagtctcccgggcggcgcccaagggcggtggtggagtccctccgcggggaaccacgggtctgatgagggcgatacaccaggaccgtgcagagggtcctcgccgtggtgagccagggtggtatgatctcgaaaggcatgctgtgacgagtgcgcacgagtcatgagctctctggccgatgaaggcggccgggcatcaacaggggagtaagggagggcgctccacaaggggacacgtgagacttggcggaagcgtagggggcgcataccgccctagcctggagaggcaggtactgggactacttctccttcaaggcaaggtaatctgcagggaaatgtcatggtctggacatcatcggggccattcccaagagtgatgcggggcccgcccgggggcgggtccaccgggcccgaaacagcgaggtctgcccgcga

SEQ ID NO: 639116 - DNA, 377 bp, Homo sapiens
ctgtggacattaagggatgtcagctgaaataatttctctagatgacataaggacacttagacaggtcgacggcccctcccgcctttggacctgtgtgtgacctgcttcggtctgataccctcagaggattatggcaatgagaagaccttggaagcagtatacccacaacactgtccgagggtgctcttatttctacagttaccctgcagtttgtgaatttatagcagaccaataatttactatcaatatatcagagcccatgaagcccaagatgctgggtatcgaatgtacaggaagagccacgccacaggcttaccaccacttattacaatatactctgccaccaattacctagatgtctataacaatacagctta

SEQ ID NO: 639117 - DNA, 136 bp, Homo sapiens
tcaggattcgtagatcggaataaaaaaaaaaaatccccacccctaccaatggttttacttcctcttccggctcagggagcagatgggcctcactgggttggagatggaatagaatacctggggctatgaggtcacc

SEQ ID NO: 639118 - DNA, 352 bp, Homo sapiens
gcggcgttcgtgtacgagttctctgcaggtcactagtttcccggtagttcacctgcattaatagaatcggcaagtaacccaccaaaacaaaacaaaaaataaacataaacaatctaaatcacaatacaaaactatacacaacaaaacataaaacaaacacacatcccaacacaaacactcaacaaaaacaacaacaaacaacacaaacatcacagcaaacaaacaaacataaataattaataaaatcacacaaaaaacactaagaacaacaaacaacaacacaacaaaaaacaaaaatactcacaacataacaataacacagacaaaacatacacacaccacaacactaaat

SEQ ID NO: 639119 - DNA, 469 bp, Homo sapiens
tgccacactaacaactttatttctctactcttgtgtctacaactaaactttttataaatgtacgaagtttgtcattaccattatttcttcctaaactacctctatgcttaaatttattgttccataaatctaaaggttgtagtcttgtcctgattcatgaattgtctctatgaatgattgccatcattactagcagaatttatcaacaaattgtcctgtgattcacaacatgatatattataatatattaggcagacgtattgtcatcaaataccaaatttatcttgaaaaatgatagcagtacaacataatggtaattatctggctccatagataaaaaataaagaatgcttagtaaagtacttgtaaaacctgcctctacataaaatagaagaacatgtgcaaatcatacctgaaagaatttggagttcaaattcttaaaacaactacatttaagtgatgcttttgt

SEQ ID NO: 639120 - DNA, 331 bp, Homo sapiens
  misc_feature (66)..(66): n is a, c, g, or t
  misc_feature (126)..(126): n is a, c, g, or t
  misc_feature (145)..(145): n is a, c, g, or t
  misc_feature (165)..(165): n is a, c, g, or t
  misc_feature (183)..(184): n is a, c, g, or t
  misc_feature (199)..(199): n is a, c, g, or t
  misc_feature (202)..(202): n is a, c, g, or t
  misc_feature (222)..(222): n is a, c, g, or t
gatttctagaccccctttctgtttggatggcctatgtgtatatgcatggccaaaggcacctggggnctgccgggaggctataggatatccgcattagggaccctgagcctttaagtggtttctatnccttcttagttattatgtnccaccttcttagttattacntgccacctcccctatganngacgtgtttgatcantancagaatagcaagcagagtancattcatgctggggccagaatgatggccggttgccagatataactggctttgggagcaaatctcttctgttttagagagatagaagttatgacatatgttaattacaca

SEQ ID NO: 639121 - DNA, 515 bp, Homo sapiens
  misc_feature (35)..(35): n is a, c, g, or t
  misc_feature (45)..(45): n is a, c, g, or t
agtagcgattttattatcaatgttattcattcttntgaaatatanagtacttcagctgaattaaggttgcagataatttttaaaatacaacacacatcatgactagtatattaaaattatttatattcagatatttatatctaatatcaaatgaaaatttactaccaaattttcacagtagacattaatcagtctgacatgcttattgatcccataggtgtaattatagatcaacatgattttagtgtctattcttttattttactaaattaggaacgcagcatttacagaacaaataaacacaagtgacgtggccaccccaggatctaacagctcttcagtgagctatgttgcaagctcagaagtaatccactaacgaaccaagtcagactccagttcttcatcaaaaggtgctggtggaggttgtcagacgccttccaatatagatccccaatccgatggccagcaaatgagagagcagcagagatggaaggaaaactttcagaaattctgca

SEQ ID NO: 639122 - DNA, 967 bp, Homo sapiens
gcttcgtcaagcccccaggctccgcgtcttgcgtgagggacaggagccatggctcagaaaatggactgtggtgcgggcctcctacgcggttccaggctgaggcctccgtacaagacgaagcgccttgtcatatgcagacgcttgatggaggccatccagatctcagagggtccacctactaaccaggcccaccgcaggtgctagtccccagagttcacagtgcccaactgccaatgagatggctgacattcaggtttcatgcagctgccgctaggtgctaagtcagcctttaaagtccagaatgccatcagcaaaatggcccatgtggtgtctatgattactctcaggctcataatgccaaggatgtgcccaacacgcagcgcaaggtagctttaagtgccaaaatgctagcccaaagggtccaaatgctgctatgatttcttcccaggacagcaatcacttggtgagttagctgctaagaagtctgagatgtgcttcaatggcccagaatgccactacgtaaagtgtgcgcacattgccacctacaatttctctcagtctctcaaatgccaatgacctggtcaaccaggagggctaaggaccccttatcacggttggaatgataccactaaaggcccgagcagttgataacccagagccagaatgtcaattcaggggcaaatgggattccagggtgacttagagaacgaccatgtttttctgagctggtggtgaactgagcgacctcggagatggtccaggtcagaattggggtccggacatgatcgtgcagagaccgcagattatacttgatgtgggacagtgaggggactaaggggcactgttcaggacgagatggcatgtcaccgcctaaccgcgtggccaagtgtgacaccaaggtggaccgtcgtgaaaagcgggcacagtacctgttcccggaacttggcgtgtgacaaagataccttgg

SEQ ID NO: 639123 - DNA, 385 bp, Homo sapiens
ctgtaggaattcggcacgagagagccgttgcctcttgtgctgtagacacagccacagcctgtgtaaccgccgcctctggaccggctgtatgattaggccacaatctttaatgagtaaacatattcctcaatatctgtgaggatcttggtcacacatttatggaggttctgaagggcagcggagattactgcgaagcacaacacgaactctatgcaaacaagtgagacacgggaaaccgagtactggttcaacaagaaacccccatatagaatgggtattctggacacgtgttgaattggaatccacagagcattttacaagagttctgaactgtatggggtatctcagagcacttgttttctgttggtctcagttactggattgc

SEQ ID NO: 639124 - DNA, 810 bp, Homo sapiens
  misc_feature (483)..(483): n is a, c, g, or t
  misc_feature (612)..(612): n is a, c, g, or t
tcatttcaaaataaagaacattctaaaatgaaaaaaaaaaaaaaaaaaaaaaaaaaaaaaaaaaaaaaaaaaaaaaaaaaaaaaaaaaaaaaaaaaagggggggcgccccaaaaccccccggggggcccattcccccccatgtttgttgcagaaacaagggggccccaaataagaagcgtgcatattaataaacaacgaacaagcgaccagcgggcgcggtctaataaaaacagcggtggagtagggagaaaaccactgagatcaggtaggctaactgttggaggagaagcacaccacctatctagtcgtcggggggggaacaaacaatatagggcagacccacccaccacccacacgagaagatatttataagccgcctcacaagaggagcaaacatatataaacaacttagaacgaggctgatactactggatggtagagcagacaccaacccagcacaaagatatatatttcgcggcggngcgtgatcggaagacaaagcttatcgcgtccccatcaacgacaggtgaagatagacgtatctttatagcgaaaaacaaatttatcatcctcccgcgcgggagctcgattgcatgaagaaataactacgnacgtagcaaaaccaaacgatcaacaatcgaacgtaacgaccagcagatacacaacagcaagaagtcaaagccatcagagaacacagaacaagcaaacagtcaaaagcagaccaacacaaacgagaagcagaagtagccgataacggaccggagcagcacaacgacaaaccaagcaaccaaaaagtagagcatagaagt

SEQ ID NO: 639125 - DNA, 92 bp, Homo sapiens
tccaggaccatctgcccagggaatggtgttgccctcagtgggctaggaccttctacatcacaataatcaacagtcaagccagtccatcacag

SEQ ID NO: 639126 - DNA, 118 bp, Homo sapiens
taatctgtacttgcggaagccaacgactaccggcgccagttgcagtccttgacctgcgacctggagtctctgcgcggcacgaacgagtccctggagaggcagatgcgcgagcaggagg

SEQ ID NO: 639127 - DNA, 234 bp, Homo sapiens
ggtacctcgtagttgtaggaggcacctgcagcgcctgagcatcccgtcatggtggtcaccctggaccccacgcgggaccagtgcttcggggaccgtttcagccgcctgctgctggatgagttcctgggctacgatgacttcctcttgtccagcgtgaagggcctggccgagaccgaggagaccaagggcttcctgccggaatgtggtgtacgggccgagccactaccgccttgg

SEQ ID NO: 639128 - DNA, 155 bp, Homo sapiens
ctggcaagacattcaagtgaagatgcgcttctggggtccccgcggtctgtcatctgacttccgccctgtgcacccccttctctgtgacccatttctcatcactgacatagaaacccatagacccatacacaggtcatgtcactgtaccctcctgt

SEQ ID NO: 639129 - DNA, 284 bp, Homo sapiens
tgtcatcatattgtctgtgccagagtgggatttgatgagagggttctcctgctatttcaggtggtagattcacattctccccatgtgccggagcttctcaactaatttggttctcacaaaggcgattgatctgtgtattgctgttgaatcagtgtgtctgtggatgaaaggaaagtccaggacttcctattctatcatttcactgacatcgttcttatattccttctttttgaccctcttacgattttccatactgtcttttatccatatcttgctttttatat

SEQ ID NO: 639130 - DNA, 451 bp, Homo sapiens
aggtcccctgaagtccaaaaaagacatattgagcttagttggtatattaagatcatatagaaaacactgtcaaatataaaatggtgtttaaatttctttgggtcataatcatataaatgttattaatttgtattccaaaattgtatttttggaacaaaatacaattttttttcctaattctcattctgatttgtctataattctgatttgtctcagtatttgtatccagtaataattatggttatgtgaaattactgtgtgccacagagatggctagatttccttgttaattgtggctttaactgtgactgtcctaagacttttgtcatccatggataattgttgtcttgatccttttcaaaaggtggcttataatcagctataaaactctcatgggtgcccttgaatgaaggtttctgataactttagtggttgtgccattgaaatagaa

SEQ ID NO: 639131 - DNA, 922 bp, Homo sapiens
tattcccagcaacaaaacacaaagaagagaagacatatgacgaccggccgccatggggaccatgttccccccgcgtgtgaacagagtcccatattgagccctcctctaaaggcgccaattcactgcccgggtaaggccaaccactgtgggcaccccgcctttaacggcacacccactggcaaccggggactagtgcccacgggcggaacgcacgtcagcgtcgcccggtgcgcgccgcgagtgaacccccacgtctggcgcagaaaagtgaaacactagtgtgtcttggcaagtgccccagctgttctttgttccggaaagtgttacccctgccttctgtttacaatcagttgaagttcgtggcgcccaagtggtcagtgtaaagagacaaatgcctgttgtcccccccccgccgctcactgttgttgttgatggaactcactttcatggtgaaatgggaggtagggatgggcaatatgtgacgactgcctcctttgcgacgccaccgttggttcataaacgtccccacagagttcttccctaaaaggggcagagtcaaccatttcttatctggtccacactgcggctctatacaggaccccttccaatcttcatgtagttacccctctcctgatcccatctcaaacaaccgcgggcgacacacattttcacaacacacggcgtaatcaataaatgtacggtattctaaatcttgtttggcacattaatattattgggctcacaggactcgcgattaaactattctcgcctgcacccctccgtaggtgctccaattaaaagaaaaaacaacaaaagaaacctcgctgtgttaaacacacacaacgtttgtctttttcccccctccttttaagcccactcttcccccctcaaaaaaaaaatgaacaaatcgccccacatgaca

SEQ ID NO: 639132 - DNA, 101 bp, Homo sapiens
agactctggtcccgccaaagtggcctccaagaatgtcatcctgccctggaactggtggagcccattaagaatgcacgaggtgcagcaaagtctgatgttta

SEQ ID NO: 639133 - DNA, 649 bp, Homo sapiens
  misc_feature (274)..(274): n is a, c, g, or t
  misc_feature (325)..(325): n is a, c, g, or t
  misc_feature (341)..(341): n is a, c, g, or t
  misc_feature (365)..(365): n is a, c, g, or t
  misc_feature (380)..(380): n is a, c, g, or t
  misc_feature (393)..(393): n is a, c, g, or t
  misc_feature (397)..(397): n is a, c, g, or t
  misc_feature (404)..(404): n is a, c, g, or t
  misc_feature (413)..(414): n is a, c, g, or t
  misc_feature (421)..(421): n is a, c, g, or t
  misc_feature (450)..(450): n is a, c, g, or t
  misc_feature (467)..(467): n is a, c, g, or t
  misc_feature (481)..(482): n is a, c, g, or t
  misc_feature (485)..(487): n is a, c, g, or t
  misc_feature (489)..(489): n is a, c, g, or t
  misc_feature (492)..(492): n is a, c, g, or t
  misc_feature (495)..(495): n is a, c, g, or t
  misc_feature (632)..(632): n is a, c, g, or t
  misc_feature (635)..(635): n is a, c, g, or t
  misc_feature (642)..(642): n is a, c, g, or t
agagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttntacactaaaactttacaagataaaactggacttcatttagtatcttttctnacagaattacttggantaatgagatacgaattacaaaccnttttttttccaaaantttaatctatctntttngacattnggaaatttnnttaattntacaagtacatttaacagatcatttatanagcaggagtccattttnacacttaccgactnnttnnngnttnggnaacatattaccacgtcttaataggatggtgcccatataggtgagcatccctttagatcatgggaaccagcagacttcattcctaatcttcattatgcctgagacttgtcttacaatgttacctttaagtgaatcacntantcgtctnggaaact

SEQ ID NO: 639134 - DNA, 619 bp, Homo sapiens
  misc_feature (274)..(274): n is a, c, g, or t
  misc_feature (325)..(325): n is a, c, g, or t
  misc_feature (341)..(341): n is a, c, g, or t
  misc_feature (363)..(363): n is a, c, g, or t
  misc_feature (367)..(367): n is a, c, g, or t
  misc_feature (374)..(374): n is a, c, g, or t
  misc_feature (383)..(384): n is a, c, g, or t
  misc_feature (391)..(391): n is a, c, g, or t
  misc_feature (420)..(420): n is a, c, g, or t
  misc_feature (437)..(437): n is a, c, g, or t
  misc_feature (451)..(452): n is a, c, g, or t
  misc_feature (455)..(457): n is a, c, g, or t
  misc_feature (459)..(459): n is a, c, g, or t
  misc_feature (462)..(462): n is a, c, g, or t
  misc_feature (465)..(465): n is a, c, g, or t
  misc_feature (602)..(602): n is a, c, g, or t
  misc_feature (605)..(605): n is a, c, g, or t
  misc_feature (612)..(612): n is a, c, g, or t
agagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttntacactaaaactttacaagataaaactggacttcatttagtatcttttctnacagaattacttggantaatgagatactaatctatctntttngacattnggaaatttnnttaattntacaagtacatttaacagatcatttatanagcaggagtccattttnacacttaccgactnnttnnngnttnggnaacatattaccacgtcttaataggatggtgcccatataggtgagcatccctttagatcatgggaaccagcagacttcattcctaatcttcattatgcctgagacttgtcttacaatgttacctttaagtgaatcacntantcgtctnggaaact

SEQ ID NO: 639135 - DNA, 476 bp, Homo sapiens
  misc_feature (225)..(225): n is a, c, g, or t
  misc_feature (234)..(234): n is a, c, g, or t
cggtggcggcggcggctcccacattcccgtttccctgaaaggcagctttatttccacctttaagatcaccatcatcatcaagacctaaaaaaaaaaaacacacacacacacatttttgctgttgagctcagcttatcaaataagaacaaaacccattaaaaaatgtaaaggttacaatggttaataaatcagcattatggcactggtcacagtttatttcctaanatgcctccngatatatgcagataccatcttctgactgaaggtgaaagcttatccttgaagaaaatacagacagacggcagcacacacggcacctggcctaaggaggaaagcagaacatgagggaaggagaggaaagcccatctatcttctcacagcccgctcagcaaggcacaagcctcagcagcagcagatgcctctctgttgcctggtaaccactctcactagctgagcaaaacagaacaaacaccaat

SEQ ID NO: 639136 - DNA, 295 bp, Homo sapiens
cagggagccctcgcttcggtcatctcatcctaagggagaatcggcggcagaatgtcagaagtatctacaattcaatgatattcttcatagtcaaggaaagtaactctgcaagtaagagaaactgcaatacaagtaggaaaaggatgtgatatccatattacaagtcattcaaagacagatgagtcatcaccgagtgttatcgccaaggaagccttctcacccagtcatggattatgggcagtgcaacatctttagacttgactcttcctcaccagcaacgaacttctagtcatac

SEQ ID NO: 639137 - DNA, 276 bp, Homo sapiens
cggctgcgtacagtggtgtgatctcatgctcacgacctccagctcccaggtcaagtgatctcctgtctcagcctcccgagtagctgggattacaggtgcatgcaccacacacagctgatttttgtatttttagtagagtttcatcatattggtcagactggtctcgaactcctgacctcaggtgattcacctgcctcagtctcccaaagtgctgggattacaggaatgagccaccatgcctggcctttgttgttttattgagacagagtctccctt

SEQ ID NO: 639138 - DNA, 361 bp, Homo sapiens
gagaccgccggatcttcacacgtaagtgatgagtgtgtggctacatacaaaggagtcccttggaggtgaaagggaagggagtatgtagggctcaaaccattagcaacagtggaatcaaataaaaggcttccactaccaaaagacattagagaaaaccttaaaagtactaaagagaaatatattggtcacttaaaaaaaaagcattacctggtggggaaacaatagttagaatggcctcgggatctctgagaagaaaccagggaggccagaaggcatagaacaatttttttttttttgggagatgggagcctggcccggtggcagagagccaagaccgggcggcctcaggggtacggagctc

SEQ ID NO: 639139 - DNA, 250 bp, Homo sapiens
gtggctataagagggcaatatgagggatctttcgtagtaataaaaatgttctgggttaggcacggtggctcacaactataatcccagtgctttgggaggccaaggtgggaggattgcttgaggccagaagtttgagatcagcttgggcaggacatcaagaccccacacctacacaaattttttttttttttttttttaagacggagtctcgctctgtcgttcaggctggagtacagtggcgcgatctcgg

SEQ ID NO: 639140 - DNA, 132 bp, Homo sapiens
cccgtgaagatcggcgactttgctttcgtgaagatcggcgatttcggtttggatactcggcgtgtgcatgcacacgctgagaatccaaactgcacacgccgaggaaccagaccatagtcgccgatcttcacg

SEQ ID NO: 639141 - DNA, 290 bp, Homo sapiens
agtgtgttactagagaagtttctctgaacgtgtagagcacctcagaccccaagtagctgggaccacaggtgcatgccaccacaccaggctaatttttgtatttttcagagagacaggatttcattatgttgtccaggctggtcttaaactcctgagctgaagcgctccacctacctcagcctttcgaagtgcccgctatttacaggcatgaaccactgttgatccagcacttccccgttttgttttttggcttatgaattttgttgtttattatgaaatgtaagagtgag

SEQ ID NO: 639142 - DNA, 666 bp, Homo sapiens
  misc_feature (7)..(7): n is a, c, g, or t
  misc_feature (53)..(53): n is a, c, g, or t
  misc_feature (468)..(468): n is a, c, g, or t
caaaggnctccaagagtaaagaacatagggtcgccttcgggcggcctttttgngttaaggaggttgactaatgtattacgttttgattcgcaccaagaagggcaaatgggcaagaccatgtatggagcacgtcgctctgacagtcctccctatggcttcggtgacgtgaccagcgagaacttcaaagggattcccttcaagtttgaagctgatcaggctctgcaagcggcccgccaagatcaccctaaagaaacctatcgactggtttattccgaggaggaactctaatggtcaacgaacaggatatgaagcgagtacgccgactgctggcactgcttcgcgctgagggtatcgactgcatcatcgctggcggcttcgctcgtgatgtgttcttcgaggctgacccaaaggacatcgacatcatttgcggtggcgtcgatcactacaccatctccacgttgttcgagnagactggcacgctgacccgtagctacccgaagtacaacggacctgagtctgatcgcttggccggtgtctggaagatcctcgatacgaatatcgacgtgatcctctacgaggtccctacagcactggaagcagtcgagcaagttcgactacaacctcaaccaattcgtctccaacgaggagaccgagaccagccacgac

SEQ ID NO: 639143 - DNA, 113 bp, Homo sapiens
ctcgcttccctcccgcggcgaccagggcccgagccgagaagtagcagttgtagctacccgcccagaaactagacacaatgtgcgacgaagacgagaccaccgccctcgtgtgc

SEQ ID NO: 639144 - DNA, 389 bp, Homo sapiens
  misc_feature (3)..(3): n is a, c, g, or t
  misc_feature (61)..(61): n is a, c, g, or t
  misc_feature (140)..(140): n is a, c, g, or t
  misc_feature (143)..(143): n is a, c, g, or t
  misc_feature (151)..(151): n is a, c, g, or t
  misc_feature (154)..(154): n is a, c, g, or t
  misc_feature (163)..(163): n is a, c, g, or t
  misc_feature (169)..(169): n is a, c, g, or t
  misc_feature (181)..(181): n is a, c, g, or t
  misc_feature (189)..(189): n is a, c, g, or t
  misc_feature (218)..(218): n is a, c, g, or t
ttnttggccgttgtgtaagggatggaattttaccgatgttggcccaggctggtctcaaacnccctgacctcaggtgatccgcccgcctcagcctccccaaagtgcagggagtataggcaagagcagaccgtgcccggccntcnatctatanacnttaccctantggttntgttgctctgantactctgnagaatcttagtacaatggcatttacattngactgatgaaattaatgaggaaagaatttgagatgttttaagataaatattttttagacttctatttagaaggatagtgtttctgaaatgtaaatctggtaactttccctggttgttataacaggtgtattatacagtttagaaacatgaagttatccaatctgccaagtt

SEQ ID NO: 639145 - DNA, 159 bp, Homo sapiens
  misc_feature (1)..(1): n is a, c, g, or t
ngtcacacaaagacaccacagcagccagggtagaaacaactagtgtatggattgggggaggagagaaggggtgcagatgggaaagggggaggcaagggctctttagcgttggccaaaaccacggccacacccctccaccccctctggctttccacctcg

SEQ ID NO: 639146 - DNA, 304 bp, Homo sapiens
  misc_feature (186)..(186): n is a, c, g, or t
ccccttggggtaaaaagggagggggagggggggggggggggtttttttccccaatttattatgaggttttttaacccctttgggggcaaaaagggggggggtttttttgttactgaaggggcccttcccccggggtatttgaaaaggaaagggctttgggggtttttgtatattttgaaaaaaaanggttgggggatttacccccctttttgggggggggcccccttttggggaatgggaaaaaggttttttttataaaccggggcggggtttcaaaaaacattttggcggcctttttttttta

SEQ ID NO: 639147 - DNA, 111 bp, Homo sapiens
tgcacagctcattctctaccccctgtacaaacacatagctaccccttcttgtactatccctatgaggctaattataccagctccatctgctacgaaaacatgaactaaaat

SEQ ID NO: 639148 - DNA, 116 bp, Homo sapiens
ttttggttttgcccatattgctgccggcttggctttgagtgccaattcatacgcaaaagaaatcaaaattagttcaaataacacatcttactctgatgcagacgtccaaaaactgg

SEQ ID NO: 639149 - DNA, 968 bp, Homo sapiens
aatcataaatgagagcgggaacggatatgaaatcgagtgggattgatccccagggtgtcagtagctgggggatgaccgaaggacgcgtatgcagtgctccgtaggccgaaccttgcaggtgccagccatgtgctgctctcgggtgcgcggcgcctctcccagggcggtggtttccaccatccgcactgtgtggcatttgatttagtatatcattgtatttatcccgaaaacggggggaggtccgcgttgtcggtccaccaggtgtgtcttgccagctggactttgatcttcagggcatcaactgggtccctcagcgttggtccgcagaggtaagatcgctgattcatcctggtcttccttcccttttcatgcttagttgggttactcgctggggccacagtttcctaatcgaattgccccacggtataaatgcggccaagtacagttcgctgccagtcagtaagacagggggatttgtaccttttgagcggggccctagggtagggccatctcggggagccatcctttgatcatcgctcgaaatcgtgaacctgaaattggtgtcccgtcccattgttatagtcgcatagggcatcctcgaggctcttggcagcctaaatgcgggttcatgccccacaaaagtctttcttgtctttggtgaagcacgccttagggcatagggtaagttcagtatttgcctgaaggaatgttccattcgtgtgttccatagaaactttttgcgggaacacagagggcggtcgcgggaaactaacgcaggtgctttgtccttcaagaaccctgagttggactagggtgcatctgggcattggcaagatcgactagttgttgattgtggtcccccatggtagcaggacccaacgggagatgatggacttgaagtagccataatttagaatgtctgaaaattaattcgcgtcctgaaggccttaagcggttcgcacattggg

SEQ ID NO: 639150 - DNA, 112 bp, Homo sapiens
  misc_feature (7)..(7): n is a, c, g, or t
cccaatnaaccctactaaagtagaaaatatcaactaccatccttttctctacttcccttgcccctcattaaagactaatacaagttagtctttagtgagggttaattcgcgg

SEQ ID NO: 639151 - DNA, 444 bp, Homo sapiens
  misc_feature (19)..(19): n is a, c, g, or t
  misc_feature (38)..(38): n is a, c, g, or t
  misc_feature (53)..(53): n is a, c, g, or t
  misc_feature (382)..(382): n is a, c, g, or t
gggagataggttatgaaanaagctatgtccagggtgantgtaactcaaaatantcacacatttaacaagatacttcaactgaatcttattttagaattattgtagttagaatttccttttaaagttgtaagtaggtaacattttatttgaagataaatttatatgatttttatattgtataatgagtaaagaactaggatacaatgaagtctacctctatttaaaggaatgatgttgacaaatatataccgtgcatgtattttgaagatttcattaaccaaaatagaagaataagaattttctatcagcactgtttttgtttggaattaaacatttccatactaatataaatgccaaaaaataaatcaacttttacatttcnttcagttttaatagtgtaaggtcctaggtggaaagggtaagggatatgtatattaataaatt

SEQ ID NO: 639152 - DNA, 961 bp, Homo sapiens
gacacagattggaagacacactccatgaacacgcacgggctgtacgcaggtcacaaatacttcggccagttctgcatttcttggtaacatgtcaacagaaagttctagaggatctccaagtaagaaccgtaacaaaagccataaagaatatcctgcaaaacatgtacctacttaccagcccttgaaccatatctatatgatgctcctcccaatattctgaaacatgtggtgggacagttcagtaacggtgctgccgcattgattagcaaagctcgagagacttcatggtaacacacgtgtgtgcgccttagcaaacagttcaacgacgcatacaaaggcagaaccttggttctactcctttcaacgaatacattcaaccagtataaccagctgtgtaaccccgaggcaaatacgtgcaggtataacttcccctggactatgcaggatacacctatctgcagagggttgggccagcctatacaagccacttagataacttgagcaaaagttatattggtgatactcaaaatacacagcagagttagtatggagtaagcagtaattacatccttctaaatatttggacctaagtatatgctagatgtactttaatgggtgacaataccttttagtattataatgttctaaaatttatggtaaatactttaaacattcggaggctggaatatgtgaggaactatccaggggccattcggattgcataggaataggtctaacaggtaaatttagcaaaacccagtttaaacggcggccttaaagccaaatgcgcaaacccgcggaaaacaccccaacaacactcggtacaatgtggaacccctccacaggggcatatagctagcagcgtggcgttaaaaaccccataatattcacccaggttatcaagacaatgcaaacaacacatgcgtgtcacaattagtgtacccacacacacttgtgcggc

SEQ ID NO: 639153 - DNA, 93 bp, Homo sapiens
  misc_feature (37)..(37): n is a, c, g, or t
  misc_feature (64)..(64): n is a, c, g, or t
aaacccccactctcatactcttccactctctcccctncttctgcatgcgattatctgaatgccntaggagatgcaaacctcaatctcccatgc

SEQ ID NO: 639154 - DNA, 144 bp, Homo sapiens
cgttgtagccgttcatgcaagaataggaggtggagtgctgcgtagggctgctataactgaagggcaagatgaagtgaaaggtagagaatcgtgtgtgggtgggactgtctactgagtaacatcctcagattcattgaactaggt
